United States Patent 8,216,786 (GENETIC POLYMORPHISMS ASSOCIATED WITH CARDIOVASCULAR DISEASES, METHODS OF DETECTION AND USES THEREOF) - sequence listing, part 9

SEQ ID NO: 1241 - DNA, 1210131 bp, Homo sapiens
aggacactttcagggcactcttgttgagttgctcagctggaatttttataatagcctatgacacaattaaatatacagcccatatccaaggaagatattgctagctgcagagaagtgatggtgtctctctgaggagctgtttcttatgacagcctcccttccctatataaaccgggggcagcctgaccagcagtgccaggattataggcatctgtggagtagtgcctactcaagtatgagctcttctactttttaagtgtgtgatgttgggccggcaattttaactcccttagtttcagggttctcatctgtgaatacaaatgaaaatactttacaaggttattatgagaattaaagagataacatatgtcaagtgcctggcatacagcctgatacataataggcatgtaaatggtggtagcatgtttctcttctattccatgtgaaattcagtctatccccagagtggtcactaggcatacattctcacctcttctctttccactaacatgaccataaaaagccattttcttagtttctccactcaggcctacttcctcacagagttgagctctaacaacttgcaattctttccaaaccattaaatatacatacagatatgtatgtgtatatatatatatacacgcacacacacacacatatataatatatatatacacacacagatagatgtatatttaatggtttggaaagagttgcaagtggttaaagcaactctttctctctctatatatatgtatatacacacatacacatatacacatatatgtgcatgtgtatatgtctctatgtatacatatgtgtgtacatgtctctatatatagagagataggtttctctctctatatagagagcggattctatgtatgtatgtatatagagagaggtttgtatatttaatggtttggaaagagttgcaagtggttaaagcaactctatattatatataaaatctattatgatataatagacaatgttagtgtgaaattagtaatgtataatattaatacattacatgattaaatatatattacattgaacatatacattacatattatacgtaatgtaatatgttacattacactaaataaatatatgtaagatacattaatatatatttactaggactcatactaattttaattctaaactcaaccaggaggcacccacatttacagggcaataaagaaagaagaggtaatttaaaaagcaaaaggggcaaatacagttttgaaatgaaggctctctctgaacagggaacctcagggtatactgtcggtgcaaaacagaggagtatttaccaccctaccgtgggttcaccatcacctcaaatgtgacataacatggcattgggttttttagtggatacaacacataaatttcttctgtcaaatttaaagacaatcgaaatgttcacattttttcacactcatttgaagtcaaacctattatttcctattgctcacttgctgaattgggattttttgttgggagtgggtaggtgtctggaggagttaccaagtgtagtcctttccaagtattttcattcatttagagattttagattaatttcattgttctattctgctgaaatctttttgaattttaatggtgctgacaattataatagttattccttctagttttctatcaccaactaatttattctgcatgttaatatctccatgccaggtatcagtttaaaaatatttgctatggggacgaggggaagcagagcactatgataagtcacaggagaataatcttttaactgggcgttaattgatattgaccaattaatacacactctggtagtagggattcaccacacttcattatagtttggatcatatttaacttaggtatttacaacaataccatgagtataatacaaaacacttgtaaaaatccagatatgattttttttgtgttaattttcagtcatttcaatctgcaataatttattctaagtgaacccatgctggctcccagtggccttacatcctttcctaagtgtttataaatcatgtcttaaataattaatttttatctccagtctgagagagatttcaagctcacttgactgtagttagaaataactatagccttccattaaaaaaaatcaaggaaacctattttcaaaaggcacaaatgcctctcctattccttaaagattaacaaaagtgattcagccatctctttggaaatacatatttgaagcaagaaaggttgggtatttttggaataagcactctaggaccctttccttgctggagattttccccctaccatgccctacacaaatcaccctcttctatctagctgatttagtctcagactccagaattttacatacccattatcacctcaaactctttgctagattaataggaccactgagtcttattatattatctccaagaggtcatccctgaacacctcactccctcctgtctctaaactactgcagtattttgttgttgttgttgggggaggctattacataaatagagttttaaattataggtcaaaaaatacacctgttttctttgttcagattggaggctgcttgaaaggatgaactctttctttttcttccatgcaaccatcttgttctcttatattgatattaggcattaagaaaagcttgctgatgaatgatagtaatgaagcctttccttccttgtcatatggccacacacccagaattagacgtctgttgaccaaaaatcagttgcaaaactggcactggacaaaaaatcataaattttaaagtgggaaaaagcacttattaaatagaatccttgtttttaattagtttaattagaatgcttcatgttgtaaaatgtatatattctccttaacctggattaaataataaaagaattaattgacccctataagtgagaaatccaaaggcagggatggctttaggttagatggcttattccaatgacccaaataatgtaaccaaaatctcagtttctttctgtttcttcactttgattctacagtttcaacttcattttcaggttctgtattagcttttttgttgctgctataacagattgctaccaaatttgtggtttaaaacaaaaacaaatttattatctcacagttctggagatcagaagtcaggaaatgcatcttttacttataaaatcaaagtgttcacagggctgtgctccttctagaggctccaggggagagcctgttcctctagcttctagaggctgcttgcattctgtggcttgtggttcctcttgagcaatgatatcactctgacttctgctgtcattgtcatacatccctttcttactctgcctctctctttcaacttttaaggatgcttatgattgtaattggtcttcctagataatccaagataatctccccattgcaaaatccatctttatcacatcacaaagtcccttttgccgtgtcaggtaacagtctggcctagtatctggatgtgggcatctttggagggctgttatcttcctttccacagtcttccttctagtcctgatagattcgcattgatttcccatgaaaactacgttcatcccttcccagcatgtccagaagtttcaatccattacagcatcaactcagagtccaaaaaatctcacattagcagctcaaaggacccaaatcacatcatctaaatcaggtatgggtaagactctggctatgacccatactggggaagatttcctcttttctatggacctgtgaagctagaaagcaagttatatgatctcaaaatacaatgttgtaacagcacacaaagccagctacaaaacttcttctcaaaaggaagaaagtcagaagaaaataaaaggaatccttggtcccaagaagttttgaaatccagcttggcaaaaaaaaaaaaaaaacattagttttcaagtcttgggaacaattatctgtggtttatgtcttcatcctcttggctctgagctctgccctctaggttcatatttctgaccttgtaattatttttctttcattctttttcataagggtagtacctacttgcaactgagtactcgtagcttctttcctgcctgtagaattttaaaaatctagcagccttctttcattttgtcttctttgtccctttgagtccaatctggcagtgtttctgctgatataacaatctcaagaagcttgctggtcttccacatatgtcttgggtatttactctattagagaggagactcttccacaggcctttcctgcataacttcttctttacttctggcttctgtcaagacagctgagaggatccatgagtcacatgcctaatttcctcaaaaaacccactgcatgactgaatattctgatcttttgatctttgtgaggcatgagcaacacactatttactttctctacacagtatgcgttcctaaccataaatttcctaatttcagtgtgatttataatctgaataggctgataatttcccaaatcaagtactgttgttttctttttatataaagagtttttccctcagtctatctctttatcatattttactataagcagcaaggagaaatttgatcacatcttcaacactttgtttggaaatcttagcaaatatccaagtttatcacttgcaagttctgcactccacatagtagtaagaaataactgtgctaatatttttgccactatataacaaggaccccattttgcatttttttctgagacctcatcatcaatgcctttagtgtccatattttactaacagtctattcaaggcaatctaggcattttttctgtttcccaattccaatgtcacctggacaattttaagtattgttacagcagcgtctcactccagggaaccaaaatcaatactagcattctattactcttgcaatcaaccaccacaaatttaatgacagaaaacaacacaaacaacacaaatttattatcttacagtcaaatattcaagtaaagattttacaaagccaaaatcaatatatcagtaggactgtgttccctacagaggctccagtgaacatctggtttttttccttctccaaccttcagaggctgcctgcattccttggctcatgaacccttccagtaatggcatcactgtgccctgacctctgcttttgccctcacatcccttcctccaactctggctttctgtctctctcttccattttctaaggcccctgtgatttcactgggcacattgggtaatcaaagataatcgcctcatcttatgatcttaactttataacatttgcaaatcccttttatcatgtaaagtcacattttcacaggttttgccgattcggatgtaggtattttgaggtagggggtggagggtatttttctgcctaccacaggttcttcatggggatctgatggaagcaccaagatttcttttaaattagtcccttcattgaaactcatactcttccacagtctgaggggaaaaggattactcccagcagtgcctccatgagggacgcaaagcttctccttcaaacaagccccagaaaatgtcttcttcactctgattggctgagggctcagttttgaatttctcatcgtgatcagaaagacaggctactctgcgtgactaaagtgattcaggatccattacctcaattttgtagttgagaaatgtggagcagtagtaccctcagagcaaactgtaagacctgttattagaataagttagaagagattaggaggaagacaagcaagcaaacaaaaaacaaaaacaaaagcccacaaatatcacctaaaatataccacttcaccccatgattgtaaattagcccatgtcaaatgaccacatcatatttatatttgtatattctatatagatagcacatagcctaagtctaatataataattggctttcttaaatgactaaatggtgaactattatattgtcacattcatgtgatttgatctgcaacgtaataaaattcatagctttataataccttttgactaggtgttattggttttgcaaatatatttctcaaatatgttttagaaagtattgaaagtcagattatgatattgggagaacaaaaatagattcagataattaattttcagaataaaaataagacaagaatgcagttccaaaatggatgttctgaaaggaattgtacacttttaatttgtcttattttcttggcctaatctcagaaaatcaatgctcctcatacacccccacccctaatacacacataactaagagtatatgtgatttgaaaaaactgaaagtgcagattaatgcaccttctgaactcaaaagtgtgtctggacatctgtatattctatcaccagattaaacctcagaaggggtctttcaaaacgtcttaaatactatgtgaagagtatcagctatgctaaactatttgctgtggcccgcatttctctcctgtttctgcctgatcttttgatattctttttttgtttttgttttcctagtaagaggctatgtggcaagtgggcctgatacctctgagaggagagatgaggagacgcagtgtctctcaagtataaatcactgaactgtgagtcagaaaatagcaaagttgtttctaagagaatactctaaaatcaagctgagtcatctaagatgaaggaaagagtattggggaagagaatacaagcaactttcagaagctagctgtggaaccaaatgagtatctaagaggaagagaagtcaatggtcttttgtagaagcccattagtcagtggactgatggcttggattactcagtacaggggtcaagggccatagtgaagagtaacttgatcactagaacagctatgtgaggctgaaggagatctgagtggtatttggttttctgtttctgtattaatttgctgaggataatgctttccatcttcatctgtatccctgtgaaggacatgatttcattcctttttatggctgcatagtattccgtggtgtatatacaccacattttctttatccggtctattattgatgagcatttaggatgattccatgtctttgctattatgaatagtgctgcaatgaacatatgtgtgcatgtacctttataatagaatgatttacattcttttgggtgtatatccagtaacaagattgctgggtcaaatggtatttctgcctctaagtctttgaggaataaccacaatgtcttccacaatgttctcacttataagtgggagcaaaatgatgagaacacatggacacatggcgagggaacaaaacacactgggatctctcagagggaggggctgaggggagggaaagcattaggaagaatagctaatggatgctgagcttcatacctaggcgatgggatgatctgtgcagcaaaccaccatggcacacatttagctctgtaacaaacctgcatatcctgcacatgtaccatgaacttaaaataaatttgaagaaaaatccagatctgagcaacatggaccatttttggtttcctaccctccctcccacttgttgaagacatcctattactgatatgggaaatacaggacttcattagtcttgagaagaagttgcaactcttccctcatacctactatcttatgcaatggttctttacatcattttggcagggaggcaggcttgaactcaccttatacatttactgaaagctaaagattcccttcccagttaaacagcatgttcacacaagccaatcacttttcataaaatttcaggatattcacaaacttcctgaattttgttggtggagacttcctgggaagattcatggactgagttaagaacccttgctgtagaacccagtcctgaaccactagaggcttcacctcagctaatggaagttttgagtgtttcaagaaatttgggggtaaccaaagagtttcatccaattctaaagaatccatccatgtaagctatttcagaaggttttgctttagtgaacacaggcacttcatattttaacttttccaggacaggaaggaatgggcatgactagggatctaaaacactgttgtccagttccagcatcataggagtttccctgatgatgattttatcctggatttttcatgctttccctcacgcctttcttcttaaatagatgttcacattctctctgctcacagcctggtgagcatgggagggtgacaagaacaggtggggaagaatctagtaaggaatggtctgaatccacagctgaacatctccttaaacgacagaattttaccagaatgacatttctattcattatccttcccggccaaattaattggtttgtaagttcacttattctgcagaaacgtattggcatgtgcagaattccaagttctatgctagcatctgtgaggagtgcaaaaatggatggcatacaacctctctcttctcaaaggagcttgagttcccgcagcagagacaagttatgcaaaggaactcagcttaaaacagtttcctgaaagggctttactgttcacccttcctaagtttcctgctgtgtgtgtgcttgtgtgtgtgtgcacacacacgcgtgtgtatggttgcttcactttatctgccagggactggagaaatgtctctcttgttttcccagagcaccccctccattacgtgaaccatcatatttatcacgatactttataattatccatttagcttctctcctgacggatcacaaaccccttgaggatagagactgagtctcactggatgtcccaactatttcctgggagccaacagaacacctggaacatgataagtgcttttaaatatgttaaagaaaacaattgcgagagaagagagaacacagacgacatgagacgtcctacaaaaggaggccccttagctattatgtcaggaaataactctggcctttgtcctgtccgctgtgtgtttcaggatctcgatttccctcccgtcctagaagggagttggatcaggtgattctttccaaatgaaaaattgtattttaaataatgccaagggcagagaaggaagtaaacatcctggccacctcctccgccttaaacgcccgcctaggttttacagtcaaataccaataatttcctgaaggctgagtgtcaaacacggtcgctgcaaaacctccagacgctcaggatgttcgcaggctccattgacaaaagtgacttcccacgctttgcccacagagggcatccctgcgcattgatacgcagaccaggcaaatgcagctcctggaagcctcctcggtccgctcttttttccctaagccatagtctgtctgcccccacccccttcccgtggaatctttgcctgatccagttcgtttccctccggtctccacattttcccttccagccctccacttctccggatcaatgtgtagtacggttccaactcccagctcgcacaccgctggcggacaccccagtaacaagtgagagcgctccaccccgcagtcccccccgcctctcctccctgggtcccctcggctctcggaagaaaaaccaacagcatctccagctctcgcgcggaattgtctcttcaactttacccaaccgacgacaaggaaccagcctcaaccttttaatgcacagcccggccacaggattgccttccatctcctcttggtccctcctggatgtggtttattgatgacttgcgagcccctcagagagctgtcttccctcctctggctccctccgtttccttgagttagttttctaaggttttaccggggctcgggatctcttggaccgaatggaactttttgctgcctgcttttgctgctgattctgtcagtggacaaggaaaaaggcttcgaaggcagcagaggcgcaggggaggtggagaaagaggtggaggaagaggacgaggaggaggaggaagccgaaggggctcggcgcgtgtgtgtgcatgtgtgcatgcgtgtgtgagtgcatgtgtgtgagtgctgccgctgcccgcgacccctggccccgaaggtgttggctgaaatatggagaatagtcttagatgtgtttgggtacccaagctggcttttgtactcttcggagcttccttgttcagcgcgcatcttcaagtaaccggtaagtggctctttcctttcttctcgtcgcacccccttccgtaccccacttcccttctcatttcatttggcgagtagtagaattggggtgggggatagcaagagatttggcgcttgcgctgcccccatttgcgcaccgatgataaaagatagaagagtttttttcttccctgggggcggatgatggtgggggggtggtacaaggggcgccccttcgctgttttaaaatctgatgcttcacgcatttttgcttctgcaaatacttgggttggtttggagagccggcgggctggggcaggtgctggggatatcgttgaaaggaactgggctgggtccttaaagccccagaaacctaccaagtggggaggattggggcaacaggagcaggcgaggaggacatccaggggctttgaggaagtctgcgcagaatgtagatggtggggctgagtcgttggtgtgtgaatacatctccttttggtttggatttttggacttggtgattgagaatagggaaagggacagctaatatgttttggtacttccaaggaggggatcctggtactgaaggaggcacagagttgccaaggaggaggggaggtgtgtttaatattgttttattttttaacggtgaatgtagttcgcaagctgagtctccatatagctccaggacacctccaaactccaagtgattgatattccagagaaccggcgccctgaccctggcacttgcctagctcagtttctaattaaaaatggcaaaactgtttggggattggatctggctagtgcaggagaaagagggacctggaggctggctgatcaggactgctgtaatctccgaatacggagctggcggcttcgacggccaaaagaatagaaaagagcaaaatgactcatgataaggtccacttgttttgcgggacctcaccgcaagtgtagatgggcactggggtacagtgagcggtcctggcaaagaaggagaggagagcggctggatgagcattcagagagcccttcggaaacgacctttttccaaatccaaaggaaaaacaggctcaggcagagaccgggcgttgagtaggagctccccagttcgtgcctgggaaattaacagggaatggcacatcaatcgcggccaagcccccagcctccccggagtccgcagctccggctttctcttctctgctaagtgctgcatggccaagggttgcgaacgcgagcagaaaatgcgcctctcactgtcgcgagggattcagacagtcaagcgccaaggcagcccgaggctccccaaagcctcgctcggccgcacgcgggcaggaatctgcgcttgcactcgggctcagctcctcatcttcctttggccagagacagagagagcaggcaggaggggtgtgtgtgtgtgcgtgtgtgtgtgtgtgtgtgtgcacgcgcgctgtcctgtgatgagcgcgtacccgcatccccgcgcttagccgctggtgctccctccctccgtctgtccctcccgggccggtcccctcctcccctggctcttctctcccggagctttgtcctcaacaattactctcgcaaaaggtgggtgggggtgggggggtgggcatctccacagtaatgaataggtgtctgttttaaattgcctcctcgagaccctcaaatgctagaggctgcggggaggaggaccctccttctgcccagaagattgacttgggctttctatagcagtttgggagacctatgcggacgggaaaggggaagttcagggggcatcccttactgggtagaaagtctgcctaacagcagcactgctgacctgaaatgtgctagctgaatgcactgcatgaagcaaggtgtacaaaaatgaacaatgatgtcttgtcaattacacgacagtattttaaagctattactcaagtgacttttgtctggcatagggtgggggtagattaatagagataaatttatgtgcgttttattaatgtctaaattaattaaatattctctttgcatttatttacatttcttgtccagagagtcagggccatgtattactgcttcattttaattttctcctcaacagacagatctatgcttgaaaaagcagatgtaaggaagggatacatacacacacatacacatgggttatgttggtggataggctaacggatctaaatctttaaacttttctgcacttctaaatctatatctgttatttgcaagtgagtcgtgatgcagtttgcgcagctcgcaggaaagtggatggtgcatttttaagatattgccaattcacaacactctggcctttgctcattaatctgagtatcacttctttctcttagtaataatttcccctgtttaggaacatggcaggaaacttacaacgagaaagcatagttcactctataaaaggaccagtaggaggtgcccttaataaggccaagtgtctagtttactggcagagaaattcccattcagccgggtgttttaaagactttgttgattggtaacaaaggattatggagactagcacaatagcactgggccctttcccactttctaggtaaagtctgaagctgctgtagatttgtatgaaactgtgatgatttaacaaaggacagccctgaaaagtgtcagtagagagtgaggacttgatgttgggggaggaggatggtgactttttagttggcttctgtaagatgtcatcttcttatatatttgacatgagccacaggcacaggaaccttatagagtctcaggggatctcagataagataacaattttggatgttggatgttaatgagtgaaaaatgaggcatacatattaattaattcttcatacatgtttgggttccattgcattgaaaaaaatctgtgagtgtttaatgtagtctggatatgctgaaatgaggctggtcgccctccctaggcgacctcttctcattcccccaaccaaagcagatcagatgcccccatgtgggtttgcttttgagtggcgggagtatggcagagcctgagggctcggggtaggctggcagtccactcctctgtgagtgccgcagtataaatcaccagtacctgtcagtgtccatttcccacacagcagcagctgccctctgagttataaagcatgggaaacggccaccacatgtgttatatgtgaatatattaggcttagtgcctttgctttaatgctcttaaaagccaggctggcttgagatgctgataggcatttttttctggggagagatttataacttctcagtgtgtatgacttaaatttattctctggcaagttaacctcttagcaaacttccttattgttttcattgaagaggaagagccttaatcctacctaaattcctgaatgaagctctgctgaaagtttctgctagagtacaggatatttgcaggctgtagtatggtttcctaaaccaatgggaagcttgacaagatatatggggaggtgattttttggtggggaggcggggatatttttacttgtttttagagagggaagttgtgatactgcatcttctaaaggaattctagcaactcagttatctcaaaagcatctttaatgagaggaaatgtttctcgcttccagtttcatacatctaacagtctgggattcttcaaatgcatataatatgctcctggaatgtttgcagctgcacgcagtagggtcatctagcaggatcactgtcatttggaaatgagccctgatttaaattttgacttgcagacaaaacacttatctttacctggtgcggcatgtttaaaagcagtgctgaagtttctgaacagaatatttctttccatgggagactgtgccctaagattacattttaaagtaagtgttcttaccatttctttggagaatttgccatcccaaactttgcatgtgaaacttcttcttcatgattctaccagtaaagataactatttaaagagaatgcagttgtttccgggtatttctttaaaattaaaattcaatgtccacatccacacacaaacaaggaggatttccaccccctcataccttctccttcaaatagctgactttggtgtgaattatgatagctctaattacataagggcacttgcaatttccctagagaatgagttcttgcctgattacagatcttcctactttccataggaagtttctggcccacactactatcagaaacttgcaccaaattgggaacacattgctctgttttggtatttgctacccagctatacatttttgaaggattaatctacctcagatgataatctcttagatgaactatatacataaatttcaagaaatcttagctttgcctgaggccaaagaataatgtcacaaacctgctgaaattacttgattaattgattgattaactaaggataaaaagtcacttggttctggaaaagtactgtactccctaaagagttctaaagaggaatagtaaatactatgcacatttacaattcataaaatgtaaacgtcaagtcttcttccccctctttttccattccttccttataatgctctggaggaaaatttaagagtttcatgagttgtcacaacagttatatcttaaggaatcatagcttggaatctcactaactcatgattaatagacactcaattaaatagcaacacaatgtccggtgaatttttcggcagcctgctgtgggctgcttgcttgttttcagctcgtttctaaggaatcaaaactctcatctctaagaggtgtggcatcaatactgcctcccttgacgcagcccaagaaagcctttctcactctgaaaccaaggctgtgacccacaggcactgtgtttaatatgctgtgttccactttgcaaggtcagggggatttgccttaaaaataaatttttaaatgttcatgcatgctgcttttggtggagagttaaactgtactctaaaagcagctaaatagtgttgttatcttaagacattctaacttgtggcctctcagccaatattattgaagttctagagctcacaatctttaagagagacaggagtgagctctataagataataggttatgccaacctagttaagctacttttttccccaaaatggtgttaccaggttggaataatagaacgttaacctttttcaaagttactacttttcagaggaaaaaacatttcttaataatatcataatatcagtagcatgggactgacccaatgtatttaagatattgttcttcaaaacaagatatcaaggaaagccagtgttaaacttgtcaagaagaaaggatgaacaatccagattattttccctgcaggccaataaaaaatgtgcaagatagaattacatgttgcatatgccaaataggtaatagcaaaaaataaaatgtaaagtattatgcacctttatcattgcaggactcaggtaaatgaaacacaatttagtaacacactttttctttctctcactctagaatgttaattccttatcttatatttctctggtttaactccaaactaagatggagaaatacaggttggctgactgatgatcaaaattattatagtgctccaaagttatttgacaaattttagcctgaggtttaacaactaaatccctttaattcaactattaagtgaaagtgttttctttggtagtttagaaatacctgagctttgtcccaatggtgtggtttagaaatacataataatgcataagattgaatatgccttctttttcaatattgatgggaatttgccaatggtaataccagtgcatattgctcttttattaatagttccaaacaaccatattattcacagctttcatttcttggggggaaaagttcaagtaggaaacacacaaatcattccatatttattgatcatatttttaaggctattcttatggcatgacttctgtaggaatgtttctcttttctagtaaattccacgagcccagtgtctatgatctacttctacttcgtgatatactttagcttaatttcactaatccaaattttttgacttttagcttgctcagtcatttcaccatggccctccagggaggaagaccctttaaaaccatttgtggttatgatgatgaaacttaacaggagtatttattgcaatttggagatttcttcctggttcatcctttaaatattggttcttgcctgaaggctactcctaagagtatctaggacaaacatgttccactgaattaactgaatctttaggatgttatctgatgaaaataccaactggttagtgaattgtgttctgataagaggacttgtcaatacaacattattctgggccatctacaatgttcttaaatctgtgtttacattttgacaagagaaaaaagaagttaagcagttaatataaatgtttttaactcaaatcacatttttagattttacttatttttctatagtcttttagaaatatttctccactcacttagctgcctctttaaaagtatgtagaacataatttaacctgttcttaatagatacaatacatcactatgacttcattatagtattatgtgattttatagggataatttttgaaggcattgcatcatacagaactgtttatttttcccatcaattgaccatggactgttactattgttgagttttatctctggctataaaatatattttgtctacatcttgtgttcagctgaaacttctccctgtataaaacttcctcaaagcagttctctcttttagttttgatgttaagacataggggactaagttttgttggggttgtgtttaaagtaggagaggagattagaaaacagcacctgaatcccttattagaggaatatctaattagttttaactaatgattctgtagcatctgatattaatttggatgtcacttgtactttgtacaacgtatttttccttattaaatgagaatgtggactagatcaactctagttattagtttcaacactatataatttatttaaattatgaactgtactatacatatagtgtttggtataattaataatacaattcatgatcatgataacaataataataatgtaataataacaaatacccatgtacccactagcagttttctgatttttgtattaaccccttgccttttgtacagtttttccacatatgtatacatctttaacatgttactttacttggctgttcttaacagtaataaaataaatataatgtgtatattctctgacttgcaattttgctgaacgttaagtatctgagtttcatctatgtggattcatattgctgtatttcagtcactttctctggtgtataatacttcatgatattaattaaccatagtttatctaatctattgttgatggattttgaaattcagttttttgctattgctagtaaagttggcataaacattctggtgcatgtccaccagcacaaatttgccaccatgtttagggtgcatacctaggagtggaattgctgagtcatagaagggtatcttttcatccgggaggcaaagacatgttgcagttactgaaacccccaccaggggcagatgaaaggcctctttgcttcatgcctctgccaacacttggtattttcatatgcttaatttgcccgcatctggtaacttctcattgtgggtttaattcgcattttcctgattgcttataagtctgaacattttttccattaatttgttagctatttgtgatgtcagcaagacaattctatgattctgtttcttcaactgagcaacatttgcttttagaccttaatattattggtagttattctgtttcttctactaagcaaccctttgcttttaggcatagatgttatcagtagtctaatgttcaggaagttgtcgcctaatactttaccatgttgactctggcctaggctttatttaagcaccttcccaaaatgtacactgattttgagttggaaaagacattcttagtcactgtaacattgttgattaccctgagcaagtcctgccatgttagtatcctgccttatcctgtttattgtgtctttatagagaatcatttacagggaagcaggatgctgggatgccaggcttaatttgaggctccttatgaatcccctgaatataatggaactaaaggataacagaaacacagagtagtaatggtagacaccaaatctgagttaaaaatcttaatatgatcatttgaatttgggtatatttccaacatggtaaaatacataggcccaatatcattgttacatttatggcatatataactgtgggtttcaaacaaacgtatgtgctttgtgcaccatcccccccaatttttgtttgggtttataattttttcacctgctcccatgggacaggctaatgaagacccctgaatgaaataaagcctcagatgtacttgcagaggcctctgtagtgtgttgccttctgtgcagactcattagagatgtgagccaaggctgagacatctaagcaaaccctctgcacccagagtcctcaatccattgttcctgcatcttttttcagtctcatgggatcccagaagaatacaaattagagagaagaatctgcaaagcttttcctttcatgtttaatgtctgggcagagctgttccctgcaggacaatttctggttattttctctctctggtttgaggcatctccagggatggtttggtgactgtttcccttggggaagttttcagcagcatatcagttttactgttaaaagtttattttacaattcatctgagatagtcctgttctaaatgttctttccattacccttgtcatctggctcttgattcctgcatacccttttcagtgacactgcctcttctgggctgaaatgtgttcaataattcgagctataaatcactctcgcctccccatttggtctttacttaaccagattataaatatttaattcatttgatttttcctcataccactccagaagcttaatcatgtttagtcttcttactttaactccctctagtttgtttatatctttcttgtaatcaaggggcctaactctgatgtgctcttctaagtaagctctccagagtcatattataaaatacaaattcagcatcatctttagcttattgtacagccatagacaaacatatggtctctcaaaacttgtgttatcagttttcaggaaggactatcaatgcctaataaaatcattgagatattataaggaccaaataagaccaagtatttcattgaagatagtacaatagttactgagcctttaccaacgattacaaatagatgaataaaagatttagatgagtttctgccctgcaggggcttttcctccagtgaaggtgacaggcacacacagaggtaggtaggatacaaggtagaacaaagtactcaccgaaaagggacacaaacagttctgttcttcatgtggtttttgtcattggttctgtttatgtgatggattacatttattgatttgcgtatgttgaaccagcctttgcagggacatggatgaagttggaaaccatcattctcagcaaactaacacaggaacagaaaaccaaacaccacatgttctcactcataagtgggaggtgaacaatgagaacatatggacacaggaaggggaacatcatcatacaccggggcctactggggagttgggggctaggggagggatagcaataggagaaataagacaggctgatggatgcagcaaaccactatggcatgtgtatacctgtgtaacaaatctgcactttctgcacatgtattccagaacttaaatataatttaaaaaactcataatatattaatatttattagctaatggactgacagagccaattcattcatccttgtatccctaaattgattggaccaaaaagaggcaagggagtttaaagagttgtcaatcatgtttaaaccaaagtattggtgtggtaagaatgaggatattatggttttgcctacagatctggtggcctgttgctgtaaaaacatctccagactttcgtgaccctttcttcccatatttcttgaatgtgttccaggtattgtgttaaggtggcaatttagcttacagcccagtgagataaatatgctaatcaaatacatatgttaacaaacccacaattccaaatgagataaggctttaaagaaagaaaatactgtaggaaagggtctcagacagcagatcagagacagcttccatgagaaagtgtgactgagtttacatctgaagaatgagttaagaaggggatatttaggaggggcagacgagagaatatcaggtaaaaaaaagtgagctcaaaggccccatggtgggaggaaaaatcatgaattccaagatcagtgtacccaggaccactagaactaaacataataatggcttagctaaggctggagaagactttgggattctctctctccagtagtagctacttgtacttggtagatattgactgaataaattcaaatgagttcttatcaaggatctttcctaatctcagtacaatgattcaaaaatttctgcaaactacataggccaccttttccttgatttttttattagatgtgaatttatgaacctatctatcctatatgtttagagatacattatgaggtgttacggacatatgtatgcaaccgagagagggactttgaaaagtgtacagagctagaaaaatccaagtaattatcaattaacttggtaataagtcatttctcctttgaaagctatcactgaacagagggaaacaaaacttcaccttttctataaaaatagaattgccatggacattccttgttctggggcctccttcaaaatgtgtgcctgaacgtgtttagtaaacctaaacctaaattttttttggagtttttatagattattttctcaatatgatccttttctatgcattttgtccctattactatttcttaaaaacataaacgaatgttctctttgctttcagttacagttcatttagaagtcattgagcttgtaacctttccatgtcaccggacctggaactactgtaccacttgaatcaacctaccatctaccactggatgttgcaaagattgttgctacacagccctgtggtctttggtctcgataagagggggcatagcctagggggaaaaagcatcccagctattgggtttgattgagatccttaaaccactggacctcaactttcccacctataaaatggacacaaaatcaacctctgcttcccaactctaaattgggggtaaaaattactccagtagttagctatatacaatatctattccaatgcctgacttataataagtatttcataaatgctagctattgttagtattatgttagtatgggctacatttatcccgaggtagtctttacaaatagaaaatttcacaggcacaggccagcccttctagaacctgcctcaattttattgttgtgattttagagacttaaatataaattaaggtagtcagactccaatggcaattttgaaatcaatcacatcatggtttagtggaccctggtcccatgcctttgcttgatttagaggctcataggtccagctaagttagatctgacatagtgcaatactgatcaaacttggcagcgtatgacacacttcctgtggattttccatccaaaccatcctcccctattaactcttccctggttgaccatgtccattttctacagacccgtcatctactcagcaggcacacctagaagctaatacttgcttggttaatgtgcagtactgggtataattggtcctgagggtcttctctgtggaggagtggctctcatcttgattttgtgtcaatgcccagcccttcttcataccaattaatttagaatctcggagatgtattccaggcacaagtattctaaagtctctgatggtgattccaacatgcagtcatgtttgagaatcagtgtcctagggtctttctactccaagtgtgcagtccaggaatcaaggcatttgcatcacctgggagcttataagaaatgcagaaacctcaggccacacccagacatactcaattagaatcccaagtgactgaggaatactgctctagatgactgaaagcatcagatagggaggtgatccttgcctctattcttcacaattgtaagtaatcatgtagtcaatgggaaactgcccctaccacactagtttttcttagcttgaagcatctgttgcatgctttggcttcaggagttggtcttatagtggcaagctatgccaacatcaaagagtcttctggtttgtggtttagcggcaaatatatttcatggagaccatgacacgtttcattttccttgagattacaagcccttgaaaatgctctttgtgtgttccatctgccttttcccttcttttctcatcaatactcatataagaacgcatattttacaatggtctgctggttttcattccatagtttcccctccttcaactctctttcctccttaaaaatgctcagacccagggaaaaagaaagacacataaaagggacacagaggccctgggccctcctcctccctccctcctctgtgtcccaagtctgatgctgagagcacacacatgctcaaagtgagaccctgacgggggctaccccatactgaacctcgccttttgattggggatggtcttcagggcatgaaacagaccaagtgctcatttgcctgagcctctgtggcagggcagaaggggtgtaacagaggtttttgaagaagagtaaagctttacaggcagaaagctcagtgcagggttttgaagcttttgctctgcactgcctggcagagagagcagctttaactggcgtgctccaaatcagagtctacacgaagagaacatggggtctcagctgcgcagattggatcaatctgaatgaaaatcactagtgttcctcctggggagagaagtttctgcttagctcatgaactgtaggcccttctctggccctggtagtaaatgagtagagcttttgtgaaaggttatgtaaggctgctgttttctctccctgcctagagtaaaattctatttatagagggatgaactgcctctcagcgaaacatgcattttataaactatagcttaggaaagataatttaataaatctttaagaaagaattaagggaagagagagaacaaaatcctaggcagagagagtgggatatacagcaagaaataggagaaagagaaagcatcattgttctggacttagttactggagtagtaatagagtgaccgatcattcttgtgtgcctgggattgaggagttttacaggaagaaggactttcagtgctaacaataggacagccccaggtaaactggaatagtttgtcactcctaatttggtacctatgatggggaggggagtagaaagaaccctgaaagattttcagcagggaaatggcattttagataacacactgttagtcctatgaggaaacaattagagaatgatagcaaggcctattatgaggggatgttctaatcgtccagaaaagatgaatatctgattggaggtttagaagcaacttagatggaggccttaccctctaatcttgtggcaaagtctaacttgacatccaaaactgaaggtttttttaaccaactccttggccaaaacactgtcagagaacgcatttttgaatcaggttatcttttggacatgataggataatgtatgtattggagaagtcatgtctagcacttctgtgttccactgtgtctagtacagtgctgaatgcatattaattattcaataaatactcattaccaaattggtttttatataatgattattctcaaatttgcatgaaatctgaagtttctttctgcatgagcttcacaaagttcagttcaggatattgtaaatttcaggattactcagctattacttgcctcttctttagaggtttattctgttttctttttctctctccccttcttttgcctgatttttcctttacatgccattattaataatgttattggcagcatttcagagtgcttgtgagaaattcaaaattgaggaaattctgcaaatagcaaaatgtgaatgtataaagtctatagaatttgctatctctttaagccccgttacgaatgcatatagggcatttgtcaactcgcatatatgaaaatggaacaagataaagtaggtgaataattatttcctacataataatcccagggatagactctgtgtttgccttcagagcaccattcctgaagacttgagtgagtcaaagcattaaaatgttatttttgtagaaatcagtggaagtcaagacaagatgatggagattaaaaaaaaaaagcacatagaatgaaaagcacaaaacttcttgtgtttcaaagcactgatcaggcagaaaaggaccttggcaggtgtttgagaagacccttttctactggtaaggactcaggggcccagagaagctaggtgagcctctaaatcacaaatctacgaatgagttccatgaaacatattatgtacacgtgggtgcaaatcttggctctaccaagatgtagctgtgtgaccctcactatgattcagggtcctcatttgtaaaatttggaaagccattgctgaatggatgacatttttgaaaaacattacactcaaggattatcacagtctttggcacatattgagcactaaactgtttctatttttatttgttcattcgacagatgtttttaaaggtaatgtttcatgtatcatatttgttagcgcctgtggtgtatttaaacagcatataaacacactgcctctgttgttttagttaacaaaatggttggaggaataagacctaagcagtgcaagcatgtaagaaaaaaaaaggtgaccagagtcacaaggcaatatattattgtattattaagaaccaaatgggtgagaggtgcagttagaggagagaaacagaacatgatcagaaattcttccagaatgcagagggattgagtctggtaggtagggtaatttggggaccttacccacataggacctgaccctatgtggacactgttctttacatgttcaggctctggaagacaaaaaagaaaaaaaatgatggtgatacttcactgcagaaagcttcttagtccaggcaccagatctcatcactagcaatgacttccctggtcactagccttttcccaagcgaatttatgataaggctaggagaaaaaggaagagagatgtggcaaggtcatctgagaagtaactttggtggcatacataatgtaattttaaaataaagaggctttaccagtagggctttttataatagttttaaggaggtctcagaagctcagggaaggacagatgccatcacacactgcattttgaacttggaaatctagtggctgagaaagcatatttaggctcctgcactactggaataagtctgtgctggaaattaatgttttcatctttttttttcagccttgcttcaaaatgtatagaaaactttggttcaggatgccaaaaccctttattactaatgcgtaaagggtgttagctagttcatcaaagatcttctgtacattttgcggccaaagggcaggtagcccagctcaaaatttgcaacttaaatagcttttcctttgttctttgttccagagtacacagtcatatgaggttatgataattaataattgataaattattattaggatgatattgttccatgcttatctgagactttctgtcttccaatggcttttgaatcttttatccatattcatctctcaatacctctatcaagtgggcaaaatggctaagttatctcacatgtgttattagtgaggttatgagagtaggggccagctatttatttaagatcacacagaagttacctgttctggctggaaaacctaaatcattttttttttttgagtcagagtctcactctgtcgcctaggctggagtgcagtgatgtgattttagctcactgcaacctccacctcctgggttcaagcaattctcctgcctcagcctcccgagtagctgggattacaggtgcctaccaccacacctggctaatttttttgtatttttagtagagacagggtttcaccatgttggccaggctggtcttgaactcctgatgtcaggtgaaatgtccaccttggcctcccaaagtgctgggattataggcataagccactgcttccaaatctggcttaacccatgtactcaccagtacatattggacactttccaaaagcaggacattctactcttttattccccaaaaattcatgtactaaaaaaatgccacctagcactcagatcttgatttctaataccattctccaataaaagaaaccagagctcctcagggaaatagttgattctggaacttatgcagaaaacatacaagataaggctggagcatcttggagtgccagaaaggaagaaattctttaaaaaagtgaaaaacccacaaagatagagtatgtcaaagggacacagaacctaactgaaagcactctcaatggtcaaaactgcaacaatttgagcaagaaaatcaaccaagtagtttcctattataacccaaactataaaataaatgtccatgagtacatactgacataaataaataattgaataaataaagagaagagacttagataaatcccctatgcagaagaattcaaaatattatatatactctactctcgaagagtagatagagtacaacccatatccttttgagtgtgggctgtgcttagcgacttccttccgaagactatggtatacaagggggaggggaggaagttaactacagtagaaaaattggccggatcatgaggtcaggagatcaagaccatcctggctaacacggtgaaaccccgtctctactaaaaatacaaaaaaaattagctgggcgtggtggcgggtgcctgtagtcccagctactcgggaggctgaggcaggagaatggtgtgaacccacgaggcggagcttgcagtgagctgagatcgcgccactgcactccagcctgggcgacagagcgagactctgtgtaaaaaaaaaaaaaaaaaaaatctgacaaacactacctcagccaggtgatcaaagtcatcatcagcagtgataagtcatgttgatagcatgtaccccctgatatgatgtgataaggatggcatttcacctctgtgatcttccttttccaaatccataaccccagtcttacaatgagaaaaagagtagacaaaccccatttgagattctacaaacacctgaccatattccttaaaatgatctaagtcttcaaaaataaagaaagtgtgtgaaacagcacttttaacaagctctctaggtgattcttatacacacttcacttgaaaaccacttggctgtgcattgtccgtaaaacttaataatggtggctctctgcttattgagatggtctttgagctcaggggatgatctggagtcaggtgaacttgggtttagatcccaggcctacaactttctaattgagagaacaaagacaagatattccgccttttttgtgcctttgtttcttcatctgtaaagcaggaaaacaacacttaattcagagagtacttataaaatcatttcagaaaagccatgtaaattatttaccatattaccatatttccacattaccactgctcaacaggcagtgagcactagcacgactctactggtgttctattagcttggttatataaatcaatatgaacataaccaaaattactcctcattgttactgatactctccaccctctaaaacttgtctttggcatcctgcaatgctttccttacatgtttctaggagtcctaagagctatgtcataaaccagttatcttctgctaggcatcttcacatgtctggaagtctggtatgcttgctggctttcatgtccccaggcagccaccgtctcttgccagccatcctgctcctctggtagattgctgctgcagcatcaatgctttagaacgtttccagtgcctgagcattattactatgtccactgacaagactgtcccaatgttgattctccctctgttaaactctatcatactgcttgtgtcttccaatttataaaatcctccatgacaacaattcatttaactagggtctgtaatttttctctacatatgacttagattcagtaagagaagggctgatctggggacagatgttgcatttcctattccctgtctttagcctttctgtctccaacccaccaatggaacttcttccttaagtagtatttaaatctcccctacataaatgagttactgcagagagatgtctgtatttttagaccatacaccataggctgtttcattgggtttgaggtacacatgtggtacaaaaatgtagactaataataatggttaatatttatgaaattgtatggtttgaagtgatgtggtacatattgcttaagaaatacttattgcccacccatttttatatttaatacagaagaatatcccattttaagtagcaatgtgctagctcaaagactcgatttctcaggctcccttgcagctaggggtagttatgtgaaagttctggtgattggcatggtaatcaggacacttctggggatttcagagtaagcttactctcctgtcctaattaccacccccttcctccttgttgcttccttctttctctggaaagtaggagtgaggcctgaaattgaagtagccatcctgtgttacatcatctattatgaacaatgagaaggaaatgaggagaagcttgagtccatggtgacttccttggggtagctatataatcttgggattgtttctttctagacttctttttatgctacaaagtaaacctctgtttgattttaaaacactgtaatggggtttctgtcacaggcaatactcagttcaaactgctgtatgttcccatattatttttttcctcacagttaaacagtgagagaggaattaatattatgtccttttacaagtaggaaaagtgagacaccaaaaagttggccaatttttccatgcctccatgctagtaaattgcagacttatgatttaaatcctgctccataacatgtccttaattaagtctatgctataattcctagataaatagatgttgtagctattacactattgttgttatttttattgttgtgggtaattattacactattgctttttatttttttgcaaatcacattaattcttgcaatgttgttttatttttattattgttattctcctctctaaaagagggatcttcttctgtgaaccgtttattatttagacacttctagattattgagtatataaataaaaattcaattttctgttaatcattttcaaatgtcacagttttcactaacaagttataagacagcttcatgcactttaatttcctctgaagaagaaatccactgccaccttataaaagactaacattccaaatacagctttagaatgctaatgccttaccttaacaagccaacttaactctgtgattcacatatgtgctgcaatttctctcccattgtagtgtaagggaattttgcacagttttgatgtattgtgtaaattaggccaacaaagtgctgtgctatgtcttcattaaaataggagacggtaataatgcaaccatgtagcgtggtcttgcaggctttgagttatgaacattcaatagtgtctccttacttgtgcttaagttggcatttgtgagcagcatataatcaattaatcaataacccaattttctcttaaagagatggtgcatgatttaaaaaaatcagaaactactgtatgattttatgaaaagagccatttcagcaaagaaacttgttttgaaaacactgaaagtcttttttggggaggacaattttgcttaactaagccaaaaatgaaattggatacaaatgtttagttcctgaattcttttattgttttgcaactacagaaaggaaagggccagtttgggattgctagtaagaatgcattgtttttactcatgattggaggtgtgtaagtggacccatctatgaatgcacagttaaagtcaattaatcctcaaacttacagtttaaaactcatctattctattacttacaagctttagagtatactaagttgcctaatttgtctcacatgaggtcacagcagcgcaaagtgatgctttcacggtgatgaagctgacagtcatgttgagacaaaaacctggccttctcaaactttaatatacatttctatccttatctttattataatttctacctaaaaagatatatatgcttattataaatattcaaatattacataaatgtgtgagtttgagaaggaaattgttccataatcccatcacttcagaataaaccacaatttatttgttttgttcagtcttttttgtctctttctctacctgccccacatttactgtgaaatttgtggaaagttaatgtttatttttgcattgcattaagatactgagttgtgttttctttctaccaaataagtaaaaagaaatatcgtggaaaaagaaaacctcaaatatttgctttgttatttagacaacaaaagacatgattgagatgagaattgtctctataagacagatcaccttccaagagagacacgtgctaggcatgcctgtcttctaaaagtgtcagttccaacgcctccaaaatgttcaactgccctcttgaaccttgcctctaaagtgcagcctgtgggccagccaacctccatatcacatgagagcatattagaaatgcagaaactcaggcttcatccaaaatttactgaattcgaatctacattttaacaagatccccaggtgatggctatgcaagtcaaagtttgagacatatcattctagtaatagcatgtttcctactcaaattgctaccatattctaagagctgtgagttactcatgaattagcaatggtgtgcagggaaggaaccagtatcaccacagctcgttcatgtggcttctaaatttcctccaaagggttgagtgttgtgctcattaaacagtgtcaagaccagaataactgtccaagggctggctcacatctattctcttcatttaggtcatgacacacattctcatccatacctctgaagtcccaaggcactaaagaccacattgattggaataattgtgtcttctattccagtaattggttgctaattatgcatggcttgatgttattttgctaactcatatacaccaaatgaaccatgagttgcttgaaggaaaaggccagtccctgagctcttttcttcaaggatggcagtcctgtttccagacatctggccattcccatgaatgagtgaatgatggttattaggtatgttagctccatttatccaaccatttgtgctttccacagatccagatttgacggttatgtcccccacttggagctgggaagtcacaggacttacttgataaacagtcaacttctttcttgaatttatgccaagacctcatatatctatctctttatgctctacgaccaccagcattggttggtggcccagttagaaacaaaaagatcggggataagtgtaggacctgtccaatttgcatcaagtaatctttcataagtttgtaaggggaagataagggagggttataaaatttgaatgctataatagattttatcttgtagcctatagtttttattttttttctcttagcttctaaaatctatgattgagtttctgttttgggttattaactcctgaaaccaagaatatcagaggaaccttaaaaaaatagaactttggaatattaaatattgaagaagaaaagctgaataatctccctataggcaggttgggagtgggagcagaatcaaacaaaacttctctttgttcttttagccccccccactcccctcctccctccataaaccaaaagagcatttatttacttgggctgcattataaacatctatctttctttcgttcattcattcgttcatttccttccttccttccttctttcctttctttctttatgacagagtcttgctctgtcacctgggctggagtgcagtggcgggatctcggcttactgcaacctctgccttccgggttcaagcgattaccctgcctcagcctcaggagtagctaggattacaggcatgtgccaacacgtagtagagatggggttttgccatgttggccaggctagtattgaactcctgacctcaagtgatccgccacctcagcctcccaaagtgctgggattacagacctgagccactgcatccagcctataaacacctttctagggataaactttgttggtttaccatcacataggagactcagctcatcaagaagtctgtattcagaccaggttcagctcagactaattaatgaaatcatgtaattgatgggttctgtttctatttctagagctcttatattttgatatgagaatatggaagtgccaatcaggttcatgaggtcacccttcagaatccctcatttctcctttctctcctatcatgtagctgatgaaaaatatagcacacttccttcccctgaaagattcacattagttgtgtcttggacacaacacctctcttgctctttgcttctggccatatcttctttgactcagaaggctttatcactggggatatatgtcaggcaaagatgcagttctcagaaagtttgagagcaggggatgttatagcccataagaaagggcacaaggccaaaaaagagaactaggctctactggtcaattaaaaaatatatatttaagccattttcagtgttcagccaacaggaagcattatggatgttcaaattgctgaaatattagcatacttcctcactgattggtaaatatttgctatccagggcctcccaatgtgccctgcttcctccattctgattggtgagtgactatgccaatcagctcctaaaagtcctccttctaagatatcaacattggcttttttcttagtgactttggagggccagatgtactctcacccagtcctgggaaactctgattgccctttagcccttcagtctgccatctacactgtgcaacatggcaccccatggcccatgtgccttctgtgcttctctggccccctgagactgacacctaagcaggttggtgttccttgagtcaccctctcatggccatcagtgaaaaccgcagctccaaaagaagacaaggtcaggaatctccaccacactgatgcttaaatatgtttaatatttaaataccacacattttttttactctgttctgtggagacaacactaaatgtctttatggcctgagaaatgttcatagaataaattgcatattatgtagtgattggttctatgattgctataaagatttttaaaacttttagtatcttatttaccaaagaaaatatgttcaatgaggaaagcatttaaacaggtatataagaaaatataaatcactcatcgttacatgactcagagttaattactgttaaaattttgataaacattgcatgtgtttattcttaatagtaaataaattatattgcatatgctggcataacttaaaaaaagcttagccatctattatgaatgcaattaaaagaccaaagttttctaagagttgggagggaacttggaaatctgctagattcattttctggtgaggaaaacatttattacatagcattcctccgaagatcctctagcttcctccttaataccaccaagggcaggttccacagccttattatgcctctgccttaaattatttttggattagttattctagaactttctgttctactcttctcacctgttgcttactcattgatcctggttttgcccttcttagtatgagtggaagtgggccaggaagggcaggcttagaggcagtgaggaggtggcatggtgaagtcagtggccattgtctttcatgagcaaaacagtccttggtcatgagactgaatgagtttcttgggtgatccttttcacctcctactcccactatattttttcttcagagacttacattgggggacttatgccttttttgtcatagcagaaaactctaaatatgtagaaagtttaaaagaaataaatctcattggctgaacacagtacattttaggagacaaaaaaaaatagaaggatgtgtttgaaaataaattgagttggaaaatatctagaggtttcttcactatcatatggtatgtttaaacttgtctccttgtcatcttccttgctctctgatcttaagaagattaatgagatgatgatgtttaatgcttgaatgtttggaagaagagtgctttgcaaatgtcaagggttagtgttatccttcgcagtagtgattgaccataagactgttctcgttattgtatttcattaactaatgctctcatttatcaagtattgaggcaagggagatatagtagtgggcaacagacaagatccttgaaaactgtttaatgaaaaagataaacaagtaacacatgattacttattaaaggaattaaaatttatttaaaattgtgttaatatctctggaaaaaagaattccctttttctctatcttaacatatagaacaatgggaatcttgggagtactaatgccaattgcttgggtggggtttatggtctgaggtacgaggggagagtatggcagtgaaggaaagattactgagcaaagctgagaggggaggagggatgcagcaaagggatgctaaactgggttgcaactaagtcctccttctccactgtagtcagatattacttacgctgggaggacgtgctaatttttcaacacttacagtattgctacagatcagagattagcagaattattctgtaaagggtcagatagttaatattttaggttttgattgtcacacaatctctgaggcaactgctcaactttgccatagtagcacaaaacagccatagccaatacataaataaatgagtatggctttgttccaataaagcattatttataaaaatagtctggacttaacctgcagtccatagtttgctgacccctgtaccaggctcttaccgcttgatcacacacctgtgtttaaacttaaggcatcacgttatggaattgttcttagaatatagcttcttacaactctatatattacttgaattttatgcattttacaacctttgtaatgcctatcatttttacgtatatgaaggagaagagagagattttagcatgtgcttaatctgtttatgctgactcctgactttcctcctataaacatctatgtttaaaatattagtactaatgtgtccggaattggtgggttcttggtctcactgacttcaagaatgaagccacggaccctcgcggtgagtgttacagctcttaaaagcagcgtggacccaaacagtgagcagtagcaagatttattgcaaagagcgaaagaacaaagcttccacagtgtgcaaggggacccgagcgggttgccaatgctggctcgggcagcctgtttttattctcttatctggccccacccacatcctgctgattggtagagccgagtggcctgttttgtcagggcgctgattggtgcgtttacaatccctgagctagatacaaaggttctccacatccccatcagattagttagatacagagtttccacacacaggttctccagggcaccaccagagcagctagatacagagtgtcgattggtgcgctcagaaaccttgagctaaacacagggtgctgattggtgtatttacaatccctgagccagacataaaggttctccaaggccccaccagagcagctagatacagagtgtcgattggtgcactcacaaaccttgagctaaacacagggtgctgattggtgtatttacaatccctgagctagacataaagactctccacctccccaccagactcaggagcccagctagcttcacccagtggatcccgcaccagggctgcaggtggagctgcctgccagtcccgtgccgtgcgctcgcactcctcagcccttgggtggtcgatgggactgggcgccgtggagcagggggtggtgctccttggggaggctcgggccgcacaggagcccatggagtgggtgggaggctcaggcatggcgggctacaggtcccgagccctgccccgcgggaaggcagctaaggcacggtgagaaatcgagcgcagcgccggtgggctggcactgctgggggacccagtacaccctccacagccactggcccgtgtgctaagcccctcattgcccggggccagcagggctggccgactgctctgagtgcggggcccgccaagcccacgcccacccggaactccagctggcccgcaagtgccgcacgcagccccggttcccgctcgcgcctctccctccacacctccctgcaagctgagggagtgggctccagccttgccagcccagaaaggggctcctacagtgcagtgggggtttgaagggctcctcaaatgccgccaaagtgggagcccaggcaggggaggtgccaagagcaagcgagggctctgaggactgccagcacgctgtcacctctcactaattacataataatgggatctcctcttcagaaggacactgggagatttgatctaatctcaacttctctgaatatttactttgagtccttgttgcttgtgtcatcctgttatgtattggcttttctcggcagagccaatcttcttttcttgtctcaatactgatgatggtgtttgtgttttgtctttggctggtttagctaatctagtgcctaagtatggctgtttctcccagttagcaaaggttacctctaacaactttgatggggtgcagagaatctgaagcagtcctttgaatgagaataagcaggaaactcgcactgagggaagaagttgaaattggctgtacataggcaagtctgcaagtgtgatggtgtactgtgggaattataggtattctttctgcaattgaggcccttccatgctgctcagagtcacagaggtattgatcagaaaggctttgtacctgcttcctttttgtttggaggggttgttccagtccagatagtgacatctgtgaactcactaataagcaaacaggccacagtagttgtgtgaactttgcaggttttggaccttttccactcagaaagatcctgctgtttgagactgggttaaatctgctcttgtctagaggcataggaaagtaatttatgatcacttgtgcagctgtacaccctgtggctagagttgaatatacatatttaccttgaaggagtagtcacgaggtgcaatctgtttcatttctgaaagtatgttttgagtgtcttgaactatttatccccattgtttctttctttttttcatgaacatgttcttaatatcatgggtctgtgtttctttctatttcttttagaattggtaagtagttgttttgggggctggaggctatttgggataaatgaatgggggacaagaagacaaattaatttttaatctcaaagcataccctctgtgctctgaatgttgctctttccaccctgagaaaaaatagcaggtttcagtccatatccttagctccctatgcgtcattctgcaggaaaaatgatcctgtcacacttaagtgcctcacacagcgggtactgagaaagtactacattatcaagtcagagttgctgagacttacaagtggtccctgaccagtgctgatgggtgactttttcccactgttttggatatagtgactgggttcttaagaattagactacttgcaaagtgaagaagttctttctccatagctcccacctcttcattgtctggaaggcagtgtgaaagggttgaaaaaaactctagtctttgttcaggatcctggtaccttcccagacctgtgcactgtgttgcccagacattataccttgcaaaatgaagataagactgctagtcctgcttatgtccaagggagggctgagcatcaagtgatataatgtatgtataaagtgcccagaaaagtatgtatcatgatgcaaatcaaagttgttgttgatcctccatgtggtgagaaggatctggctcagaaagcaccagttctgagtgtgtttctacctgttatagtatcggagagactgagaatggcaagtctttctcttaaggttacaaaggtgtttcatgtaatttctttgtacgaaaaaccgggaaggaaattccttgtctctccaagaatgaatttggtggtatcgatgaagagtcttctcaaaaacgaggacaaaaaccctaagaatgtgtgctaggtgcttctagattctgtttaaattttacttctataattctttgtgggttttttttctttgtgggtttttttttctttgcaaatgggctattcctccccactttagatccttcaatagttagatttttatttgcaaattggttatttctccccacctcaggtccttcaatagtgggaataatttttacaaacacctgaccatcagtaatctgggaatggctgaacagattcaaagagaagtgtccatttcttaccatttgtgttgagtgtgcatgggtgtaggagccgatggaagagtgggtgaataatcgaagaaggcagccccggggatcatgctcatgatgttacaacgatgtcaccaaacactttgcaaatggaggacatcacaggggcttggccttgagacctttctctctctgcctctctgcttgttacatttatttttttctttaattgtcagtactgaaagatattatataaaccaaatctgtattgaaatatcagcatggtgtttataactcaaaggtgatgttactttacttgatcctcattgatgaggttatacagaattggtctgtcatgactatatatctcagagaaatttgaatgcaattaccagagtgaatgtaaaaagtttctgtgatatatacatgggcaggattactacgtttgagtcaacctgaatatgattgggaaaatgaattcaaaggattgtggcactaacagtgtctgacttaatttccctcatcttatccaaacatacagagctaattgcagaaaagaaaatacttccaaaatatgaaaattcaaaagtaatgggtgatattaaaaacagtaattaatttacactcccactaacagtgtaaaagcatttcattttctctgcaacctcaccagcatctgttgtttcttgattttttaataatcaccattctgactggcatgagatggtatctcattgtggaagacagtgtggcgattcctcgaagatctagaagaagaaataacatttgactcagcaatcctattactgggtatgtacccgaaggaatataaatcattctattataaagataaatgcatgtgtatattcattgcagcactatttacaatagcaaagacatggaatcaacccaaatgtccatcaataatagactggataaagaaaatgtggtacatatacaccatggaataaaaggaacaagatcatgtctttttcagggactaggatggagctggaagccattatcctcagcaaactaatgcaggaacaggaaaccaaacaccacatgttctcacttataagtgggaactgaatgatgagaacacatggacacattggggggaacaatacacactcaggcctgtcaggggtgtgggggcagggaaaacatcaggaagaatagctaacggatgctgggcttaatacctagatgatgggttgatctgtgcagcaaaccaccacgacacacatttacctatgtaacaaacatgcacattctacacatgtaccctgcaacttaaaataaaagttaaagaaaaaaacatgtagtaattaattcagaaagcaataagattgaataataattgaagaaaaatcaccaacgcttgagagaaattgtttaaccattttaaaaaatattttttgatggagaagaaaggaataagatggcagagtgtctcaaggaaatcattgtatttttttgaaatttttacaccaaataactatttggaacaacattaccagatggagataatggaacagacttcggtaaatacagagagcatgctagaggttggtggaaagcgggagttcagaaatcaatagaactttgtcaaatgtgaactccattacaaagagaactctttgtcaggggacaggctactttctccctggatgtcatcttgttagggcactggagagaacattggtaatgttgaaaggaccatcttttggctgatttaaaaaaaaaaatcatactagtctatcacttcttgaaactggtatttttatttatgtatttttatatttccagcagttagagcagtgcctaggtgccacaaaatttgtctatgtttgtgtatatgaatgaatgagtggatacaatctgggaaataccaaagtgaaaatagtgtttctgcttttagatcaaagttatccaaagtactaaattggacaatttttatcaaatgcctaagcagtaatttatattttgtgaaatatgtttaagtaaggaaaaaccctggatacctcctaaaatgtaatactctaattttttagagagaacgttagtgaacgtttactaagaggtttcagaacgaaaagtgtttgttagttgttaactcttttaattccattttaccctttttcaccttcttaaaggcttgaagttacttagcagccccgggaagaaggctttctaattagacctccttcccctcccgcctgcttcttctctgggtgtgcaaagcaatgtatggagttcgtttgtcatggaatcatgaaaaaatagaattggtttggaaatgactcttcgaatgaatctatcaattttctgtctggtttatgctagtttcctcatagcattatattttggacctaatggagtttcaggacctaaggaagaatgtgttcttaaatttggcaccctaggttcctctctggcctctgcctagtcctggctgtgggtgttacccaggcaatgctttgataataaagaagaccaggctgaagaagaaggagctgtttgcctggaagatccttaattgcattgtcttactctctgatcatgtcctccttttgatcagctactcatttggtagtttttgttcaccacattgtgaagaagggaatggaaaaattacagaatatcagaatatgtcaaacaagttctcaggttctgagccagtgagtattggggtgaacaatgctttagttatgccctcttcttttgcctccaactacaaagagctggatatctagcaagccactagggaagtttctgaatgagccttctttctgtacgagagtagtaacctctgcataatactagaccccgtgtagctgtagtgctgaagaaaccctctggggattggttgtgtagttggaaagtgtcagtttggggtgagggagtttattctctcttgcaaaaacacatgtgctctgtttgagagtccatgcattggctggttatgaggacagtgctgtaggctaaactgttccacaaggcactccctgtacactgggagtagggctggttgggtgtctgtgatgacctttagagttgacagcaactattacttgtggaaattagagctattttctagtgatatgttatatagttgtatatactacctattacatggcagtgaccctgaatatatctttatgtgtatataggtatgcatgcatcaacactttttgtcatttaacgtgagtgtgaaaccatgcatttgtatgatttagttgtgaatggatgtgagcacagatatgaatgtgcttacttcatctgttccctcacccaccctctttctcacctcctagcttagatatcaaagtattttgacggtgcaaaacccaagaagcaatgtggcagctgcacatgcactgaatttgatttgtatacctcggggcagctttgggatcacttagaggatgaaataacaaaaacccgagatgataaaagaagagacaaccattggaaacaatttattgttcgaatggaaaatgcagtgcattttgctaaaaacctgtccttgacaccattatcttgttagggatgcaggagcctctattcccacgctaggtttgattgtgttgacaacacacctgtggcttataatcaatgacccagctctcaggcagtgaaggtttgtttttcagagagaaagatacagattttttaaaaaaatgtaaacacatccagaagaatagtttaatgggagaagatacgtgaatttagtagaagcatcaaccccacccacaaggcagagtgaggcaaactaatggccatacagttttttttccaaaaaatgtgcatctttccccctaccctcaaatgtgacccttaatctaatctaccttctaaagtgaccaacaatgaatctgagagtgtgtgatgcaagcctcaaggtctctatgttctatgctgttctacttttgagggggctttcacaaataagtagtgcccacaaatcagcaatttttcagctgcttattaaacatagtagtgaggctggaaactatagatgtgactatattcaacatttctatttcttcagtggaataattttgctgtatatttaaaattatgttgttcttctgtgacatgtataccaactattagattttgcttcataaccccacaaggctctccctgtacattgtgggggtgggtgggcattctcttttgacctttggagttgataacagccattacatgtgaaggttagagctctctctctctctctctttttccttcacttttgaggaaagttaaccaagtttgatttcatcatctgaataatgccctcagtcaatgccctccttccatctgggcttttgtagcctaaatgatgctaacaccttagtcattgtttagcttaaaccttatcctctctctccctggatagatcacaggcttttgcaataagaaaacaatcacttgggatcaatgaagcatatttggttgcatcattttttttttttttttttttttgagacggagtctcgctctgtcatccaggctggagtgcatggctcaatattggctcactgcaacctctgcctcctgagttcacaccattctccttcctcagcctctggagtagctgggactacaggcgcccgccaccacgcctggattttttttttgtgtttttagtaaagacggggtttcactatgttagccaggatggtctcgatctcctgacctcgtgatctgcctgcctcggcctcccaaagtgctgggattacagacatgagccaccatgctgggcctatattttttaatctagattatcctttacaaacttgcagagttcactgagtagaacctaaagagagtgaatacactttctcaaatgggtttttggtttttactgaggatatctattattgagactttcttatttcccttacgatccaagctgaaagttgttggacacttttatctgaattttttaagtcagagcagctcctccagaacaagtatgttcagttccaattttagcccctcggtgcttagaagtattgggaaggaactaggtactgatgatgtttacttgaactgaatatatacagctataaatgctatatatatatatatattcatgcatctaaacaaagaattattgatgagaggggcaagatacaagagagatctaagaacacagatagggccaacattagactggctggaataggtcttttgaaaccaaggaaatgagataatttcctgtaatgtaaacaaaaaagagaaaatgtacaataacataatatcaactttgagctggccataataaattgtcttgattgaacagcctaagactctactggacccattagtctttagtcagagccaatcttttgttctggtctagaaagattaatacatgaaatggcttgttacctaaaatgttcatttcacacagcagatgaggagttttgtatgagagaagggaagttgaaaggtagaaacaaatgtgttacactcctttttttctccttctcaatattgatttcccagccattgacctctgtccaatgccatgtcactgacccagaacattgacttgtctacatgtcattgccatccctcgatttaacaatctgatacatggctgaaaggctgaaggagcgccatggggcttttttggtcttcttgatccccctttgtggtacgtggttgccttttgacaaaagaatgtgttaggactcttattaaaaataaacccagatttttagttatatatagtcttgagttctatagagacaaaaaatgagaagtcagtgactttaggattgtgaatctctttactatgagaggagccaagatatcaaagccaatcaagatgagggcaaaagtctgagtggacgtgaacttaagaaaagtgaaactataacactcacacacacacacatttaagatatatgcaaggttaaaagaattaacaaaccaaatctgctctataatattttattagtagtataatgaaataatgaaatgctggtactggtttagctctttggagacactaatcatatcatataattaatctttattattcattatgaaatttcaaataactcttagaaacaagattgtaggaacaattcttggcatgctgctaagtgtttaacacagaagtatcatgtctccgtggaccagctatgggagtcttgaaccttcatttgacattcttttcctgatttgggatgtaactttgtgaagtttgtgcagggaagtcttgtctcacaattttaaatggaagtatagtggccagaaatatagtatcacagcctttccaggataatattatacaaagcagtgtgaagcatccagtggcttaaaccagccagtatagttgtgaggcagtagaagagacatcctgtgggttaagtgtttctgggaatactgggagtaccaggtcagatcctgaccccaggctagaaaaagttttatgctatcaggatagctgttggggtgctaagtcacagagacaaatggtaaagactggtagtctgtagaattttagagagaagtcaaggtttcctagccctttagaagtaatcagtgagaaaacaacactacatgctagcccgaaagacctagatcctggaacccactaggctttaatttatgatttggggaaagttctctttcttgtgcttcctttcctttatctgtaggacgatggcttgaactaaatctattaactgtcatagggtgctgtttataaaataactctggattgtaagccttatcctagatttatcttttgcttaaaaagaacattgaggtcctcaattggaggaacactctgtacaatggcatgtcatacatactccaattaagaggtgcagaaaatagcactttggtttcaaatatgaagacatgaagtaatcctgactcatgaagaatgttcaactacccagtaagtaggcaaattcttcagaatttaattggaggaggagggaggggttagttaatttgtctctgaagatttctgttgtgtagccaagaatagaaagaatagacttgaatttctcaaaaataatagtatatttctatgtgtgtgtgtgtgtgtgtgtgtgtatatgtgtgtacatgcacatgcacaagttttcacttgcaaccttcttgcaatagaagaaagtatgctcaaaacaaataaaaatatctttagtttcttaacattccgggacaaactccctatctcatcttttacaccatttatttgtttatttggggattttctctgcaatcatttagtgaatatctactggggctaaagttccaggcactttacatacgtcatctctattaattatatatcttgtctccttcagcacttagcacatgctttgaatagatagatgctcagttaatatttattagaatacatgaagtagtagcaaaacaacattcaaagacgcaaatgtgtaaaagttgaggaagggaaggggataagatgtaatgtggttaacacgaagtcaatgcaaagccatcaaaaccgtgcctggagtgctcaggtggtcaggtcagaccttccagcagcggctacatctgatgcctatcacccgttgtttctatacaggtatcattaatagaggataatctctttcttcaggcataaaacccttttgagaaaagcgctgactgttcctattgcaatgctctttgagtgagcaatttcacttagaaaaattgtataaacaagtgcttaacttcagctttttttcttctctaattgatctaaatgtgaagttaaattagctgctgatgaatagttcctatgctgttaagattatgatttttccagaagagaggaaccagcctacattactatcctgagcacttctcattcaaaactttaatggatcacttagaagcatggccagttggtctttttctaatggtgacaagtaaagtgcacatcagcttgttatcagaggagtttatttacaaggattctacaggttaatattcccttaagtaattttgctcatgaatctccaagaatggccatgtgctgtcacattgctacatttttcattgttagtaagcccctgaaaaagccagaacaaccatggtgatttcactgctagcatttagatattgttgtcttttgtcttaaactatgagaatctgacttacgtatttatcttgtcttaaataatagtgaaaacagagtctttgccacccattgcaacaattatgcatttttttttataggaactgcaaaaatcaaacaaaacaacagaaaaaaaaaactattaagccacttttttttttttttttcttgagacagagtttcaccctgttgcccaggataaagggtaaagtgcagtgacacaatcttggctcaccacagattctgcctcccgggttcaagcaattctcatacctcagccacctgagttgctgggattacatgcatgcaccgccactaatttttgtatttttagtagaggtggggttttgacatgttggccaggctggtctcacacttctgacctcaagtgatccccctgcctcggcctcccaaagtgctaggattataggtatgagcctctgcgcctggccaagccatttcttttttttcttttttcccttggttttctaggattccccaagacctgatttcaagaattctggaatctgtattttcatgtagactatctgtgaagcaataataattgttttaaaaggaatagattaactagggactccaggtgaatttaggaggatagatctaagctactcatgcttatttaggaaagtgaatgtctttacttattttcataattatcccaatggaaataattaactgaatttggttagaaactgagaacactacaaagcaggcatctaactaatagagatgatctctaaagaaaaaaaaaaaactagaatttcacattgagaagatttgggaaaatgacataatgtcataacttaagcatccttacattgtaatccaacgagcctttgtttagcaccttctctacatgcaggaactacaaggaacataagataaatatatacagtggactttacacttcagggagtataatcttgtttgtgaggcaagatacacagccatgaaaaacagaattatttaaaatatatatactttttttgagagagagagagaaaatctcacactgttgcacaagctggagtgcatttgtagagtcatggctcactgcaacctctacttcccgggttcaagtgatcccctcacctcagcctcccaggaagctgagactacaggtgcacaccaccatgcccagctagctttttgtactttttgtagatatggggttttgtcatgtagcccagactgttctggaactcctgggataaagcagtcctcccacctcagcctcccaaggtgataggattacaggtgtgagccactgagcctggcttaaatatatatactattttaatattatcatgttacagtatgattattctcttagcaatagactctttccctcttcagagagaaaaataatgaattttggtttctatagcgagttttgtgtacgtgcccttgttgtaggaaaggtaaagtataggtacaaaccagtttatttggggacagaaaaatgaatgaaattgcttaaagcatcttgtgcctcattattaaagccatcaaatattgcgtagcaaacctctctcaggtgccacgggaaatgtgatgtttcatttaaatgtttcttattcacagactcatttagctttattttccctctgtctcaatttttcctaggtttatttgagatgcagtgctacaaatgatgaccttgctacaaaagcataatgttttttttttcaaaaacagattggatacatgcccattgcttagtgagaaatcaaagtgtagtagagagagttgaggctttggcatctaaaagatctgattttaaatccaggctcttctgcttattagcttgtgatcttagtatggttacttagccttgggacttttgcccagtaaaattatttcccttgtagaaaacacttttgaccacgtatttaatttgttctgttgttcaacactctcctctccactgccatgcttgttatgactgttttcagctataattaatattagcagtaatggccctttaattcactttcctagctgcaaagagtttatttaatatttgtgcatcacttaatggcagaaagtctttctagtaatttttgttatttttcttccactgcttgcagtgtagggaatgagcacttaaccaaaagttgagagttatttagcttcggcttagttatcaggttcctggataatttagggacagattgaacagtctgaagcagcttagaaatctggtactttgccttgaagttccaccagaagttaggaatctctgtctcttacccttgacttgaaaccttcttgaggtcctcacatttatataatgtccctgtcttaatctgtttgtgctgctataacagtatacatgagactgggtaatttataagaatagaaattgatttctcatagttctggaggctgggaagttcaagagcaaggtactggtaggtttggtgactggtgagggcctattctctttgattccaagagggtaccttttgccacatcctctggaggggaggaatatcgtttccacacatggaagaagatgaaaaggcaaaatggacctaagctagtttcctccagcccttttataagtcactaatccattcatgatggaggatccctcatgacctagtcacttccccaaaagcctatctcttactgtcaccacaataaagattaagtttcaacatatattttagaggagcgacattcaaactataccagtcccctagaataaagtttctgctctgagataaatgaggtattgtccaaaaccatcttgcaaattagcaagataatatataattaaatttcctgtttggtgattcttagtataccatcttaccagttgaaccaagtgtctctttagattgagcttgtggtacccaagcacctacgcaattagcaggaaaaaattgccagatggaaccccctcacaagacaaatctctccattccccacatctctaaactccattccccactttcgaaacatcaatggtcatttcagatgggcactttgattcagtagaagaacactggatttcgagatttaaccatgagttttacatttgtctctgaatatcttaggtgattttataaactttgtagactgtccttgggcctcagtttccatcattataaaatgaggatgttgagtcatgcaaaacagaaacaactggtaagatccattccagatctaaaattgtatgaatcaattacgtacatagcttcttgcacccaatgtattaaatggttctgtctgttctttctcacctggccatatggggctggccattgtagcatggggactctgcagcagaagagaaatgaaagattcttctttagtctctttcagctaggagcaaataatctctgtgcttacctagacttaaaggagctgttctaaagctatatacctgccattagggaacatactcagatcaattatttaaaaagaaaattaacaaagaacaacttggcattgtaacctttcttagcagcttgaatacaaggtattaattagacaaggaaaaaggggggcactaattatttcttaagtggaataattagtgttgctgaatttataaattaaagggcctcattaagaaaaaaaatcaaatcaagtttgaactatagtgatatcactgtgaaattataaactgatttttgaagactgcactttgatcctatagtagatgaaaatttctgtttcagaccatctggatttacttaagggggaggtgatgcatgtagttggtgcagcattttagaaagaaaggacaattttttagcatctaagggtggaatcttgttatgctgaaagaaaaccttatcaaataatacactatttctaagaatagagtatttggccagcaggctgatacatatttcattgggcacaaggtatgaattcaacatcaaagtagttccagttgcaaaacaggagcaggagcaacattgaggaacctgacccagctagagttgggccttctatgcctatgttatgtactcaatataactataccctagtcctgcccttgactcgattacagggctgacttcacttcctgtgtcccaccactgagggggctccagacctggtttgaggtgccagtgtctcaacaaacgggatcaatatttgcagatcctcaactctataggttttggcttcaaggtctgctttcactggggcggctgtttcttgttcctcttctcttttctgccctagcgagctcattcttaggagctgctgctaattattgatcctactctcatggtataagacatctttagcatattccaccccaaatgctaaaacatgacagaattatatcttggaaatttataacaagaatttggagttaaagttcagaaataaaatcatatttggaagtcttggaaaaaagctgtctccttggtccatgctttggagaaacaaataatgctgcctcttagttccttaaggagtcacatatctttggatgaggatctaagactgactccctaatagccaagtcaaagaagctgcatgctgcacacatgtacattttcatctaacatacattgaatggtgttctgtgctaagtggactttcatatgtcttaatattcagagatgtaaaaatgaataggaaatatctcttgctgtcatagaccacgcagtcattagaggaaacagacaaataaaatcacaataatttacgtgctataataaaattatttagaaaacaccaagaaactcagaacagagcagtgcctttcaaacttcttttgacatataattgaaacaaaagttttataaagctatattaaccacaactacatgcagtgactaatacttttgttatattctattctgttcctttattttaaaataaaataaatgccttaatgaagaaaataccataatcatatttccattttatagagaacattttggtaaaacttataggacaggttttactgagataagactggagtcagagagactatttgtggactattgcaagtatttgggctagaaagttttggaagtgaacccaatactctggtgttgtaatgacgacatattggagagatattttggagacagccaacaatgaccaatttgacctgagagattacagaaattaagaaattgaggatgatatcagggttctgccttgggtctgtgggtagattgatggtgactttaatggagatggggaacacaggagacagagtaaattgaatgggaatcagatagcttgattccattgttacataactcgtacctgtaatactcaggtgcctgtgtaggaggcaatccagaggtgcctatcagtcacttttacttctaagactgtattcttcactcttatattgtatgtcattcattatttcatcaaaataatattaccatgttttaaaaattatgcacaaataaaatttagattattccctagtattgtatgatataggcatattaaaatttatttaatcatttctctagttttgcacattcatttctaattcttcaccattacacacgatgctaggatgaatgtctttgtgctagatccttcttacacctgatacatcccttaagacagattctcaaagacaaaattcttgagttaagagcatgaacgtactaaaggctcaagatagatatcagcaatagttttccagaaatgcagtaccaatgtttacctcttactctaaatttataggattgtccatcttaccatattccatgcaagagaggcggtattacaagaaacagactggtgagaaatgttatcatttttaaaattgcatcttttattatcagagggattagtgttttatattaattatatttttatgtgatggttagacaactgtacttctgtgaattatctattacatgattttccagtcttcttccatttgtatcttattatttatctcattgaatgttatatggtatagcttattttatattatgtagcatttgtttatatacattaagtgtattatttttgttatattagtgtcaaataaactttcatcttttatggctagtctcttctttttatttatgtcattttgaaattttggagttttaatttttttatgatttcattcatgaattattcagatgttgtttttctaaaacaccttccttcattttcctggtttctctgtgtttcatatgattattgtaatttttcctctttctctcttcaatttggagtttctgttggtgtatgatataacaacatttcaaaacctcatcctccaaatcagtcaacgggcttctatacatttaccacagaaattttcattccactgaatttttctcttggtttttctttagctggaacagcaccaactcattcttgtatatgtatgtaagcaaactcatctgtcacttagcacttcctttaagaattgcttttctgatcacttaaaattcccctatcacaatcacttattttcttacttaaaattttgtttacattatttttaatatattaaaatagcattttaattctgtttatttcctatttgtcttctcaattatctaattgagaataataaatttcttatgactagaaactgtatagtcaacttgtttttgaacttctcaatagcagcccaacactgggcactcaagggaacataagattcactgaactgaggctgaatgattaatgtcacataacccctataatcattagagacctctgtgcactaaggagtgacacttcctaccgagcttccttcagaggttagggtgcaatcctggcatgcctttgctaaagctctttgtgtgaatcattttgttccctttatcccagcaataatttaaatctgcagcaacacctgaaacacattcatgaatgagtgatgtcaaacacgatgacattgtctcatctgtaaccacattcctgtggagaccattctctgcagtgtggaggaagagtccacagttctccaagggtagttcaagatcacaaaaaaattccacaacagaaatgaaggtaacaaaagcttttgctgttgtccctggggtggcgtggcggggtgaagaccctgtgtagcaggagagttgactgttcaaaaaatactcatcagctcttgtttttaaagttaccaagtcgtcttttttatgcccgcatttgtatgcctgattcagaaatggactttgtttcatttggacaattagcagaattgcatgacaattataaacagaactaaaagtacatatttgcatagtctattctgaaaattaaactacttcactgcattcatatttgatgaagagacctttcacaatccccaaggaaaagagtccattttttgggtaacatacacaagcaataataatgaaaagagagatataagccagtgtttataaaaacatgaagaactaatcttaattaatgggttcttcaaataattagttcgtggaatagctctctatataataatgaaacacataaccaaaactcagacttcttgagaaccagaaatttttatagaagctcagatgccttctagggtgataaaaagtgcatagagcaaaggaaaattaaatgtgaatggttcacaaccattgcttaaaattccctgaaaaagcaaatgtagaagataaacgggaatgcacttgtctgggtgctctattttcttgtcccaataaagtggaatgtgtggtatgaaatagccagcaaggcttcattttgaaattacacatttttatttttatttatttatttattttggagacagagtcttgttctagtacccaggctggagtgcagtggcatgatctcagctcaccgcaacctctgcctccaggttttaagcaattctcctgcctcagtctcccatgtagctaggactacaggcccccaacaccacatctgacttatttttgtatgcctcagcctcccaaagtgctgggattgcaggcgtgagctactgtgcctggcctgaaattacacacttttagagcagctagtttattcccagcttccaaagaagatcccattccaggggaacagttccacagtttaaaaacactcagaggatgaagtgattctatataaccaattgatagtggtagtagtgttagtagtagtagtagtagtaattagtgatatttttcagggaggaatgtaaattccttgaacttggaaagtcgaatctaaagtttaacctagctagaccaaatgaattaattatctttttctcttaagtaattccagtcatctgtaaggttttttaaaaaatatttaattattgttgtgtagtgcttggtatagttgacaattgttttcctcttttaaaattacctcttcacatattggtgctgcgagctataatagccatctaattagtagaaaataatatttgtttggtgtatactatgtcccagggatcatgctgagcatgatatatagatagcacagatgtgtatgcatatatatgtgtatacttacgcagatataggtagattcttattcaatcctcaccagaaacctttaggttgtttctagacatctagcataaggtcagaactcaatattagccaacattaatgttattttcccatttcacaggtgagaaaacagaggctctgggagcctaagtaacttttccagggggcaaaacagcatccaaatccaaatctttctgaaccgctatttcagaacatttcccatctgccagattaccaaacaacagtgattgggtttttagggggtttcccatattcaaaagacctgtattaaattccagttttaagatcttaacaaagatatagctttcattttttgccctcaaacatgattttaaatttaaaccttgtgatgaaatgtcattaggggattttggtaatcctcatattagtttttcaatcagtaaatgatgttttttcttgagtaatatttccctagtcatttattttcattccttttctgttggtccaataggccttttgtgagcataatgagttttgaaagaaatggagtgatatattaattaaccaagctaattatcttggagagccttgatttttaaaccccaaggtgtatacattatttctgaaaatgtgtgttgggagatcttgattgagatggtttaggcagagggaaagacagccaagtaatacacagcaggataagcaaattttggttttagaaattagggaaagagattgttgggaatttaattgctggtgctgttttgtttcccatatataatttctaatatattacaattgcacacatagtttgtacacattacacaacatgtatcatatatcaaaaatcacctttcaccataagctcaatgtcctcattgaaactaactctccagtctagtacctattacagataccattacgggagtagctctggtttttgatgccataagttgtagctacttaaaagccagtagtttaactccaatttgaagaacaaaatgaagcagaaagggcagagtagctaaggtgagatgtatgatgttttatttcatcagtagcaaattacaccgaattcagctgaaaatgtctttctcatattttcttaatagcactttcaattgaaatagacacatagaagaaagattcttaaatggcaacaactattgatcatgttctttgcttcctgtctaatgtactaagcagtgagttagtgctttgcagcaggtatggctctgccctccagcagcctgttttctatgagacttactgaaggtgtgtgaacaccgatgacatcatggacatcaggacaaaggataaatggatcttgtgggaagggagaagaaaaaaattggtaaattacaggagaccagagagcgagtctggatgatgacatttcccagctcttcagggcacaagaatggtatattgttttcacgtgtattgaagctgcagcaatctccttctgcaagcccttgctatgtgtttggacagagctactaccagcagcagagacaccagcttcctttaagatctttccaatgcaagggagggcaaagccaggctgttttgttttgtttcttccttccttccttccttccttccttccttccttccttccttccttccttccttccttctgtccttccagctttaatgaagtatgatctatgaacaaaaactgtctatatttaagaagaagaatgtgatatttctatttatagtttgttctggcctcattgtttgaggcctattgcaatgctctctactctttcaaatattctgctgcaatgaatgggattctcataggttacatccaaaagaactctttttctctttacattttgctttggataggaaaataatacacatttataaaagtttaaccaatatctagttttaaaagtaaaaagtaaatgttttcctttgctcgccaccaccaatcatgctccactgcccagagttgacccttgacaaccctggagggtgttcttcagcatggcacatgcatccatgggcatactaatcacatcgtggtctatgtgaggggctctccctggtaccaggcagggctcagcctgcattgctaggcatgaaagcctagaataacattaacatctgtggacccagtggcgagctttggaggcctcagtcttagttctgtcaccaacttgcttcatgttaggtgtgacgttcaacttctctattttttttttctgctaattgaggcattaggagaaggcaacttttcatgtgtctgaagaagacattggaaaagaggatttctaatgtctttccagctctaaaattcatagatgtgctatgtatctttctagtaatttgttgctttgtagccacagtccataaaccaggctgttgacacacagctctccagattccaggatcagacaagagaattaatttttatttattatttaggttctgccaaattactgttttctggttgcaaattaaactactattgcagaagcattttcctttataagtgccacttttttttttccccacggaaatctatactgtattttgcatggctatttccagtacttttagaatgtgtaggggaaaaaaaaaaacctttgctaggagtatttcagcaaagtttttatttgggccatcaactttctgtcagcttcctgcaggtaaactggagagagaaggtgagatgtattctttggacatttttccttccagggccttctcttctgctttcagcagccttcccacacacacgtgaaaatatgtaggggatgagtatattttggaaatgagttttccaggcatggtcaggtcaagctgtgtgttattaagtatatgatccacatggacgtataaatgatagcttcgactataagctcaagtgcatttgagatatttttgggcaaaagtgtctccacacagtggacacttggtaagaccaatatgtattaatagccagagatcgttcaggaccgaggatagccattcatcaaaaactatgtcttctgctgggtgttagttgtgtattctctgcccagtgtgtatggggaagaatatgtgtatccaccctccctggaactgctcagcgctggctgcatacgcacagggtgagcccacctgaagagtcactctgtgcttccatttcatcttgtcgatgagttcatttttgcagtggcttataaccagaagccagttttgcactcccagcatgtatttggcaatgtatgcagacatttttggttgtcacactggggaagtcctacctgccaaataatagataaggtacacacttaaatttgaattttcaataaacaacaaataatttttagtatatctcaaatatcgcatggaacatatttctactaagaaattagtcatagtttatctgaaattcaaatttaactggacgtcttggatttttattggctcattctgacaatcttatgttaataacgcagtaggtggaggctatggaggttgctaaacattttacagagcacaggtcaataaagatttatctgacccaacctgtcaatagtgatgagattgagaaattctgaattattgtaatactttatatggtaacatagtacatagtcatgcaaaaagcaatatggatttcaggagaaaactgatggcacttataaaaaattacttctatggtaggagttacatttgcaacaaggaaacagaataatttagcagaagctaaataataacttaaaaatcaattatcttgttggatcactgaatctttgaagctgtgtgcacctccctaggtcctccatcatttgatttattttacaaggacagcgagccccttctttcatgaaagtctggcatacagtgtatatctaattgattattgttgattgattcaatgaataaaaacaaacactttcttgtattgagaaactattaagtactaacctttcacacatattgcttccagttcaaacaaggagagtattataccaatttttcatatagagagactgagacttacattacaatatgccagaagttatagcactagtgcagggcaaaggtgggatttggggagaggatgtttcttccctaaggtttctatgctttccccgccacaaacagaagacccaggcagcaaaagatctgtaataggggaaacattcttccctctatgaggatcctgtatcagatcttcaggttgttggctctcccacaaacatttcttccatgaatgtatttctgttctttccccatttctcagtaatgaaacagtgactgcatatccctttggaggtaggtggatctatttccaaagctctacctgctgggagacatccacaaccttctcatgctgcttctgtcaatcgtctggtgagcacaccaggatgggcacagaagggacagctgttacagtcttgggctcctgggaagcctggcagaggtttaccctgcctacagacactccaatttagtagcaatcattgaacatttttaccctaataaatttaaaaataaagaagtttgcatcatttattttaaatttgtgggtaggatttcacactatagtcatttgtgtttgctgatgagtggaatggcttccaccttttatgctactgtgcagtctgaagaaacccaggttggcatctgctcttgtcacatggtggagttcgcaggtctccaaggagactcatggtctcttaggatgaaggaaagagaagaaatgcagcatcctgagtcctgggcaacagttttgtggccaagcatcatggccacttgtctcattaggcaaatattagttattcctcatatccatctttttccccagatcactaagtcagaaattgttagttgtattcattattacacttccctcagcatactacactctcttatacatagcgaacattgagtgtattagcacttggagtttatacagcctattttgcagaagtttgtcccctccattaccaaaagtcttatcatcttcttgcctttcacatctatgtaagggtagaacatcttgttacagatttttttttgtgtgtgtatgtgtgtataatattatacacacttttaggcttctacattcatgtatgctgtcatctggttcttaaaccaaaattataaagtaatatttccattttgaagatgaaggaacagaaacttggtgtataaacaggcacatccccaagctacaatagtttataagaggcaggatcaatttggagcctatcatctcttgacttcttcccaagggatttttcttctctgctttgtagctcatgaacacttagaaggaccctcaaatgttgcttcaccattatggatcttaatatctaaaatcagactgtgtgttttttaagccaacaagcatatagctaggcacaaaagagagatccaattttattttcctctaatttctggttttgcatcctctaactgaaatatatagtttaaacagattcaaagaaattgtttgaccagaggaagttggttttaaagtgagaataagagaaccagaaggaattaagaattcatacttgcttttctttctgagatgaagacaggctatctgggtctttgtcctgctttgagcattggttgtcagtgaaggttatcatcttgccatactcagagtggctcatagattcaaaaactgccctagttcaaggggactgggggaagggagcagaatacttgagttatttaccaaggacactggtcaaactttaataggagtcataatgcaactgagcaccaccttataatcaagcaactctattctatttgggcatatccctggatctattgggggtagggtgactggaaatatacttaacctgcttatgccatcatatgggcacgctgcttttctaccaaatctttggaaggcgtcttacagttgcatggctgggagaagtgtcacagactgcaccactgggacagctaatgtcagacacaaatctgtgtatcagctttaaagctgccagtgtagcgctatgtgtcaactattcgagtccacaaattcttggcataaatgccaataagtcaaaatcaaatctgcgttatgaggcgcacagattgcctgcctggtagagcacacatgctcattcagttatgtgtgaataagaagccacttgatctattaattatgcttcagaatcaacgtgaagctctaggtaagtggctggtagcagatgaatagatggctcatagagtgaagtatagtaattgtcttgaggttcttgatgtgcaatttagtaaactgaaatatggtatttttcagcctaataacagaaaatcctctatctgtgccgaagggtggcagttgcatgagtcactctcatgttcagtaaaacaaaaaggcaactcaaccaattagaaagcttggatgatacattgccacatgctaatgctattaataggatgactgcacataagctgtgactgaaactgtatagtgaagtcttctaatggcagttaccgatagtgagaaagggtagtatatgtgtaaacccaattcatatttactttatgtacaatgcaagttgatggaagaagaaaaacttagttctaatgggcagtgcattttatttaaggcactatcattcctcactaatatcaggggcttaagaatgtgtgtgtgtgtaggtgaggggaaaacttgttgcaatactcctgctgctaatgcctttgtctgtgatcccatgctccacttatgggtggtacattatttactttggtgtgttcctgtctactcaaaaaatgcagtgaagttcattttggtttatagaaagaaagaccaagaaaataaaatatggaaagaccataaagttgacttccatcttccactttttttcaggattggaatcgaactatgcaataccaatagcatcctgtttctggcaaaaaggaggaagaatataatgttatgtccctttaggatcttcttccaatcttatacagatgttatttttctttgcaatggaagctgtttacctttcattcattcctctgtggtgaagccagggccagtactaggctaatctgagaagtgatgaaattagactttcccctctgttcttctttggaatgtccatcagggctttcactgtgggatgagatatgttgcaggcactgaccacaggtacactcccaatatctgtgtgatcatggttcagtcattttcattctaaacctaaatatccttaactatgaaatgaaagaatgacatgcccattcataacagagggttattgtatcaatgatttctgacttggaccatacggaatctcatggaatgtagaggggacgatgcagatatagtttgaagaaagcacatcagatggttctaacatgtacttcctcatcctcgaatgacctgagtcagtggttctcacagtgtgggaccaatgggagcttgtaaaaatgcaaatcttgaatcagaaactctgagggtgagacctagcaatccatattttaatctctatattatttatattttcatgaataatcacaacaaagtttgaggaccactggcctggatgtggatccaagaatgtggtcacctaaccacctgcatcagtatcaccaggagcttattacagatgaaaattcctggaacaaaaccaagccctgctaaatcataatatctgggactaaagcccagggatcaatgttttgacaaacttcaggaaattctaaaacctgttcatacttacaacacaaagttagtctagaaccactgttccagaaaagtgattgttaaaactaagtgcacattaaaatcgcgtgtgagagtttttaaacaataccaatatctgggctccaaccacaggccaattacctagattctaatttccagtcaggattaaaaattactagactagattatttttaagacccctttcagattcaggttccatgatttttgcaattttgtgttgtttcctaaatgcgtattttaattctcaattcatagcatgcttttcaatccacaccatagttgatttgtaccacacagtaccctacctactggtaaattcacgataggctggtaaattgtcatcggctaaatccagcaccatttacaatactatgagctaaaaacaacaggtgcagcctgagaagctcatctctaaagccataccttcagaaaacttggtccaaatagatctcaactcctatacccaaggcatcctcgtctttctattgctgtgttgaatgacactagccttcaggtttcatttacttgaatactatttgcaacagaattaggatgatgattattattattattattgagacagggtctcactctgttgcccaggctggagtgcagaagtgtgatcatagctcactacagccttgaactcctgggctcaagggattctcccaccttggcttccaagtagctaggaccacacgtgtgctctaccatacctggctaattttttaaagtggtttttttttttgtagaggtggaggtcttgctacagtgcctggcctggtttccaactcctggtctcaggtgatcctcctgccttggcctcccaaatcgctgagattacaggtgtgagccaccacacctagcctcagatttgtaattattttccttgctgcttccaatgtttttaaaagcataagtcagtgggcagcaggttttggaggtcagacccttaggagttatttcctgcagcttccagagccccatcctaataatgaacacctgtactaggcttagtcaaattgatactgtttgccagtaaactctggttttcaaggaaactgaaaccagaggagccctaataatacatgtttttaacctgaggtttgggcttgagccaatggcatcagagagcagctcaaatgagctgttgcaaggaaggtttatctgaaaaatagttaatgaaagactttgagagctgcagggatgtctgacagattggcaactcactttgagaaagagactatttcccgttccaagtcccagacacacagcctgcgggtaagtcatcagaagtaaaataaacggggaaatgggagaggggaaaaacagtaccctgtaacatctatcaactgtacaagccaaagctactgatgaagttaaatagacaacaatcctttgtgtttattttctgttcagtgaagttgctaacctgagctttcagaggactaacaccacaattaaaggcaagcagattcaggggaacacagtgaaaggtagatcaagagtatttttatgtttagattgaaatttactattggctaggaaaggaggtgtttattgtgtctaaagacaataatactattatccacccagcaattatggtcacaagaccactcaaacaagtagtgggttgttttggttggagagaaaaaaccaaggctctgtttgcggtattgctcggtatgtgggtttggttttttttgtagtttagtgggctgtgggcttttgcagccaccctcaaaaggatgaagagacttttaaacagcttcggggttggtaacaggagtcccttggtcccttcagggaaaccaaagatactcaggccaataatttaatcaggagaagatttatcagttggagtgacacagttttaaaggtgcaaactctctgtgtgattctaagcagatatgaagtccagctgagaagccagtcaaactgatacttctcgggtttctctacccagctattctgagcctgagatctgccttcttcttactctggcaaatcagaaccaatgttattctcccagatttggggcatcacatctattacgggtcatggctcctcctgaagtcaaaggcccttcatttccatcttctacatggattcctgcctggttatctactcttccatttaatgcaacctattctacaatccagagctcaacctattccacaacccagagctctctggcctctcacagaataggtaagatttctaaacctttccacagattcacataagtcaggatatacctttagatagaaaacgttaagcctcaggccaccctccctgctgagttctagtcagaactcagaggccagctttcagtgtattctgaggaaggaaaagggaaacagactatcaaatgcaaacactaatactgacgctgatgggttgtatgattccaggcaaactgtaaatctttcctggggttctctatgtatttcccgttaaagcagaaaagaaaataaatgcctccctattctgcatgttatttgggcaataaagtgctactgatttgtgaacttcaataataataaaataacactggaaaaacctgcaccacaccccccccccaccccgccctgaaaagacttcaaacatttgatgaagcttcaagcaaattagaaaaataaaaaaatcaacaatttgagctcctcctaattttcctgacaatcaattttctcataggatgcttattttcagctttacaatctgccaactagctcctccaaacctcatttgtgacccctttatgggggaaacctagaggttaattaacagatgactgttagttcctgaaagtcgccctgtgatttagtcccgaggtggcctgagcatctccatcccttgttaggaaaaggctctctggttcaatattaatttctgtagcttttacaactctcactgggattaacatttaatcaacagagcaggttcctttttatatcattatagaaaagtttcaataaaatagaatggtgcattatactgtaatgaatgacaaacactggtaaattttcatttaaaatcagtaagttgaacctagagttgattcataacggatgggtcatctcaatttaatgaatagtaactaaactaaaaacacattaaacaaatgcctggaatgaaaagggagacatagttattgccccacgaggctgtgtgatcctctaagagagggcatatgttttcttaatttttccttagctgatgcttagagcaataccaagcatatagtgggtactcaacaaatgctttccagactgaatatattaataaatgtttctgtgtatagaaaggtattttcctttagaaaaaatgttactgcattttgctaattgcggccacctctcaatgaatggggatgatcacaagggattatgtatactacatctttttcttttataaatgtttatagtagtgattctcaaacttgtgcttgcatcaaaattacgtggggagcatgtaaaacagtgatttctgggccccactactagaatttctgatttaatattctggggaagagctcccaaaacgcatacttctaaattcctgggagatctgatgctgcattctggagatcatattgagaatcactcgcttatagcatctatctgtatggcattggtggcaatttccatttattcatgtacaggtgaaatcttccctagagcaggtcctcacacacagaaaatacctggggagcattcgctgactgcacagataattccaccctcattgtggggaatgtaacactattgctgctatatgcataaatggctttcattcctagggtcccatcagctatgaaaggaagcataacagtattgctgttggccttttctttcatgtgataaattgccattagagtgctaccctaggcatatatcaatttccttggggatctaactttgactcttccgaatctgcccacagttgctatagctgtgtgtatgactctttggccctttcacacagggtggctgtcactggagtaataataggagccattgccattagagtctgccagtggtattgactctgtgactctacctttgagtttgtataatattttattccaattaagcctctccatctgtatttgttttcatctagcaaactgttaattgtaggtggctctggatatatctgatggtgctggccacggaatatctgtccatctcatgtaaaaaatgtaggaaaatattttattaggaaaagaatggccacagtggtcatgcattttgattggggtgtttgatttgtttgcttttaagtaatagggctgggcttcaaggcctcatcaacagctcctcaccttgtttcctttctgagcagtagcaccaattgctatttaactctttaacttagggatacatatattggggtaatgctttaactttgacggtacatacattggtaatagaataggatagagctaatttactgatccagttttgtgggtggaggatttcacaactttggtcccattaccaacattttcttagcaaatgttttaaagttatgttaaataagcctgatagttggatattttcattcagatatcttagagcctaatacacctacacatcttttctctcctttcaaattttgatgcattcttcaaggaaaagttcattccactctcatctgtgggttttttcccaacatgaactcttaggtgttactaacttgatcattcttctggcactctattacataccattttgtgacatcctttgtattgtaactttttatgcgtataaactttgtctcctcaattagattgcacactttttcaatcatctctcattttactacatgattattcaacatccactatgcatagtgcaccaaaattgatgctggaagaatacagagaggcaacatatatggtcttatatctaggctcttaaagaatttatgatttagcattaaggccaagctgtgcacatacatacacgtgccataaaacagcaactttcactcacagtagcacatgagttaggagtgatataaataggatccatataagtctgtttttccactgggcttacatattgttttatagacatagtcatggagtgcccatttattttcttcatatgtacataagggatgtccttttctaattaggttcggtgtataccgctcaggagatgggtgcaccaaaatctcacaaatcaccactaaagaacttactcatgtaaccaaatactacccattcctcaaaaacctatggaaataaataaataaataaacaaataaataaatttgccattatgtcaaacctcagaagtgctatgaaaagagtaattattttgacctaatttggatatatttaaatttaaacacacttgatactgaaatccatattgataaaaaattaaactgagataaggctcttgacaaaaacaagcatctttcatagtaagatgtctttaaattagcaagctccttcacatatttaaaatatatagtgtttttttgtttcttttctggacaaaaggaggagtttgaggaaaaagttgagtatcagggacagctttactgatgacaatctaacttcctcctagctctagttgcccctagataactttccagcattgtctggtcaaggcactgtttaattttcatcttcgttctactgccaccattataagcagataagaaaatgtccttttgttatttaaacacatatctataattttctattgaaagagtgtaaaggggagactgatcatcatgaagcccaacatcatcttcccattccttctccttattcttcatcctaccacatcctttatgatccagtgttgctgatctacttataagtccctaaaaatctatttttttagagtcacatctggcttttcttgcctgttgaatctctgcttcatcctcaaggcccacctcagtgtcaaactctctgaaaagccttcctaaattttatgaaacagaggtatttgttctcacttttctgtgatgttatgatcactctatatgatggcattaattatagtgtttttccattataaagccgttattgacatgtctgttacgttcattggactgtaagttccctgagagtgagaacctgtcttattcttattaatatcgttagcattttctgagacagtatatcttgctgataattggatggccaactatatatttgtacaattaatatatgaatgaatttatcaaataaatgagtagatgaatgcctacctcaaaagtaacaaattagtgactacctcttagaaaattgaatggataataaataaatacaattataccaaataccattctatggaatttcttttgatcatattttcatgttgtgaatagaaatatgtttgaaagtagcatatcccatcaatagcaattcatagctcaacccaaatgtgtgacattaatttcaaaatatgtctgcttttgttctggcacttttcaagctgaatgtgtacccagtatgttcatcctgtcaattcataagggtagcaaggaatataaaatatgaaactgcattatgctataaatggtgatcttgaaatcaaaagtattggcagacaccaaaaaatatggatgatttctctagtaccttcaaatttcctaaacaaaacttcctataaataaaattatattttaaggaatcagttcaaaagtcaaagtgtgtcataaatttattagttagaatggcgattattaaaaagtcaggaaacaacagatgctggagaggatgtggagaaatagaagcacttttacgctgttggtgggagtataaattagttcaatcattttagaagacagtgtggcaattcctcaaggatctagaaccagaaataccatttgacccagtaatctcattactgggtataaacccaaaggattataaatcattctactataaagacacatgaacatgtatgtttattgcagcactgttcacaatagcaaagacttggaaccaacccaaatgcccatcagtgatagactggataaagaaaatgtggcacatatacaccatggaatactatgcagccataaaaaggatgagttcatgtcctttgcagggacatggatgaagctggaaaccatcattcttagtcaactaacacaggaacagaaaaccaaacaccgcatgttctcactcataagtgggagttggacagtgagaacacatggacatagggaggggaacatcacacaccaaggcctgttgaggggtgggggactaggggagggatagcattaggagaaatacctaatgtagatgatgagttgatgggtgcaacaaaccaccatagcatactgtgtaactgtgtatacatatgtaacaaacctgcacgttctgcacatgtatcccagaacttaaagaataataatgataaataataataataataatgcatgtaactcaatagtggataaattctgctggcccttgaaacccagaagaaagggttactatttgggaccggtaaagttcatcagaatgccatcaatcatatgctttcctaatgggcataactctgaccacattcatctagggatcactatctgaatttgcatggcatagaacatagcagaataactttccatttctccatctctactgagcatttacagcatcccactagttacaacttaacttggaatcttgtggttttataaaccccaggataaggacagaacaaaattcatattctaaccatttactgacgctgaagcaaattgacctttagcaagtcaactggcaatgcagagaaaccacaacaaactgtgacttaagcatttctagaaattactgacttaattgactcagtctacagctacatgtagagcaaaggaacagtgaaaatggccctgtcctcagcctttgccttttatagatttttctcaggtgcattcatttatgtagactcagtaatgataatttggcactctaattttgaatgctgttctaagtcctagagcagtgaattatgtcttttctttcaaaagtgagatttactaggaaaagaacaagctttttttctgttagaagttcattatgctcaattttaggaaggcttaacaaaatgataaagagttttcctaaagtaatatttctgacatagctgttctgtcataaatttttggcctatttaattctctacaaaaatgtaaaattgtgttttcaattatttttcctgatcaactttgttacattaatacaacgaactgccttttctggaagaaaatttcaatttataacgatattataggatgtaaaatttcacataagatggttgactgtcttcaaatcgttgcagctgtcttctagtaagcaagtgtattacttgtcaagggttgcatgtacaattcagtgcccatggacatatctaactgattgggttatactttagaaatccttttagttttgaagttttgttctttcatagtaagtgaaagtaactacccgatattaatggtatatatgaaagagttaaacatttactttggtggtagtatagtgtgataactcactctctgatcgatttaaatggatttaaaactgcatctggcctggttcattttgggtgatcagaatattttactctataaacaagaatgcatttgagtaagtaatgtgtagacatgggcctctatcgcatgttttcaactccctgaagtccactataacagttcattttactcattgtgtttgttctcttcatcttcctttctattttctccatcctttaagtgccccaggaaagtacccatcaagctgtgacttgaaagtttcaaggaattattatttcaactgctcttctaaaggttggcttcacttccaaatctccccacttaaagttttcttttttcttctttctgtctgtcatttacaaaataagttggttttttagatgtcgcattttaaattttgaaatgtgtaactaatgagactattttccttatctcctttctttaaccctcctttatatactgtccttatgggctagtgtcatcattaattagttaatgtttgtagaatttgtgagcaagaattagtgataatagggaaagtagggaatatttgggttgctggttggaggaggaatactaatgaatgttaatcctgaatgctcacatagtgccttttgtcttcaatatagttgaacgaggcactaattaattgtcatcctacaggattattattaaaacagtacagtcagtgttcaagtgtgcctggagcaaatacagaagtttagtcactgtataggctaagctgaagatgcatgtgttttctgtgcagtgggaatgactaataccaaatcattaacagaaggatttggctaagaaaacaggtgcaacggtgaaagttttgatggtggacaaaaagcatttgactatttgtttttttgagagtttcaggcaaaagctttgcctatagtaaagtttaccgtatgttttctagtaatttttaagaaacatctctacaagtaagcattcaaaagaatgatatgtggtatctacaaggtaggccagatcctggtgacatatctcagatttgtctttgttgttgtcttctggtctccctataagggaagcagagataagggaaagctgaacagcccttgatgctctccacttcttattttggtggtttcaagtctttcactgcccctgtcattcagaaagagcttactctggggcttcttgagggtccagactcatacttaacaccctgattaacagcccaattgtgttttgattcatggctagagtgtttactatcatctctcctaaagagccattggtcagtaaacatgggaataaaaagtgctgcttcttgtccatgaatcatctcattttccccaccacattctttatattgttcactagattctatgaaaaactaatgcagaggaaatgaaaatgaaaattattcaggaaagagcaactaaggagggaaggaggaggcaatgccttagtgcctttgtgtgtgtatgtgtgtgtgtgttcaaagcataacccttccctaaataatgcatttgctgctaattcaatagcatatttcacacttgagaagagcctcctcagcagcacttgatgccagccctagtgctcttaaaagcaggccttctttaatgtatgtttgatgagtgtattgttcactgagagatgaacaaataatgatttggaattctctgtgtcactagacattatgtagagctttagtcatgggcaattagtaagcattaaccctcctggtgatttacactgtatttcttagattcagaatggtcattttctggaaaaacaaaagtatattccaacagggcatgtctttggctagacagaaggttctgcctgactttgaggggtaggaggtgggattcctaaagacagcggtacaatgatacatggacttatcaggcaaaaaaatatggtgtcagctcattattaatatttccctgaactctagagacatcatttatcatgtattaaggagggaaatgattatgttcataatgtagagctttaatgaattgaaaatgtacagacatcattgagcaactcttccttccataggtcaggctgactatgcttttactgaagagaatgggttagtaccatggagaacagtcattcttcttagatggcgagcatctgacactcaacttgaaagataacataagagtaaaatgatgtacgctgactgtgtgccttcctcctgctgcatagtgaacacttctgtaacgttaaacatgttgagtttatattgcataactgaagttggtaaagaaagaaatctttccaaggacacacacagtaaacctgtatgcagaaatacgaagaaaagagtgactagcccttatccctatattggtaaaaatgggcagatttctactttgcagcccgaagttaagaatggagttttcttttttgttttcttttttttttttaaattatactttaagttttagggtacatgtgcacattgtgcaggttagttacatatgtatacatgtgcgatgctggtgcgctgcacccactaactcgtcatctagcattaggtatatctcccaatgctatccctcccccctccccccacccgacaacagtccccagagtgtgatattccccttcctgtgtccatgtgatctcattgttcaattcccacctatgagtgagaatatgcggtgtttggttttttgttcttgtgacagtttactgagaatgatgatttccaatttcatccatgtccctacaaaggacatgagctcatcattttttatggctgcatagtattccatggtgtatatgtgccacattttcttaatccagtctatcattgttggacatttcggttggttccaagtctttgctattgtgaataatgccacaataaacatatgtgtgcatgtgtctttatagcagcatgatttatagtcctttgggtatatacccagtaatgggatggctgggtcaaatggtatttctagttctagatccctgaggaatcgccacactgtcttccacaatggttaaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcgttttttcatgtgttttttggctgcataaatgtcttcttttgagaagtgtctgttcatgtccttcgcccactttttgatggggttgtttgtatacaccaacaacagacaaacagagagccgaatcgtgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgcttatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcctgcatcgcgaagtcaatcctaagccaaaagaacaaagctggaggcatcacactacctgacttcaaactatactacaaggctacagtaaccaaaacagcatagtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagttggattgaagacttaaatgttagacctaaaaccataaaaaccagagaagaaaacctaggcattaccattcaggacataggcatggtcaaggacttcatgtctaaaacaccaaaagcaatggcaacaaaagccaaaattgacaaatgggatctaattaaactaaagagcttctgcacggcaaaagaaactaccatcagagtgaacaggcaacctacaaaatgggagaaaattttcgcaacctactcatctgacaaagggctaatatccagaatctacaatgaactcaaacaaatttacaagaaaaagaatggagttttcagagtaggcctactaagcctatgacagcattattgcttaattcggactctggataatgggctccagattcttacatagtccaggaatgatcctctgcaatctctgtgcccttctgattaaaataaatgttcaaagatgataaagggctagctaatccttttacttcttactgtctctctgttacaacttgtatgtttgtaaattttatatggaatcttgtaaaattaaaacaaaacaaatgttttacagtttgggaggtaccctagaggttgattcctcaaagctccagagactgttaatgatagttacccagtgtagcaatctatgtaggtagattcagtatgatataagacagtctgaactaatgattatttgttttccttttaataaacccatgtgtgagtctgtatgtatctgtgtggttgcattctctgccaggtttgttttgtattttcaaatgaatatttttgttgagattcacaccggtgcttaaaaatcaccatgttgttttgtctctgacttctcctactagattggtgagtttgattactgtagtcttttctaaatagcactctccataatcttttcctgtggaaacatttggtggcacaattgtcactcctgcagctaggtgttgattattaacaaccacttatttttgctccatgattgctgtcatgtaaattcccaggaagtggggtcagccagtcctgagtctatcctacagtcagtgatgcttatgggcaaatgtcaagagaaactttgtaccttagcgttgaaggtgaagagcactcctgaggtaaatatgagatagttttactagaaacagtaaaacaaaagatgaaagatatgttgagtaatataaacctaataagagatgaatgtgcatttgatatattttcggttgtccaggtccaaaagaggtcttggtcttcaagacccaactcaaaataaattaataacctggtcatactccaattacttccttgatattgattatctgaatatctccaaacattcacgcccttatataagggcctcttaaaattattctttaattgtttcaactttttatgttctatttcaattagattgaaaaaaaagccaactctttgggatagaaactccttttcttctggtgttcttgcatcttcttccatctatctacacaatgcatcttcaatatgaagcttgttgaagaaatgaatgaatgaatggttaggttggaaagcagagatttcaaagtgttctctaaaatcataatacatttatagaaaagtacattctctatttctaagctagcagttttttctgtgtacagcttccctctccaaatattttgtaccaaaatacccatggcctacatttctgtggaggccatatatggaaagcaatgagataatcaaaaaattcctttagttattttgcctcttgccttactccatccaatactagcctgttgattttcattctcttagtttaattggttaatgtggttaagacttaagtataactgactcaggcaaactttgtatctacttataaatctgctgtttttatgagaaaataaatgacaataagtcttctgtcttacagaaatatattattcatccaataagcctatgaaaagtccaaaaacttcttgggacttactatcaatcacatatccaaatgccatatatgatattctaaaataatatactagtatgagactagtttagaaggtctagctgtcaaaatccagatttttttaagaactgaaatgagattagattcaacaccagttttttatataaaatgtagttagaagacattttaatttttttaagcttttttcatggaggaaagtctttttaaaaatttttattaaattttcttaaagaatatctacaatgacaaatgctgaattcaggatgcatgaagaattatgaactgaaattatacattttgaatttcattttagaaatatgagataagtttttatcagcccctgttggcaaagacaattcctgatgtggaccataaaacaactcaggcctacaaattaatttataagtaattacaccccaggtttttagatatttagttcatatgcaaaagttgactgcacattaatgcagtttggatgtatagtttgttattttatattcctctgaagcatcaagcatctatagctccagaaaactctggatttattaagcatatggtactggaaaaaatataatttcataccctaagcattttcagcttaactcatcattgtattaactattagattttctttcatttctcaaattgttgtgcattttgtgatagatttgtaaactatctgtaaggaatcttttcactggaaacttctgagttctctttaaagggcagacaaaatgatttgtgggagtttggggagtgctatttgtttttattaggttgaactacaaggctcatgtcatccttatgaggtagatccaaaagcagctcacttttgttcattaaggtcaaatgaatgtcttgggatatacccctacagacaatcctgagttctcatcagcacaaagcacttcttgttacagagagaaatgttttgattcattatttcaggaaaggatgccaaggaaaaaaagcagctgacttacaacagcagttcgtacatttcctggactgttgggatgtatcatgtattccatttacattgcacctgcctcaggcacaggatatcactacgtaagagcaaacatattggcaagtaacaatatggtgtatgtggttgtaggtaaggatgctatccaaaggcaactgattctgttgtgattcagagtagactgcagacaatgctcatcagccacaattcatcataataacttgtgtgtatctaaactcttatacattggtagagtgtcatattgaaccatatgaaattgctgatattcaactgttttttcttagcttataaaactggaattttatgtagtttaatctaatactttcacatttattattccccttcgaaaggctacctgccatgcttgaaagcacactggatttagagccagcggcctgggtccatgtcccaacttacatgccacttgcttgctgggtgacctttacaaatccattagagattgaacagtgacatgtgggaacaaagaaaaatctaattcatgagctatttatcagttttttgactaacagtttctggatagagagccttcttcacaggggtgatatgaagttgcagtaccataatgtattcaaaaaggctaacaattcaaaggtgaataattattaatgtcatgactggtcatcaagaggagattgtcaggtaggaagggcaagtatcattatccttattttgcagttggagaaactgaaagtaataaaggtggctgaggtgactcagcaggtcaacaatagaatctaagacgtgtcactgttgctcttttaagggcaccctctggtggttctctcagtgtcaagtgagtgtgaacactgctctaactgaccacagcagcatcaccaggacatccccaccagtgaaaatgcctgtctctgtaatgccacatcagtgttttgcaaagtcatgaaaatgtaggatacctgacaatgagttcttccaaaatctttgtttttccccttcaaaaacggtattaggctggatgctgtgactcatgcctgtcatcccagcactttgggaggctgaggcaggaggattgcatgagcctagaagtttgagaccactctgggcaacaaaataatatcccatctctctgaataaatatatcaataaaatatgagttggacatggcagcacacatctatagcaccagctactttggaggcggaggcaacaagaggccttgagcccaggagtttgaggtcacagtgaactatgattgtgccactgcattccagcttgggttatagagaaatacctcatttgtaaggcaaaacaaaacaacaacaacaactgtatgaaaagttttggtgtttttgttccccccatataaggaaagccttcacattgcaaccgtgagaggcaccatgtagggtggttgctgtcattcctattatatgactgagaaaacaggcccagtgaaatctgaaatacctggtcggagatgtggcaggtagggatgaacagctgtgaagaaagctagttccttccagtttgaaagcctgtacttctactgctaaaatgctctgttcattcaccttgggcctgaagcagctcacaacactagttaattggtttgggcaatcataatacccatgcatgaaacaaaacattattcagtggtaacatatgaagcatatgggtaagattaaaactgaattcagtgagatccagaatacaatattggatgatagagcaaatactcccttggagaaggaatacagtgactttttatagacaacttttagaaaaatctcagtacagtattaatctgagtctacttaaagcacctgacaactatttacattgtaatatgactggttccaggatattttttacttgggtaaagtaagccataaagaaagccagtttacttcggaattcatatataacattccaccttgaccacccaccactctactttttatcactttccctttttattcttagcggtaaacttcctgtgtaagatcttgaagttactacggtttgcatgcaacattcaaggatttcatatgcggactgctttaaggcagctccctcagatctcttcaggatgacttcccagttagtttcaatttctctccctgccttcacactgtgaaagagcatggcatctctcgggaagtctctgtaatgctaccccttcttcagctcttagttactggtcctgggtgaagatgacttgttccatttttgacccagatacaggctgttggaccctgcatggaaaactaaagcaagctatgccgaaactgtcattatctgaggcaaccagtgctctctggacccaaaagtaaagccttgactaactttgcttttctgttaatgagaaaattctcccagttacctggacattttctttctcctaagatttcatctagggtagggtctgtcttctggcctgtggctacctacttctggctataagtaactactaggaactttcctcctttcattcattcatcatgaatagtgaagtacttaagattgtggatccagtgtcagactgcctagttttgaatccaggttcttccacatattagtcaaatggctttaggcaattttctgggcacaaatgtctctgtctgccaaacggagataagatcctacctacctgatacaaatatcacgagacgaaatagatcgatagattaaaaatgcttaaaatattgggcttacctgtccccaacctcattgtcaagccacaagcaattcatcacttatgctgtgtccgtaacaaaccccaaatattccatgcatctcagcccacgttcaaagtgcctcattagcttggaattccctcttgccacccccacttattaaaattttatccacatttcaagattctattcaaatcccacatcttccttaaagaacttccaccttgtgcacacctaactcttttaccattaatataatagcacttatactgcaatgtataatgacatttatattaccaaaatgagtatacaaatgtatatcattacacttaaaggcacctcaataagtttttacacatatgtgagtgtatgtgtctgtgtgtttgtaaaggcatgtatacacatgtatgtatgtattatgtacctgtatatctgtctgtataccaattgatttgacagtcattccttacatgactatcatggttaatgtaccctgttacacggaggatatgaggtaaataagacatattttctgcctatgaagatttaatattatggaaggaagattttttaaaaagcaatatatactatactatactgtaaaactgacttggatgatatacaagaaatatctaacatatacacacatatatacatatttatataggcatgtatttataaatgtacaactaaaatttgatgaaacatcaaatttctaagataatttccaaaagctaattttatttcagaactgataactgtgatcagtattaagtaaaaaattattattgtatttctacatattctaattgaaccaaggcttgtgccccaagattgttcagacttgcatacttcaatggttctaactttaaatttagaactttctcattctgatggcatctccagatttctgcttctaagtttttcacatacctttgatagactttgttgactaaaaatgttctttgtaacctttgccatgtgtttctgcagcagaatcttttttattcttttgcattttacagataataacttcttgtctcttggtctgggaacaatgtggaataaaaattgtaacaaataattttagaagaccggattcatccagatttaactgaataggattgttactatgcatttatacactgacaattcaatcgattaagcttacttttgataaactctataggttgactttagattgcattatttgacatttattatctccattgtcttcagtaggccttagcaaggaagttgagtttgtttagaggcttatatgtttttttttcctgaaagatcattgctttggtttctctgttttaaaataatatatccacattacccagatgattagtaagaaaattggacagagtacatagaagtgtttgttaaatagcttactctaaaaattatgcaaacctcatagcttttaagatgttttttaaaagcctaactatactagatagaaaaagaaaacagctaacaattatttcagtgcaaactgaatctttttctgtagctatgtctagatgattcatatattagtaaaaatagcatgtataatatgatcatgtttcatatagttacttttgcatctatctaatctttctatctttctatgtatctgtcatctatataacctctcttctgactataaatatgtagagataaatatttgaaattattttcacaaaatgataaaagttatttattggtggttgaatatagagcaattatttttaaccctattaacatatgttctgatagttattattttatatataataaacatgttacatatttttattatgtattctaagaaaattagtacctttatctctatgaggtttttaatccttttcaaaggggaaaaacaagcatacttctttataacatgttagtatcgaagacagacacacttttgggcttgagcataagggagcatctagttttgatgagactctgagagaaatgtttgtgagtttcggtgtcttttctctttagaaaaatactcctttacataataattatgtacaaagcactgggtacttatgcatatgcatatatactgtttgctaggaagatgctctgcaaatagaatgatttgtcattacgtacacgtgtgtatctatgcttaaaaatagctatttgtgtttatcacacacctttcatctcttagatgcatgaggatattcacagtatctttgattttaagtcctttcctttgccttgaaatggagttgaaatgactatttatttatttattgagatggagtttagctcttgttgtccaggctggagtgcagtggtgcaatctcagctcactgcaacctccacctcctgggttcaagtgattctcctgcctcagccccccaagtagctgggaatacaggtgcccgccaccatgcctggctaattatttttgtatttttagtagagacagtgtttcaccatgttggccaggctggtcttgaactcctgacctcaggtgatccacccacctcagcctcccaaagtgctgggattacaggcatgaggaaatgagactttaatatgaattctcttttccatgactcaatgctttatcttgcttttagccccttctgctccccatctgattgactttctattagtaaacatagaactgtctctgcattccaagccctcaaatggccaaagtagatggaccagctccctttctcttttataattccagctggattctcccccttgttatcgttagtgggagaacagagatgtgcattaactgcatagacagctgtggaaaacaagaagaagcccagtccccatgacatctccaataaagccatgagactcatgcaaggtggagaatatttgtatgttgtggtcataggaacctgaatgacttatgagcagttggggaattctgtattcatttttattaactttaattataggagcactataaaattttctcattctgtgttgcgtgaaaaatgcagtagttaattgctcctgacatttaattggtttatgcttccctctaacacaatcttgtactgcaagagacagggaaaactagttggcatatttctgcaattgcagagtattacacaccaagaaattagtctttttgttagttctagcagtgaattacaaatgcagtttcagaagtgtaggtagagaaataaaatctgtgcgtctacattctacatatgctaaaagactgacatgggcttccctgaatgctttgtatgactttgccagaatggctgagattttttcattatcattgtacagatttaaaaatgacattttttatacccttgtgaacatgtcaggttgtttaccatttctgttacaagccatctggacccttcataaccttttcatatattttttcaaatatcatctggcataaaaagcataaggtaaccttgctgttaccaattataatacatgatggaagaagttggatttagtgcggcatagtgcctctgatttcaagagtggcgagacactctggaaagcatccatctcctgtgatatgttctaagcctgaagggagaaaatgatacatgaagtacaaaaagccaatgctaattgccatttgacacaattatggactaacggtgcatataccaacagcaaggcactgtgtaaacattatgggatgtgccatgatgaaggtggcaggcaccttgccctcaaggagtttgtaatctagaggagggaggaggccttacatggtaactaaatgcaaggctggaaagtgcataaggctgagagagcacagagggagagaattgcgagagtatggagaggtgattagggaggctgtacggtgctgccatattataaaaatagaagtgaactggcagtggggaacagctttttgaaacgtgaagcctgtttatcatttttattgcgtctatttgattcttctctcttttcttctttattaatcttgctagtggtctatcaattttgttgatcctttcaaaaaaccagctcctggattcattaatttttgaaggattttttgtgtctctatttccttcagttctactctgattttagttatttcttgccgtctgctagcttttgaatatgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcattttgttatgtactcaatagtcattcaggagcaggttgttcagtttccatgtagttgagcagttttgagtgagtttcttaatcctgagttctagtttgattgcactgtggtctgagagacaatttgttttattttctgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtgttcttgttaactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttagcattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacttgagatgggtttcctgaatacagcacacgatgggtcttgactctttatccaatttgccagtctgtgtcttttaattggagcatttagtccatttacatttaaagtgaatattgttatgtgtgaatttgatcctgtcattatgatgttagctggttattttgctcgttagttgatgcagtttcttcctagcctcgatggtctttacaatttggcatgattttgcagtggctggtaccggttgttcctctccatatttagtgcttccttcaggagcttttttagggcaggcctggtggtgacaaaatctctcaacatttgcttatctgtaaagtattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttcccttgtgggtaacccgacctttctctctggctgcccttaacgttttttccttcatttcaactttggtgaatcagacaattatgtgtcttggagttgctcttctcgaggagtatctttgtggcattctctgtatttcctgaatctgaatgttggcctgccttgctagattggggaagttctcctggataatatcctggagagtgttttctaacttggttccattctccccgtcactttcaggtgcaccaatcagacatagatttggtcttttcacatagtcccatatttcttggaggccttgtttgtttctttttattcttttgtctctaaacttcccttctcgctttatttcattcatttcatcttccatcactgataccctttcttccagttgattgcatcggctcctgaggcttctgcattcttcaggtagttctcgagccttggctttcagctccatcagctcctttaagcacttctctgtattggttattctagttatacattcgtctaaatttttttcaaagtttttaacttctttgcctttggtttgaatttcctcctgtagctcggagtagtttgatcgtctgaagccttcttctctcaactcatcaaagtcattctccgtccagctttgttccgttgctggtgaggaactgcgttcctttgcgagaagaagcagcaggaccatagcgcagctctgtccgcatcatctgtcattaattcttcgctttcaaattttataggaccccggaaaattgattgaggaagatctaaaagaaaacaatggtcaaattttgttctttagttcacttgctccaggtcctgaaaattatttaaaaccaacagatcgtcaaaggctaagaacacttactggagctattttttaattcattaaagacttcaaaagctagaaatcacaattctgcaaggttaaggaaaaagagaaatcttaatttcctctgccattagttttttaataaatccaaaaatacccctggtgtatcttgagaatgtagctcttctccatttttacctagtaaaagccatgtaatctcatacatgaaatgaatagataaactaataaacatgaaaatggcctctgtaggcagacaaggtagagatcattatactagtgcaagcagtgtttttgaggctggagcaggcagggtggcttttccctcagaagttacgtacgtccaaaaggtttgcaatggccaactcaaacgaaagtaaagttatggccaactatctgggaaggcatttccaaatggctcaaagatgccagaagcaggaggcaggcccaggttttggttaggggagatggggacagaaggttgagtcaaagaccaaggtggttttcatcctatacagtcacaagcagtgggtccaacacattcacaggtgcaacctctcccccagattctcccctgagttcagagatacccaatagatccttggagctgctggcgcatgtcataagctccaatacaaaatatcctaggatgacgacaatgttgtatgtagtaatcctgttattatctagtgaaaaacagtatccgagatcctttttctttttctttctttctttctttcttttttttttttttttttttgagatggagtctcaccctgttacccaggctggagtatagtgacgcgatctcggatcactgcaacctctgcctcctaggttcaagtgattctcctgcctcagcctccccagtagctgggattacaggtgcacgccaccaggccaggctaatttttgtatttttagtagagacggggtttcaccatgttggccaggctggtctcaaattcctgacctcgtgatccaccctcttcagttccccaaagtgctgggattacaggcgtgagccccggcgcccagtggattcttctttgtgctgcttttgctgatcactcgccagtcacatgcatagagacaatgctatttaccatcatgttcaggatgcagcacagggtgttggagagtccagtgcatttaggagcttgtagcttcagctctgcccacttgaaattcatggggctgattatcttggcctgcaagatattcagaaagcagctactggcaatgcacatacctctgcccactctgtgaacatagaaaacaagttttcatccagtgtcactgaggaaatatttcaacttcaaagcagccattgtctgtaggacttgattagagagtacgaccaaggaattggctacagtcatgtgtttgagaatcaaatctgtggatcttaatgtgcacctggtgaaataaaggaaactataacgttaaagaagaaagacatttcctaggaattcaactataatctgagataagaagatcattccttttgccaaataccccagggcatttgtcattttttcagtgacttttatttccatttagagtgagaggatcctgcatagaaacatgaagtctgctttaatgtggaacctgaaattcacttgtccacttattgttatttccacctccttaatttcttattaaaacccattttttcttcctctgaatgtttgctataaaaataaatacatatatgggaattatattagtttcataagaacatatacataccatatcagagttttatatataacaatcccataagtaacaataatttcataaagtaagcactttgttattcccattttacaggtgaggagagcttaggtaaaggaagactgagtgacttttctaatgtcccctccttggaagaggcagagccaggagttgacaatgtatttaaccattgtgtgtttcaacctctgacaaagttgtatttttccaaatgtccacattatttttcggttttgcatatcctgtacatttttaaataatggttgtgcatttagaaaaaaacaaggcaccaagatggggatgttgcatagattggggaatcggttctcaaggaaagagagtcaagaggaatagagcaaggctcagagctggcacacaattgaagaaactcaatctctagacccaaggaaagccctgtgatgttgctgttctggaatgcccagactgtgcttaccaggatgtagtggctccttagaggcacagtgccaggcaagccatgtgatcttgatctaaccagttgaggatctaggggagcatttcttaaagtatggtccacagtctcctacaccagaataccacaatgagtgttaaaaatgcccatctccagacctgactgcacaccttggaatggattttggggcaccttcctgggggtgactcttaatgataccaaagtttgagaagctctcatttaggtcatcagaagaaatgaacacgtgaaatcaatgacccagacaaggccagaaattttacatgggaaatcatggggccagatagtaacaatagtaattgaggagaaataaagataaatttgagctaagaggttaaagcaggtcttgaaagatgtgaggaattttactcagtgaagaggtgggaacattcttggtgggagaaagggcctcaaatgaaaacccttggaggaagtcagcctggcatcatggaaaaggccttgagctaaaattaggtttaatgaggattgggtttagaggagagtgttagcatctggtgtgggcagaataaatgtgatggtaatgtttaaaagtgattcaggatttaaggacttattcagatcaattcactttcagtgctacaggattgcaagcccagaattcagtgaattcaggaccttggtattattacttttgctaagtcatattttcaccttatcgaataatgattctcttcagtgcaacagatacacatctaacattagtgctatatgaaataagggggaaacatagaaaagttattgaactgtacagttcctgtgccttgaatttcatgttcttatgagcccctgtaactttttaatttaaatgctaatgcaaatagcccataaaagagacaagaagagaaagtgcacatgcctctcagaaatcatgtagacaggtagaccaggtgtctgatgcgcaatcaagatatgaagggctgatggtgggtggctgccattagaggtgtcagggataacgatggcaggtccgatgacattcctagtaacagctgcatatggctaactatgaggagtggcccttgcagtgcccttcctttagaagtcccttattcaaatgtgagaacagcagagattcccagactccaagggctgaaagtcccttttgtttaatccctgtcccaatcccagccttgctgctgctgccccagccctgcctcaggctcttgagggatggtgtcttttcagcacaaaacgccacatctgctgcactttcttgaagctcacttccacggagcatagggaatcaggtgatcttggcacttgagccttcactgaatttgctttgaaaagttaccaagtggttctggcatgagaagcattcttgattaattccccaggttggtggtctcttgtatttgccaagaaccagagagagagaccaacagaatggtaaatgttttttgttgttgttgttatttgtttggtttgttttgttttagtgatccttgtagtatgtctttctttagcacttaccggcccaatggcccctgcactccttatcctgcctttatgcaaacttctaactgtccaaagcctcaatagtgaccccatgagaccctatcatttctagtagagccatgcgtttcagacctttctgaagtatcttcttctcatcatgttttaataatgttttcctaacacagaatgttttcctttaaagaaaactggaaaacagagaaaaatgagaaaatatttgccaacatgtagataaaatatttattgctttaatcttaatttttttaagcttaaaaggaagggattaacaaaaagaaaagtgagtgaatgcgtgaataaatgaatggacacaaatgacaaataaatgtttgatttcatctgcttaaggcctgctaagtgattgattggcaaatcttagagaacaattcacatccagatgtttatagctaaaaatatcctaatatattttctctgagagatacaaaaagaattctgagacttgtgataatatttgcatgtcagtggagctcttagtccccttaacatcacatcaggattgtccactctgttttattggcttaaatgtccagaacatggcccagagaagagcctgtgacatttatcttctgtattcaatcccacttcatctgcaagatcatagttgggaagactgtaggttgccccagagtaaggaaggatatacaaactacaatgaatgtgcctagtaatatttctcacattcattccaggatatacaaactacaatgaatgtgcctagtaatatttctcacattcattccaggatgacacaaaaaggttcattaccagatgtgcaatgcaaagacaagtgctttgtgaaggtggaagagaatagctaggagtcatgtagaagaaaggaagcggcaatggggtgggttaagaattagagcaacatagatatcctataaaatggaatatgtgaagaaggtataagtgaacccaaagaagggtgcaaagatacaagaatgaggaaggttggtcaacagccacttttctggactagtctgtcttccagtgcttctctttgccactgtttggagggcttgtgcaggtggtggcaggaccttcaatttgcagacctgtgttaggtaggacagaattggattagccacttagtgacattaatttattgaacaaagtgagtcagaaaattgaaagttcatcttaatcctttaacctcctttcctgggacacctggattcattcacctatttcattaaagcataagtgtatggtacttacatgtgtcatgctctgtattaaagcctatgggaaaagcaaggataaatgttgctcttctgcctgtaggtggctaacaatcctcattgaaaaaggcagaaatgcccaagaaacctatgcagggcactatcggctgtatacacaagtgcagaaaaacaatgatagagaagccctgcagaggtagagatatcttcaaactgggggatctgcaaagtcgtcagagtggtggggttgaagccttgactctggcagatgggaaggaattctgactgggtctgaccattggaccatgaaatgtctgaaacacctgcttcctatcctcgggaggtgactaactcagctcaaggcctcttgactacacaggctttcaaacctccagcagatgaacacagaagatgaagtggctgagatgaagcctgcttttctcctgtcagaaaaaaaaaaaaagtttccattctgtcagtaggcagagagggaatgagagagcaaattctagtcaaaaaatgacaattggtttctgtttacacatatgtgctgagggttgttttcaaatcaaacttctgtaatctatcctcagctgttgtggtttatggcattgatgagtaagagcttcttttggaaggaaaagaaatataatgcacaggagggatcttgaaatgtattttgggacagaaccacatttcctgaacatgtttaaagtgtgaccttttctaatctttaaaagtaagataactttttgaagattaatatgttatgagtataaaataaccctctggtaatgctgtgtgtgaatggcaggaatatttttttccaagaccctttcgcttccgttccgataatgtctctaggaccaagaatggtttcttgttcatcctttctaccaaaagtccaggatatggctcagagggtggtgcaagttcagtagattcttgttctgggctcctttgtggatgttgatgaacttctatgtgtatgaaaattggtttgcttattttatcagtcttctaattggatttgcattgcattggatctcactcaacaaatttgctttaaaactgaatattatattaaaacctaccatgtattaggcactcactgtgtatcaggtagtatgctaagtattgtactgcttaatttccacaatcaccgttcgtgctgggagctattagtaccagtttccagatgatgcatttgtctgttccccagagcagggatcagaaccagcacctttctaactctaaagttcaagctcacaaccagtaagccatattgcctcacgtactccttctcaaccatatcccttcttccctaagggacaaagttcgtaggggaagcacaagtgctagagaggaaaagccatgggtattttagatatatttagtgcttttatcaaataagtagggcatggtttttctcccaatatttcctgagttaaattatagatgttttgagccacatagagcgatgttagtggtagagctaaatcaggctttggcttctaatccagccctccaactaggcaacaggatctgcctagatcctaattaagaaagtgccacattttttctaaattgtgcaaagcccttattgagttacctctgccagttcacaatgggagaactgatggttggggaaattggaagtcctgatacagattatctgcatggggttcagacgatgccagtcagtgggtaacttccttctacgtatcaaacccaagattattgccaaagtatcttatttatgttatatttctttctatttttttccattcattttttattatctctcctgatttccttttcttttttattttctttttatttgtttaatttcatgggggtacaagtataattttgttacatgcatagatggcatactggtcaaatcagggctttagggtatacattgcctgaataatgtacattgtacccattaagtaatttctaatcatccatttttttcctaccatttgatggatagtgctgataagtttagatatttcctgtattagaaagttaataggctccactagcttaggcataacatttataagctatgttacaaaataatacactggcaaaactcatgtagttctgatgttacttgtcaattttctcctaaggaggtattaatgaaacacatagttgggtgtggctaaactggtgtccctcttctctttctgcttctgtcatcctcagatagatccctgagtgtcacggggctctaagtctcatgatgatccatgtctccttgcgttagactggttccctacctaaaccagagccattgctcaaattgcagagtttcagttggtgtctgaggtgatttcaaggttggtgctaccatgcaaagatggctggctacaagtatgccatgtgctatcagcacgttctatgtcccactacacatgcatttatacactgggaacgttatgactatactgcacagccagtagaaaattggcaacctccattgccaatatctgtaaaaatgcttgcttgtgactacagtcagcagggtttcgtaggccttcctgaagttgaataagaaaagaaaagtaaaacattttgggacttggaggattcttcccaccctcattcattgggatcccaggaaaaaaagcaaagtgtttggaggcaaactgagtttaaattccagctccactcatagaaattatgtgactttggcttgtggtgtattaagttctcatacataataggaagacaatacctacctcccatggttgttgaaagaatttaatgagtgtttattgcctatgcacatacattacagtcaataaatataatattctctgtcatctttgtggttttctaattcctgatatcaagtgttaccctaaacattaggctcaagatctcactgttgttatctcagtgaggttcttcaactcacacagaagcacatagcaatttctatttctaaggctcaccttagagatcatctaggattagatttgagtttatgactaaaatgttgtagttttgaaacagctttcaacaagcagcctgtaccagcctgatcaaagcacttgtgccttatgatggtggtgaaaagctgtgtcctccaccctatcatctccacggcaatgagaacataatgaaggtggctgattgtgcatgaatcattccttactaaagtcagctgtagtgccagaatttttttttttttttttggcatcgcttactccaacttgacagcttgagctaaagctctaccccatttgacatctttgagaatcttccttttccctttgtaaacttaaacatacgtggtcgtggtgtaaggacccagtgggcacaagagttatatctagaaaactgtgtgatgaccagttttatctacactgaaaaagagtctatgttttcccagaaataaacccccaaagaaagtggacagatttgcaaacaaatcaataatcaccccagcaaccaccgacaaaaacctacaaggcaaatatctgtttaataggcctgatattgcctaacatacactgatagttctgagaagagaattaattctgtttgatctgctttagttagtctttgtagaggataccttgttgccagcatgtaaataggtgaggatttacaaacagcttggtcattgtgcaattttatattactttttcaaatggcatgtggaatgtggcattattttttgttatcagagaaattgaatttgaagattagtaactatctgtgattataataacaaaaaatccattttggttaaaaataataataacgattcattgaatacttacaaggtttcaagcactattcttaattcttggtatactttatctcccaaatcctgacaatagttctatgacgtaggtgctgtttttaatttgcatttttatagagacaaaaactgaggtttaaaagttatataacatgttcaagatcatagaacaacttaatggtgaagtaagtactgtaatccagatccaatctccaagtctacattcttagccctttcactaagtacttactactggaagggaaattagagatgaactaatatcacctgctcattgtcatgaagataaaactgaagtccaaagagctgaagtgatttgtccaaagtcacatagctacctagtgccaaatccagaattagaactgagatctgctaatgttcgttaagatcaatatatccctttcccctgcactacatccagggttatttctctctgttaactctatgatcactttttgagaattttttttaaaatcttttaagaaggaaggaagagaaggaaaaaggaggatatggaaggaaggaaagagaaaaaagaaagttgaaattcagatttggatcagttatacccaacaagatgtcaggtttgcacagtggagggtctgagtctgagcctcatgacaaagcagagggtgtgcgactgcagatattgaagacaaatatactcccaatctaaaggatcatctgtttttaggatgattcctcttgtaaggaaagatgttggcacttgtcagccagtacctataaggccccctgaaggtgattttcttactcccatcatgataaattcactctgtttcaatcagggtgtgcagggtccaaggccaagttcttttcctcttttcaaagttcagtgccttcttcctcatagaaatcagagaatgaggtaaactaactttcttttcttcctttcttccttccttccttcctttcttccttccttccttccttccttccttccttccttccttccttccttccttccttccttggcacatcttttgaaacactcaaagtattatctcacgcagctgatctggagccaaaaggcaagcactccaccaaagtagctcttgttcaacaaagtcacgtctctaggaccaaattgtcttggcttcgtggctcatgtgtttattccccttggcctggcattttgaatgctactgtccttatcaatctctttaaaaaatcttcttgcatttctgttttatcttctctctctgcagccccttctttctcccttagttctacttccactaaaattgcctctctacatgcatattgatcagctttctgatttctttccctgagaatattcattgctgtcctgcttaatgacaggttggtgagcagaattatgtttaattcaagccattttcaccaacctgttctttgactcttttacatgaagccttcagagagtgtgtctactccgttagtacaagaaaagtagaaagaaatgtctgcccttgtgtcataataagattaagtaaaaatgtaacaaatgtgtttgtcctaattaagaggatacaacatcatagaaaaaaaggtcttaggcagacctacaaggagatacatttgacttggagaagatttgtgttttaatatgtaccatcgaaacccaacaacaataacttgtacacctgcttttagagtttaatggataatttaatcaaatgtggttttaattgtaccatttactgatataaattattattgtcatcattagccatattgttaccaaactatttcaggatctaaacttggtactaggcattttgtgtgagacagagcaagccatggaaatttattataatttttaaaatctttatttcactgaaataaatcaccagacaaactaacaggaggcccttgctcttcaatcagcaggtatgttattaatccaactgtattttctctaacccctggaaacactggtgaaatgcaaagcatataattaacactgtggctagtaaagctattaatatatatataatagaagtaatagactgcctttaaaatacccagcggctgaacttctcatgttgcagaacagaaaaatatgcacgtggatgaatacttttatccaatcatttcctgccatccccaactcctaccctctctttcgcactttacttctgctatctaaacatccccttgcctttctaagatctacgtacagttatacaacacaaaagtgactaatttttactgatgtccataactgtctttgaggcccatttattgagtgtctgttaagtactaggtactgcgctaagcattttaagcacagtatctcatttagtctactcatcaacctatatattaggtgttactatcactaatttacaataaggaaactgaggctcaggcaagttgtataaattgcatcgaagtacacagctggtaggtgacaaagctgagattcacactgaggcatgtgtgagtgtctttctgctaatagacattacccttgaattttctgaaaaaaacaaaaacatctgctgctttttaggatgctaaagcactctttacgtttgatgttagagtgataagagcatattaatgacttttcaccatctaacttttttttgacttaatttatttggctgtgtgaacgttttctatgtaatcagatgaatttgtcatgggcccctttgattttatttgtttctgtatctgaaaaacaaatagcaacaaggcttctctcacctgtttcaatcaactaagcctaatctaaagcagaaaatggccatgttcttaaatctctcctttgagaatattgtcattccatcagaataacactcatccaaacaaagctccattataacaaatcttaatttctatccaactcaaagaaacattcctttattaccagtaacagtcatagatatgctgggaattctaaagtaattaaaacctggctcctccttttaagaagcttatagagaaggaaaagcagattttgctctaacaagtcaagaggtgggtaaggtattggggctacagagaaataatggcttttgagctggtcatgggaggatcaacaggatttgagaggtggataaggtataagaatatttaaagtaggagaaagatacaagctgtacagagcataaagcagattttagcagagaataaagtatatgcaaaatatttgtggaagagaagttgtactgaaaaggtgagctaggatcaaactgagcctgaagagcttttagagctcccaagagacacccaatctacattctcttggtagcagagagcctagggagggttttagacgtgaaagtaataagaatacatctcttagaaacataactctgacagtcaagtgaaaggcaaatgaaaatgaagggaaactgaagatggcagcttatcaggagggtgctgcaatggttcaggtaaatgaggatgtatttctggaccaaggcaacggtggtgagggagaaaaaaaaagatgtgaatgcaacatacttttacagtacaagaaaaaatgcattggttaattggatgtgaggtgtagggataaggaagagtcaagtgtgactcggaggttcttgcctaaggcagccaagtagcagatgattctgtttgctagggaagggaaagcttgggacagtgatgagcctggtagatgatgaatgtgctggggtgctttgggtttgtggtaggaatctatggaggatgatagtaaaaatactcattaattctcatttcttacatacatacaaatgacaaagaggagctgtgcaaaaccgctgtggaataagccagtttatgtttgtagtgtactagttatatggcatttccaatagggaatttcctattgaagtgaaacacagttgtttaggaagaaataaatgctgaaataatgcacatagtgaattcagggatggagaaaacactctcaaataatttttttaactaagaaaattccaggcagcacctaaaagcatgattgctttcactagacactttaaattactgtctataaaacttcttgatcctcttttaatgcccaaaccttttagaggaatttacaaactctttatttttggcttctcagaatgagtggtttaggttcaccccacaaaactggagggattagcccatcaaaagatggacacatatggaaaggtacttccacttgcccttaatacccttcacagtgatcctcaaagtgtggttcttggaccagcagtaccatcatcaccagagaacttgttagaaatgtaaatccttggacactcacccaaatatactgaatcaagaatgctggagttgggacccagcaagctgcacttttacaagtcctctaggtgatttggaggcttgctacatttgtgaatcactgctctagtcccggaggtaaagattgatgaaaaaaaataagaaaagcaataataataaagaaagaagagaacatttagaaaaaaaaagatcagcattcactttctctttgaataagtgaatgaacattccttgggggtgtaatagttaggctcctatccctttcaatacaacatatatttgtcgagaatccaattagtgccacggactgtgctaagtgtagcatattcaaaaggggaaaaattctgtggattttctgtgttctcaaaagaagaagaaaaaaatgaagaaaaagaaaaaagtattgttcgtcttaaaggtaaataatatgttgtgcttttgaagaattagatgggcttggctgtttatggttccaatgccagatgaaatgctcagtgaacacccctgcaacaagtacagtgaagggtcgtagctccactcagcctggccatgcatcctaaattccgaggccacaaatgttccagagacactagccttttttcacgaggcataatcaccacttatcaagtgtctcaccaataagcttcatgtaacagaaatgtcaagccccatttgattcatcttgcactgcccattctctctgaaggggatggctttcaggccctccatccatctcgcctgatgatcccttggagctcaactagagaaatcatccctcagactctgacacctttgaaacccaagagcatttcagtaaagcatcggaaatgtcagaactccctctgctgattcttcttcctcctattttatctctagcacacactttgctgcactgtttgccacttttatcttctttccctgatggcttttatatattttttggtcttgttcaagctttgaaatcactgctgctcctttttgtcgcccctcatcactagctccctgggtttcattgaccactgcttatctccaccgtgttgcacgtgtcttgttggttatttaataatgcatggctctcatgatcaggagtggagaggctcaggtctcaggtctggctactgaaactggaggtttttcctgctgacttgggtctcctttgatgtacgaggacatttgcagctcagcggcggattggtagcttctttgatgtgctcttcttattctgatttgatgtatgttatattccttttatgttcaagagggaccaaataaaggaatgtccctcctgcttctcacatctaatttttgcctaagcaccctctgttgctcttcgtgcaagggagtggttcttttgacagtgtataatataattttattaaagaaaaacaaataatatcagacaggatgaatgtcatcatttatgaggtcttaggcagctctttatctctctcctttgcttcatgttgcatttgcataaatggttctttaattcaaggagaattggctgcggataaatacaagtcaaacttgaaaggagtttaatacttgataatcacttatggacattgcgattaaatacactatcactcttttatgtttaagctacatagcctaaactgagtactacgagtggatttatcttgaagcctgcagtgtgcaggagtgccgcctgagctcacctgtggcttatactggcccagatattgccttctctggagagttgatagagggaaattggcaaacggtaattctgtcctgtgcttccatctttcagtttccctctgcactctaacatctggcctttcatggggacataagcaaataaataaaacaacaaagaatctgaagagtgtcacaaatttatttattttttactaatctttattagaacatcaaatgagattattcttgttaatgaagtttatggatgatgtgagcattatattcatttttaatatccctgaaattatttaaccaggtatttgagagctgtatatttaggaaactaaatagaaaatctattaattagggttaatttgcgatcagtaatattttaaaattaaacccacttgtgttcattgaaaactttgggtggaaggggtttcaatttcaaaatcatgtttgaatttattaatttatatttgtttacagtactcacattgctttcatatccattcgttcatttgaatatcatttgggtgagaaagacagaatggttattattagtgctatattacagatgaggtaatgaaggctcaaagatcagtatattctgggactagagttttgagctaattcagtgctctttataatacatcaagtccaattttgtacctcttgcaatacacaacaatttggcaaataatgaattgttttttatatacactaaaaattggttagtcatcatgacagaaacacataatgggaaccatgtatgaattctaacacttacattagaagtatgtatttgttgtagttgatgaaaaaacaaagttataaagatattgtagtatacatcaagaggttattggtaatctattctttaaatgtaactctggattcccctttttaaatctgattatttcattttgttatcaataataattaacgcttttatacatgggaagtcctatttttgtcttattcaacactatgaatcaagtaggtttcttgcaaattttaggattcatcttttaataataattacatgcagagactcaagtgttgtctggtttccctgtgatatagaccataagagttgaacctaagaatgtcagtcataagaccatggtggttaaaaaaatcacacatgtaggtccaagggaaaaaagtgccatgtaagcagtagttcctaatcaaatgtgtggtgtaaagccatttcaattattgattagcaggctttcttgcataatcagagaatattcaaaaatccttagaaggggttgaatagttatgtaatccatattgtaatcaatgcataaaagtgtttatttctctaaaactgtaatccttggatttacctatgtagttagctggctataattagatatactttacaccactggtgtaaagagaaaaattttgctttcctgggtacatttggcaatgtctagagatatttttggtcaccacaactaggggttgcttctggcatatcatggatagagaccaaacatgctactaaacatcttacaacacacagggcagccccctgcacctaaggattacctggcccaaaatgctaagagtgcccaaaaatgtcaataatgcccactttgagaaaccctgattgagataaaatgttaaattgctacaattatccataaaattcaacttcctacaaaactatttttgagaaaatatactgataaaacagtggtgatatgctgcataaactatttttggtaattaaatttgttctccatttcacttttgcttatgtgtcaatgctaataaaccagcagtttttaatttttcttttttttttttaaaccagagaccctttggaaatgcaaaatagtttagggtacttggaaccatttggttattatttgctatttcctagatgtatcactataaatttctcttcaagattatgcccttttattttattaacactgttacatactagacacctagtcactgccccacacctccccacgcccgtccctctggaggcctccctgattctgcagtttcgataacattgtctgtacccccagaccacagcatatattcctcataccagtaaatctttgttgtacacatatgtcctgtagattgcaatgtttgcttttatttttacctttcttgcgagtaatcatagtgcctcactagggctaggtgattcggttatctcatagttttctattcaaatcctaggctgtttccagacttgagtttgtctctctggtatcattagcttcttcgcatgtgggccctcacattctggcccaaagaggccagtaaaaatgctggtgccttttcaatcccctctctaatctgctcatcttcctgcctggataacctgtcaggcctttgccatttataatatttatccttcagcagttttccctgttcccttgttgattgcttttctgcaccaagaaactcccagtccctcttgcctgtgtgtgtgtgtgcacgtgtgtgtgtgctaaatagatctgtcttccttcagcagcctcccttgtaccccacttagcccttctctatttcataatggccttttccatgggtggggtatgtagtaagatctccatatctcccgtctgcctggctgtggctgcctcctcgtcagagcctcgggtggatgggaccacacacacgctaatgctctctaatccctgcagctttgtcactttcaggactgctcagatgctcacccagctctgactggtttctcatcaccctcttgaagggttgagctgtctttcccatttatctcaacggtgatagtgacagcaatccaccttcctggcctttcctcctgggccacctgttaggctgccagccgcccttgagattgatatttgccatttctgccgccaggtttgttctggcctctgtgggcatgttcactaagaggcacatcagtctcgctgccccgtgttggggcaggaaactccattatagactctcagttgatcactgttcttctgcttcttccctgcatcagtttctatctgtgagtgacggagcacctgcccagggggagatctcaggaagtcccatctccaatcaaatatacacaatcctgcccgctgaaccaaacaggccttctaaacgatcagatgacccatggcaaccatctccccagtaggacattgtctctattcttcctctacccattcagcccggagttctccggaaactctgggatgcctatcacacacggatccctctgcccctcagatcttagttttaattcaaccactgattctctcttacccactcagagggctagacccgaaaagagaaaacacaaggactgtttttgaaatacgtggacatgagtgtcacaaagttcatctggactaaggagagaaggaaagagctaggggaaacccccaagtaatatatgtgactattttttatagtggcttctggaaagcctgctcccatgtttacgacttcactgaaataaatgattctggtcatgtgcattttgagacagacattagtggcaaaccttgtcatgaatgactcctggatgctagggaacaaaagggccctttatgcagttctacatgacgctctccattcttgccactcaacatgctgctcatgctttgtggcattagcatcacctggaaagcttgttacatatgcgatcctgggacccacctcactatctcggacctaccaacttaccatctccattgtaacaagatttccaggggcttcctatgtacattaaaatatggaatattctgctctttcttttactgtattaaattctcagaactggctgggcatggtggctcacacctgtaattccagcactttaggaggctgaggtgggtggatcacctggggccaggagttcgagaacagcctgccaacatggcaaaaccccatctctactaaaaactacaaacaaacaaacaaaaatcagctaggcatggtggtacgcaccagtagtccctgctactcaggaggctgaggcacaagaatcacttgaactcaagaagtaggggtttcagtgagccgagatcatgccactgaactccagcctgggtgacagagcaagactctgcctcaaaaaaatgaaaacaaaaattatcagaacaaccttctgagataattattaaatttcccattttatagatggagaaactgatcctctgaatggtgaagaagtttgcctagtgttactggaaattgatccctcctgtaaaggctaaatcttacttttcttcttttaactatggaccactactgtataggtattcacaatgaagtaggcattactttttaaaatataattttaaatattagaaagaaaaatgttccagtctcattaagatggcaaattgccaaatggggaagacatctccatgggagatagggctctgaaacatccagctgagcagaggcatgaagagagagtgcatcctgcctgatgtggagggttcagggtagtttatagtcatgtggcagaaagaggacacactggggctctccacaggctggcagtcttggcaatccaaagatggtcacagcaagataaattatgtgttaaggagataattactatggcctttcctctgaacagcagctggaaataggctgaaacagatggagccagaaatagtgaaaaggttgaggggcaacctcaaaagagagacagatgtcctcaaaggaccagtttaaataagaagagcctctggatggttaaagataggggcgcatattctgcagataggattgtacaggtcttttaattctccctctaactagagttttattgttgtaagaggaaagaagaaatgaatcaatgaggtttattttaaaattgtatttttgttgacatatcacaggggattgatttacatggttttttatgcttatcccacttgtctcttcccaggcaaaatttaaccactaggtcttggctatatggaacaggaaccactgtccacctatattcaagaagagttaaaatttagaacatcttcttcctctttcctttacagtggcagtaaatactatggtgcctccagaaatcactcagcttaagaggttatctatttcgattttcacctggtgagttttgaatgggtatttagatgccaaattttaagcttgactatccctattcactccttttcacaaatattagtattaagagccaatggaaaaatgaaggctttcaggtagaacagcaatacagatagattcactgattagatgccactgttattgctgctaaccattcccagtttcaaaaaacagatcccaggggccagagtttcttactgattggcagcttgctccccatcctcccattcaatatacacacacaattttcaccactccactgggttctcaactgggttctcgacatctgcagtgttgtagatgggcaattgtaactttgagatgtgcaaaagcattttgaaaatcaaggaattctgtcactctggtcggtctcctggctttaatcaagaacatcctaaagcactatttctctatgtggtgtttcaacagatgttatgttgggttactaagagtgctgtaaaatggagagtttcagttctattgacccacctggaaccatgaaagaagtttattaatttttcacattaacatagtctacttagctcatagagtatcttcccattgggaaattctgcaaaattttatcactaattgttccaaacaaaagttttaaaattatgtgaaagtagaatcttttaaaagttatatttgagcacttatataaacaagaaactctttaaaaaccaattctttatatagcttgagacataaattaaaatacttttttcacatctaaatagaatgaggctaccataataaagcagtgctatgtatgtacttggcactcaagattttcaagtggcatcactatttcattattatcttgcatactctaccactaggcacagcagacaatctaccactaaaattccttgagttgtgttatgcaataagagggctatgggggtacatttaggtaaattacttatagtcgtgactgaacagcagagaattgaagggaccagcaatttccacctttctgaagctaggaagacttgaaaagatcaatcaaaggcatatgaatagtggccaaacactttgcctcttctttttagcaaagggaataatgaattttctctatacttactgagctcctgttttttctaccaagtgtgggagaaaaaaaggtaaattcgaaattaatacacgttttcctccaggtttggtttatgaaagtgcagcaggaaaaaagcatggtaaacataccactgttaatattttggaagatatgttttgtgtgtgtgtgtgtgtgtgtgtgtgtgtgtgtgtgtagtttggtttccctaatcacagaaaaaaatacaggtaatctcttactacagtgatctagtagtataggttgagagtacacatcaataagaaaacttaagtttaagtgaagaagtatactacccacactgcaggaacacattagctgtagtttcacttttggcatggaacctgactccctaatttcttatggcttcacactctggtttgtatatatattagggtgagaaatggccttagggtgaggcatctggaccattgctgaccttgcctctgtgctcccagttccctcattagtaactccagagataagatactgaagcgccctgttaaaaagtatgaaaggattgaggttgtgggagaggcttaggtgttgacattttatgataacgaggtttgtttaagttttgacacagattaattcaacctgttaaatagcagacctcttagggacatgacctaggacaggatccttcaacagagagagacatttgtcatctttgtatcagcagaatctaacagagctatcaataaatatttacctagtgaataaatatttgtttagttaataaagaaacagagaggatggatactccatttaccataatgcgagtattacgcattgcatgcctgtatcaaagtatcttatgtacctcataaatatacacacctactatgtacccacaaaaattaaaaataaaaaaatgaataaatgatgaaaaggtataaggaaataaacggggcatagctgttttcccaggaaggaaggcacaacatgcaatgtcactgggacaagtttgcgggtcagggcacgagcagtgttcaggaataggggttggatttaagagaggagaatgtgacaaagaagagtggaataagaaccagagtttgctctttcccatgtgctgtttccagccctgctaagagcagaattctcagtagaccccaatttgaagcgcataccccttccatcgcagtgccattcatcagggccagttacaaaggatgggatcttcaagagaattccatctgagtaatctgcactctcacttgaaaaaaatctctcctgagacagaattcatgctcacgtgcttcagaatacaaatccacaaggatggttcttagaagcttggcaagactctcttgagtttctttttatcattttttctttttgtttttaataagtgagctcaatatttatagtacttccatagccatttatttcaggtgtgtgaaaggggctgtttgcctgcccactgagggtgaattatagggatgacatttaatggtgcaacttcttctgctcagtgccctcaacaatggagagatgagttgaaagggagtgatattgcatagtaaacagtaaatgcctcacacaatgggaactcatcatttttattttattttatttcttaaacgtaaggtttgaaaaaatagcatgtggtctcttgacattattctaaattgcactgttagaagaacattaactttttcatttcacactttctgagccttaagcaccattgctgtatggggaaatcagtcattttctgatgattcatgtgcagatttgtgccaatcagaattggccataattatgccaagtctcttctttcaaggaagttcattgagggcatagagaaaggaaagcaaaaggagaatcatcctctgtatgtgctctgtgtaaattcacaaaccataaaggtacaagtaatttcatagtgcaatggaaatctactttgaatagactacattgttataaaccacagatactggtacagctatctggggagtcacttgatagggacttaatggcaaatctgtgggtacatttgtctttttcaagtttgccttgaggctatggacataagaaaatagtcaataatatctttctatgattaacttcctatgaaaatcactgagaatttggaatcactgatttttatcacagattctagagtagctgaagttatgagagatgttcatttgtctgagaccatttattttaagaaacagcaattcttacagcatgatactgaatcaggaatgagactaacaggaggcaggaactccacaaaaatgagatgagtggctgagatattagaagtgagaaatgtttatattgatttttgcgtgaaaaagagtccgatatctgttttattctcccctgcttctcaagattccctttcctcaaagtctatgaagtgttgttatggatttgttgttatttattttatttttaccttatttttagtctgaagtacattattgttttaaatcctatcaccataaaaataaaaaagggacacaattattttccttggaacattcctctgccttttctctcctattcaaagagcttactgttgaatttttaaacactagcattttcatcttcttcagcctgacagagtcattttgggaaatttgtgtctatagaggtattttctagtaaggtttgatttgattactgaccttttttaaccttaaaggtacaaaagaaagtacttcaagcacctaagggactctgccaactaatagcaaacaaaagttcaagatgggtcaggtcccacaaaggaaaattaaatgtattattctcacacaacaagattagcaaatcatccataaacccagccactcttttcttctttttattctaatgagtttagtgtgcaataatgatgatacaggcttcatcagaattctgccagtgaaggggaatttgcaaactctgtttgcaaatgagatgtgcaccataaaccatagtcatccatcatagagaagtagcttgtgcctgataaaaggctgttggggctgagtcaatcaaatgagcattattagagcttggtattatactgtcctttaggtgatggagaaggaatgtaatacagttatggaatgtgatttttttatgcctctgtcccttttggaagactaaactctattctaacatgaacatctcagagtgacattcataatctatgttataaaaagagaccttctctaatttctcatctgtcaagaacagttagaactgtgtagagttttcatgatatagctaacaccatgaagaaatggtcctgtaactaaaattacagctcatacttgttgattattaatgaaaggtagactgagcacttgtgtcaattaaatgaagaccaatgaagatgataacttctaatgtcctttgatcatgattaaaaataataattataacaataagattttgagcttataggttacttagacaccatctgatgtagtggatttctaacttttatttagtattggagcccatttttcaaccaaacatcatatggcaccaggacatacaaaatgatcaaggtgtaggagttctttagaaagaggcaagggctttctcactctttcttagctttccccagtcaccctccttgatggacatctctgatattttgaaacacattgatgtaactcatttttctaaaatttacagattgagaaaataatatgccaaaacatttgtagattttaataaggctgcagaacttactaattacaaagcaaatataaagatccagacatctttacttccacacagatgctttccctactgtgcagagctccgccattaccttgctctacatcgggtcagaaagccaatgtctgcaggggccaggcagtcatggggatcaggggtaaagcaggtggtaagctgcaaagctccaacccccacatgaagagaacagctgtcacagtttcaggggatgcttctcatgaggaaaatagggcccaagattccttaactttctttctattttttttttttagcagaagttgaaaaatcagaacttcagtgtaacaatggtaataattaaaaactttaagtgaataataataactactatactgatgaaacaaaacatatctacaagacaaattcagccaacaccactggtcactataaatactgatgttgagttcaatattgtgatgttgttataagaaatattaaaattcaaacatccctgtaattagattcattggatgtgcccaataattattcttatgaacaattagtaacaagtcctcattaattttttaaataaatattgaggagcccctaagcactaagctctgctgtatagaaaggtcatattcccagacctttgagaacacataatctattgaagagagacaagcatacaagtgatatttgtaagaaggtgaactgagctaaaatagaggagaaatgatggtgtttgtgggactaccaacaacagtaaaaaatatttgcataactctgctcgataaagactctccttggggagtcatgaagaatgcataggagtttcccagacaggtgagaaaggggacattctaggcagaaagaacaacacacatacaagaaaggagctgaggaaaaatcatgtcttgatcaaggaactgcaagtaatgaggcatggctagagggcagagaggatggagaaagggaagaagagagagaggcagctggacatgtagacaaaagctagtcaatgaaatattataaaatatatgctaacaagttaggactttattgtgtagctgctaagatgatatttaaagattgtaaatgggtgaagtcatcccatttttattctagaatgatgattcagatgacatgtatgagttagagacagagacgggagaaagaagaaccagttcttgaaatagctcaggttatcattgatgagggctgcaaaggtgttgagattggaggaatgaaagagataactttgaggcagtagatttatagaatctggctgctgattggctgagaggaaaaggaaagtattaaggataacagatgcccgggatttctgtctcaagaacctggactgactgtgacccatttaaccaagggggagactgaggaagtggtaggtgctggctgcagcctagaaaggctgtggaatggggctacctgaaccaggtctggaagggctgtcagaacaccttggtgtatgcagttcctggcctgcagaattcacctctaaaatgaggtgtttccctaatttcctccagcacatttcaaatataaactaaaacatgaccttgaaaatccagaaatctaaatatgaatgaaaaaactactaatcttattagaaatagcccactcactggaagacttctacgtcaagaagcttaaaatcagctgaatttattttttttagcaaacacattctagtgctaaaaacaaacaatagtaaagccaataaatgcctgccaaatatgaccagtagtatttctcagctggtttaatgagcactgagctagaaggtcgagacaaaagcacacaagaatctctttttttcaataatacaaatttaacatgtttggcattttattttgcatttgaatatggaatagctgactttagtttatagcaggagggaaaggttaaaagatttgttttcctcctgctttggcctagagtagtattaaaccacattctcctgtgatctattgtttagaaatctaatttttttttcttctcaagaatgtattcggagtaatcatctcaaaatatcattgaaacccttcaggtaggccattaaactcagtggcagagtgaccagagagagagagcgcttgactacctatattttcaaattaaatccaaacctcaagtatggtgaaaagcaaatatagtcattctggtcatcaattcagcaattacagacacacagtggatcactatataattcaaaaatcatgtgtctcaatgaggtctgtggttattttctatgttaggtactaatttcttttaatttacaaaagcaatgcatttttcttttttaacagtctagtgggggtgggacatgcaaggtggaaacaaacacaggagctattgaacatccataataagggcattattaggagaataaaaggagagggaagaaaaacaatcaacctgaaaacttagtacaattcctaaatagtaattcctttcaagagaatttatggatcttgataactagcaagtggcagcacgctccattcaacataaaagtaatagcaactaataataataataatttccaatgaaagcagtggttaccacagcctctgatttaaaatgtaggttttggaacagcaggcgtattaccaatgatatttgattttccaagaggattatccataaagaatcctgcagctgcacttatttacctgtctcttcatagcatcattatgcagacagggatactgagaaaaacactgtaacaaaatttaagcgactgcataattctttctaaatacacccactttatatattcacatatattgtgtgctcttcaaatgcaaattttaagtgttgtttatctgttacttctctgcttgggtctctgtgtgtagtctttccttaaggtagtaatatattcagatgttcagtttctctaacacaaaacgaattttgaatatgtaagctggggatttttcaatgaagtgacaggacaaaagagacccagacaaactgatgctttccttgggaattaattaagattcagagtagccctcaaatatttataccaaactcttcattttttaataagtggcccctagtgtgggaatctagcattgctggtcttttgggggaaggtagcgttcacagatagtaactcttgaatcttctacattcgaaggatggagaaaccacagcatgcaaactccttaccagttttttgtttgtttgtttgtttgttgtttgttttttgagacggagtctcgctcgctctgtcgcccaggctagagtgcagtggcgggatctcggctcactgcaagctccgcctcccgggttcacgtcattctcctgcctcagcctctctgagtagctgggactacaggcgcccgccaccgcaccccgctaattcttttgtatttttagtagagacggggtttcaccgtggtctcgatctgctgacctcctgatcctcccgcctcggtctcccaaagtgctgggattacaagcgtaagccaccgtgcccggcctccttaccaggtttttaacttcaaaatctactttgcctgtacatggcaggttgttgttcattttaacctcgattaataaggaaagaagacaataaattttaggatgtttgaaattctgtatttgcttatctacaagctatgtgatcctccaagtccaaaatgccaagcaaactgggaacactgatagaagtatcgccatctttcttcttttcctggcttcaataacttcatcaactacttctctagatcatatcagatttttcattgactttggccttatgggtttttgacccttctatataaatgcattggaattgctttactctttagcagataatcctaaagaatacttttatagggcttcatcatgtgagtgtgacattacagtctactttgtgtttggattatgggtcttcatgtatcaatggtaatgtcatctggcattctccttctagccactacctttggtattgatgttactgtgatgatttgcacatgagtgccacagagttatttttgtgtgtgtgtattgctgccattgagatgaagagagtgatggaaccaactcaccagaccccctgggactcctgatccccttagtggttccttttgaggcaagttgaacagaaccttgtctccagttttaaatcttgggtttatattacattcggcataatgcccagagagacatttcaattcaattgattgatttttatgttacattctcaggagtactgtttgccagttttcatcctcagtcctgtctgagcagttctgtggagagttatactcttccacagtaatatcctcagaacaattttgaaacaattcttttctccatattcttaaacagacatcaaagactttagtcctcttgtgaaaacacaatatttcttacagataagacacaaggcacatcttagtctgcctaagggtttcaaaacaagaaaatatggcaccttcatgataaagataaccccccgtcttagtcgataatactctcactctgctaaccatttgatatggttatcaaacagtatcttcaacaagtagccagtgctaaagatagtgagggatcaaagaggtgtaagatagcttttgccttcaataaatcatcatagttgggaagactgggtatacaatttaaagtattactgtaaataaaggtcagcatgtgttaagtgcccacagtgcagtggcagatgacagttactatacaggttgagaaacatgggacagaagtgtgactgaccttggtgactggaacaggcttcacagagggagatgctactcacttggatacccaaggataggctgctcaacttcaccagaatggaggtgtgctagtctgttctcgaactgctataaataaatacctgagactgggtaatttataaagaaaagagatgtaataggctcatggttctacaggctgttcaggaagcatgatggcatctgctcagcttctgggaaggcctcaggaagtttacaatcatggtgggaggtaaagggggagcaggcacctcacacaaccagagcagcagtgagacagagagtggggaggtgccacactcttttaaacaagtagatctcatgagaactcactcactattgagaggatagtaccaaggggatagcactgaatcattcataagaaatccacccccaagatccagtcacctcccacgaggccccacctccaacactggggattatattccaacatgagatttgatggggacaccgaaccaagccatatcaggagagtattggagtctggagaatggtgagatattctagtccaggggtccacaaccccagggccacaaactggtactggtctgtggcctgttaggaaccgggccgcacagcaggaggggagtggtaggtgagcatttctgcttgagctccacctcctgtcagatcagcagaggcattagattctcataggaacatgaaccctactgtgaactgcacattcgagggatcgacattgtgtgctccttatgagaatctaattcctgacaatatgaggtgaaacagtttcatcccaaaaccatcccctggcccctctgtggaaaaattgtcttccacgaattcggtccctcatgccaaaaaggtcagagactgctgctctagtccaaccttgaagatagaataatgctttggtgaacagagcatacattttgttattagagtagaatgttaatgaaaggaaatactgatagataaatttatagagttttttttttaattattggctaagcattttgaattttttcaagggaaatgagtgcctttgaagacatttaaaggcttttgagacgagaagttttctaagatttatctgcccagaaccgattgaaatggttaggtaggtgggtggtggtggaagagggagagacagatggaaaaacacattttattagagatttacaagtgagatccaagtgctcagatcagtctggtaacagtagaattgagcagacataatccatatacagtttttacttagtggagacccaggtcattctgaatggagtgagtaacactttgtacttttaccttcccagctaatggccataactttcaccctagttgtccctaatggcttgccaaatgtattaaaatgattttggaaaatagtttcgtgggatgtaaggtgaagaaattaacatttgctagtttctttccttagaataatagtcttaatcttagagcttttattagttcattctcatgctgctgataaagacatacccaagattgggcaatttacaaaagaaagaaatgtaatggatttacagttccacctggctggggaagcctcacaatcatgccagaaggcaagaaggagcaagttatgccttacatggatggcaacaggcaaaaaaggagagcttgtgtcaggaaaactccccattataaaaccatcagatcttgtgagaattattcactatcacgagaacagcataggaaagacctgaccccatgattcaattacctcccactgtgtccctcccacaacatgtgagaattcaagatgagatttgggtggagacatagagacaaaccatatcagagccctttgaaaattagacaaaagtatggaatctcccttgcgggggaaaaatacacttatagacaagattgtgaacacagtttcagggatttgcagataccctgaaagatgcatagatgataacttaagagtccttagagcaatatttggtccttaatgatttagtgtaggcaaattctgagttgcagttacagtaaattcaggtagaagtgataacactatagcatttgctcattctgaggaaagggagataacaatgaaacgatgacacttgggctggcaaaactttaaaggaagactggttgggagtgaggttttctttccacttagtgccttatttgtcactcatgtactctgatatggtttgggggtgtccccacccaaatcttacctttaattgtagcctccataattcccatgtgtcatgggagggacctggtggtgggtcttttctcatgctgttctcatgatagtgaataagtctcatgagatctgatggttttataaagggcagttcccctgcacatgcgctcttacctgccaccatgtaagacatccctttgctcttccttcatcttctgccatgattgtgaggcctccccagcaatgcataactttgagtccattaaaccacttttctttataaattacccagtcttgggtatgtctttattagcagcatgagaacagactaatacatactctgatattaatcaagtaagaatttaactgaagggttaatttacaattgggaaaagaaactattatggaagacagaataatttcggaaataagcctgtctcaaaccgagacttaaatgtaatgaaactgcctttggtccatgtaattttcctaagtgatatttcaggaatgttcgccaacagccacttcatttcattatttttatagtaacataggcaggaagtaaccaaggtttgattaaacttgcttatatgaatggaagaggctgaaaagttggtcagggaataattgctgctttcattaataatttagttgggtggctccttgattcatacctttccagtttattcagtaaatgcttattgaacatctactatataccagactttgacctgtagacaaggtaaccatccatgtagtttgttctgggaaggtccagactaatggctattaactctatgcaattattctcaatatcatttttattctcaaaattgtcctgttttgaacaataaattaagtggttattctagctttaggctatttggggaaatgttatctctgggaaaaactgtttggcctgcccaaacgtttcttactcatcagtccaaattacatatgattacttgtagtatttggagtataatacaagcctcaggaagatagaacttcatccattttgttcaccaatatgtctcctgggcctagcttattgttgaaatgtagtagatactcaataaatacattttataaatgaatgaaccatgtaaaatacttcactattggagaaaatggctaccactataggtatccaaaggactaagaatagactatgctctgcaggtcaggcttaacttgaagaaaattaaccaaaaaaatccaaaaaagtatattaataattcaagaaaatgattttattatctgattgtattttagaaatacgatttgaatgtgtttattttggttttgaagtcaatttcttaagtaaatgtaaagatattaaaatgtttgccttggttatgaaaggttaggtgaccagctattgttgaagtaaccatgtagaacattagaatttcactgtgggcatgttgtgaggcagggattaaatatccatgactaagggaattagtgagcaccagacccaaagtatgtctttcctccctcccttctttccagttgtcaggatgttacagtatatagatattatattttgaagaggtgacctagggtatatgagccgtattcttattttacacagaaatacatcaagcttggttatcttgtttcccagcctccagaagattagaagcagaaagttagaaagaaagctgttagagtcaaacagatttatggtaatgggagagattgcacaaccacaaaaaggaggcaagggattcaaaaagcatcatttctgaggccgtttgggaaagagataaagagcctcacacgcccggtagccccagaaagcctcactgtgttaaaccagctcacagcagttgtcagtaatgatggcctcaggcaatcggaaaaggttaaagtaggtttattgtgctctgttcaataagaggacatagtttataatccacttcagtggtgctggtgttttatttaagctcttttggttgcaagtaataggaggaccaaaatacatcctaagagaagtgtgtgggcgtgtgtgtgtatgtatgtgtgtgtgtgtgtgtacctaatgactacaaattgcaagtaaaaaggtataagtggtcaagaactgagtcggctcgtagggctgggtcctgattttgcaggtccctggtgtcttggtttatgtatctctgtttctgtctgagtctgatcccttgttgcagctaggcattacctctttgggctcttctctctaggcctctttttagtttgaacttctgcttctgtcttctctctaggtgattctgataaaattccaagagagataatgtgatttttccagctcatctgttcacactggcaatgtcacggcttgttgattatcctgtgttttacctgctctgaatcagtccttttcctgccccagtttgcagatagagggagtgagtggctttggttatctggcctgattctgataatccactaagcagaagctgcagacaagctgttttcacaaggactcaactaaaggcattgcagatacctaaacaaatccaaaaatagatcaatgttttaaagttttgagatttagttcaatgaggttcagttacctgaaaaatatgctttaggtagaaatacattccattaccattctacaaataaaaccctactctctctatatttcatatcaattcagggttctaataaaatattactaactttattatgcattatgtgtctttttccccaaaattattccgaaagaagttctgtgttcttcctatcctatgttactcacccataagcacatttccattatcgtccttgatattcgagggttggatgtaattgatccatggcctctaccatttcctcctcttctccttattccctactcagacttagcaaaacaggggaagatgcttttacatctggagcagagcatcactgttccaacaatgggtgaacgtgagctgccgttgttgccaatactgggttttgcaataagtgctcagaacagtgattcatgtcacaacatagtacatgcaggaaattatactagtggtccagtacaataagccttagcacatgtgtcacccatttacacacttggttaaaggcatagaatgaattaaataaatgtaggtcagaaatctgttttcaacaaagaaccagggagagaatggcaattcttttatacctcaagagtaaagactaggtgggacacacttataaaacgttagtacaacttgtacagagatcctgattgaggctgtcaatttaagacatctcaggtaattttaatgacaagactagatataaaaacagaattagcattttgaaataaacaacaatggtggcccaattttgggtgcagcactgtgtgtgcatgtgcccagcgaatgtgcatgcattggtgtgtctgtgtacataggcacaggccaccctctccttgtcacagtacacgcaccacctcctctctatcaccaaaacatatagctaccctcaaataaaagagcagctaagctcttgtagaacatgacgtattatatcagcatagatttcagtatttcaaattattcctggaattaattcactaaataacccaggtagtcaaagcacagatccattaggctcggtagaacacattctttaaatgttagtaccatacaatgaatatttgataagtacatcattaataaaccttggtgtgacataattgatatgtggatgtttaatgacaattccaaatgatgtagcacatggcatccactcatccctcaatcatcacgcaggttgcccctgtaccatgcgatgggcacaattggaaaggcaaagtctgatcttcattagtggctacccataaaaggttttcattacaagataaatgattatagcctggctttattaattaagcatgcatttctgcagaccaaagtaattgaataaaatggctagtagcttttaaactacacaaaatcttaacatctcaagaatagattctactttcaatctgtgcctttaaccctctattatttgagaatacatggcaactgaatttaaactgttgccaaatactgactaaatttcacatacgagatttttttcctctaacatcttgctctgtggctgtcatgataaacggatttgtctttcctttcatctaataacctcaaattcatcctgaccctactctcagccttgaggaacataaccccagaatatgtacagattaactatagaagcattggtgcttacagaaatgaaatgacttgttacatcttgaaagagaattagtggctgaagagcaggtcactagaagtcctttattcagttgtcactgaatcacacctaggaaacgacctcatcatccatgctcaagtccttctttattttggggtcaggaaggatgcttcaaacgtgatatacccatgtaacaattccctttctatctctgactgcttcagtgagaaaaataagaattcttagaatatcaattttaaagtaaaaaatatatatctacaccagggaagacattttttgctataatttttttacatatacaatatcttggaataaaagagctctaaaacaaaagcagtaaattttgcaagatcattatgtttctgattgcttggcacataggagctgtgaaagcaaagtttaaaattcatttttactcaatgagaacacacatgacttagtgcccacaaaaaatccctcaggataacttttttaagtagagcaaaatgtatatgtatataatatattctaccatgaagcatctaaaattaattttataagatcagagaatattctggcaatgagacaactttttctccccaattctgctttgaactagttttttttttgtatgatcactaccagaaataattacattattaaattaattccactcctattgaccgtggtcactaaacagttcatcagcttacggtattaacataaaataggaagcttgaccctcaccttgtcgaaaatacttttatttgtagtgtttttacttgaatttattgataattacttttatactttatgagtatgctattgattcttctgcatgcctttcaatggaagcattaacaaacatttagctttgaaggtgacattttaatttcatttctaacatttgtaaggactttgacactaactcccaccataatattttcaatcccatgaagaacgaaacatttccatagtttattgtctacatttccattgtaatggccaggtggctggtattagagtagcatggcatacaattccagtattaactaaaaataccactagactattcaaatgactcgttttgcattagtgcaattgtttccaattgcgtttcatcatgttttattcatcctagtttcttcttgttgtagcattaaactatatattatgaatttaatgtatatagtaaagctaaaaattccttttatgaagtattaagtgctgccataattcttatgtttatttttaatcatttttaaacctaagattacaagcacagatttagagataattctgatttaatttaattaatttatttgttttgttttcaaatatgagaaccttcatcatcgtgtttcaatgagtctcctgaaataataaattcaaaaagaatttattttctcttatttcagctgagctctctttgctgcaagtcttttatttacatcatccatttttcatccttgattattcagaatcaccagagaaccatcttacttctgaaccatgaggttattattcaagacctactactatgctgaagaattcttctttcttctttgtcccaaccagatctgactctgtcactcaccagctacatgacctggaacaatggtttctgcatgtgtaacataggaaagcttgagggctcaatgatcctcagagaatcaaatttggccagtggcctccaattctatgtgttatggcaagactcaggtacaagtcaagacctttacaggggcaattcagcatggcctggttgtaattccagtttttctacttagtagcattgtgatcctcggcaacttatttaaactctatgtgccagtgtttcctcaactgtaaaatggggttattattattccatagagtttgttataaaaaccaaatatagcaagtactgtgtatccgaggtactaaaaacagtgcttggtgcatggtaagcatccaatgaatgttagcaaaggattaaacgtccctaaggagtaaaaagattatggcacactccatccctaccctacttccgtatgtaagttaaaatcaaaattctggtatctccatatggtgacttttggaagctttagttgaaatatgaaacaaacaaacaaacaaaaaaaggttaacttttggttttcctgccttagctttgctggtgctctaagccagaatatcctgtagcatgtgctgcatcgtatcaaggtatgaaagacaactatcactcccttcctagtcctctgttgaaaacagatttctgttttatatttatttaaatatattgtaggtgtccatttatgaaaataatatttatctaaggatgaagcttcagatatttctggaggtcttatccttatgaatcaagtttcagtcttatagtgattattattgctattgttactattataattgtggtttcaagtaataaatagacattatattgcatttgtcatcatttatcacaaataagtacccaggtatatattaatgaaatttcctgttgctttcctgagtgccttgttctctagaatagtaatgatggaaagcagaccctttcctggcacacatttaagatatagtaaaggttattcaaatgccagttattttaatgataactttgttagtgtaccaagtttatcacatattaacatggttatacaatatagtttaactatatctaacgatattaaggtttaaaaaataaatttgactttcatattttatttttagtaggcccaatgtatgacatgattttaaacttattgttgtttgaagatataaatatttgggcaagtaagaggatatggaagacacattgcttaaagctgatgacggtgtgttgaattacatatagaattcctgtggatagaccctaactgaagagatatctggtctgactccttattttgtagctaagccacttcagaaaatgtaactaatcagccacaaatcgcaaagctggaaacagaattccctgttttttgacaccaagtctgaggtctttccaatgtaaagcactgcttcccaaggtactattcccagagagaatttatctagtattttcatttttcatacttgttttttttttaaaaaaatagtatttccactctggtttgtattgaagtgaatagaatcccaattatacttcactttatggaaatgcaacacatgaagagctttttgtatgagcttttcatttctggttctctttgtcacaaaaggctcttcacttttgtagttgaaatcatttgtaattatgaactgtgcttttaaaaaattcatcaatgaaatctttgattttgaaatgaggtgccagaagaaaggcagaagtgggataagtggaatttaatgcaatatgatagagaaatagagaaatcacaaacgagaggcatctcacctagagcagtgtctcataaagcagctggaaaatgaagataatgcatttggtcatgttttggagtttattattcagtattatttgaggtaggagtgcacagaaaatatctttatgccacacattaaatatttttcatgtatcaaatatatctactatacaagatttagagatgatgggcacagggggtcaccaacacagtgatggaagacacacagttttaaatactcagctgtatttaattatattttattttgttgtctttaattctgacctgctatatggggttttatgtcagtatcataaatgtgccaatatctgttaataacatccttaaggtatatgttagtaaacggccaaagaaagaggactgaattaagtatatgcttaagatggtgagagtgagaagaaattgaacaaatatttttaaatgtggatttcaataaatgtacttccttacacaatacctgcaattaattacaactcacatgacttatttcaccaactcagaggtaaatatgatcatatgcacttatttaatgttacattatcactcaaattcccattgacttgggaaatccaagttatcctctcaaagatcttgcccacccctgacagtttcaactggttaaaacaagcaagcaagcaaacaaacaaacaaacaaacaaacaacaaacagaaagaactcagagcaaagtgggtctgtcctggctccaaaagctagtctctgagagtgctggagtctgatctgttcacttcagctacaggcgtggatgcggccacatggtttcactgactgagacaagcccagcactggcacacagaagcctatctctgatgtccttggtggtccaaattttgaccaaaccttggtcaaacctctccacagcaagtcccagggtttcattctgcttcatatctcatgttaacagagatcttggtcccagtcacacggctgcaggggctgcccctggggcacctccaccaccatcctggtcctgacagtagtttatcccatgatccttcagccttctgattgagccagggtcactgaccacatgtctttcacatacattatttcaggagactcattgtccccccctgactgcgtgtcttaggggtactgggtgcagtactctatgtcgttcaatcttaagcagcagaggttggatttccttcttcccacagctattaggttttgttatcaaaacataaatttcttatcccttctgagcactttgaaaatcagagaaacagagaatgcctatgagttcctctcttacaccctttttcttttccttcccccatcctactcctaacaaggggtttcttttgacccaaatttgcctaatttaagaatacagcaccagagattcattcagaataaagaatacgtgcttcaatgaaacagcttgactatattccttatctagaagatgctggcataaaagtctatattacctctactcactatttaatctttgctgtaacaggcattgtgctacatacagtttttaaaaattctcttctaagaaataacaaaaaaactcctttagagttagattagcctagtcagctcttattcttgaaagggaggagagttaaaaaataaaaacatttaattgtcttttattattggttttgactagaataattatgtcgcttgagcctgaaacatggaaaggggaagttcaaacctaacaacttcttctatactaggccatgtgatttgcacaccaatgaatgtgctttaactctcagccctgaagccgcctgtaaattagttctttttttttgccctatgggtacaaaaggttcataacatcaaaaccttatgccaccctctctacccacagaattctctgataactctcacatcatcaacttaccctttatactagatcgttgtcatttcttttctttagaattcttttttaacttttattttagattcaggggtacatgtgcaggtttgtcatataagtgaacttgttccatgtgggtttgttgtacagattattttgtcacccaggtactaagtctagtacccaacagttattttttctgatcctcttcctcctcccaccctccaccctcaagtaggtaccggtgtctgttgtttccctctttgtgtccatatgttctcatcatttagctcccatttataagtaagaaaatgcagtatttggttttctttctttctttctttctttctttttgaaacagagtctcactctgtcgcccaggctggagtgcagtggcgctatctcggctcactgcaagctctgcctcccgggttcatgccattcttctgcctcagcctccccagtagctgggactacaggtgcccgccaccacgcccggctaatttttttgtattttttagtagagacggggtttcaccatgttagccaggatggtctcgatctcctgacctcgtgatatgcccgcctcagcctcccaaagtcctgggattacaggcgtgagcaaccgcgcccaggcccagtatttggttttctgttcctgcattagtttgttaaggatgatggcctctagctccatccatgttcctgcaaaagacatgatctcattcttttttatggctgcatagtattcatatatatatatatatacacacatatatatacacacatatatatatacacaccacattttctttatctagtctaccattaatggacatttaggttgattccatgtctttactattgtgaatagtgctacaatgaacttacgtgtgcatatttctttatggtagagcatagatcattcttatcaacacacagcctgagatattttcccatggtaataaaatcaaaatcacactcctttgttctcacttcctgctttagatattgcccctgctctgcttctctgtatatcaaaacttactttaaaagtttgtcatactgtttctaactcatttcttttgattttttttctcaaatcatctgtagtcaggctttgcccctttctctgcaccaaaactattcttgataaggtttccaattgtctccatatggctaaacccaatactgcattctgattctgcttttagctaacctctccatagcatttgatctagctgatcactccctctttttttcaacactttctttacttagcttccaagatagtaaactcttctggtcctcctatttccatactggttgctttttagtttattgctggtgtctctccatctttctgatctctaacataatgtagtcatatgtcacttaacaacaggtgtaagttctgagaaatgcatcactcggtggttttgttttctgtgaacatcatagagtgcacttacacaaacctagatggtatagcctagtacacacctaggctatatggtgtagcctattgctcctaggctacacatgtgtacagcacgttactattctgaatactacaggcaattgcaacaaaatggtgtttgtgtatccaaaatatctaaacatagaaaaggtacaataaaaattctgtataaaagattactaatggaagatctacatagggaatttaccatgaatggagcttacaggactggaaattgctctgggtgagtcagtgagtggtaaatgaatataaaggcctaggacatgatgtacactattgtagattttataaacaccgtatactgaagctgtactaaatttataaaaaattatgtttacttctttagtaatgaataaatcttagcttactgtaattcttttgctttataaacttttaatttttttaactttttgactgtttgtagtaacacttagcttaaaacacaaacacattgtacaaaaatatttttattcctttggatctttgttctataagcttttctctattttaaaaactttttattcctttattttcgtctttttagatgaagacacaaacacacacattaggctaggcctacgcagggtcagggtcattcatgcccctgtctttcaccttcacatgtcttcccattggaaggtcttcagggtcaacagcagtcatggagctgtcctctcctgagataatattacttctttgggaataccccccgaaggacttgcctgaggctattttccagttaacttttctttttttaacaagtagaagtcatacactctaaaataatgacaaaaggtataatatagtgaatacatgaaccagtaatgcagtcgtttattatcattatcacgtattatatactctacataattgtatgtgctagattttatatgactggcagcacaatagttttgtttgcaacagcatcaccacaaacacatgagtaatacattgtgctatgatgttatgacagctacaacctcactaggccataggaatttttcagttcttgtataaccttatgggaccactgttgcgtacattgtctgtgattagctgaaatgtcattatgcaaagcatgactgtagctcaggactcagccttggacctcttctctaccaagatttatttgtggtgatctcctccagtatcatggctttaaatatgcttaagatactccgatttttatctccagctcagacctctccccgaaactacagtcattttttcaactgtgcactggaaagtctaatagatgcatcaaaggaaacctgtccaaaacccagcgccttatcttctttcctgaaactgctcctcctgtaaccttctctgagttggaggaaactcagtcctttcaattgcttagggcaaaactttggtaccatttttgactcttctgtttttttcacaccccatatctaatccatcagtaaatcctttggccgcaccttcaatttatacccagaattcaactgcttgtcaggatttgtcccaccaaggtaggaagttattgccataagcacaataagaagtgatagtgtatttatggcaataacctcatatgttgtctcttggcttctacctttggcccactacatcatacacagcagaacagacagggttaccctgtgaacatttacacgaggtcccagcatttcctcattcagaaccctccaatgacttcccacctcagtcaaaataagcatcaaagcccttccaatgccctaaagacatcatacaatctgtgtccccattttatctcccagcccacatcctgtaattctcatcctatttcattctgctcctgacacactgcctcgtgtcagcctcaggcctacctgcttactttctttttgcccacaatgctccttcccctcatattgcctcacagtgcaatatgcaacctcttttaggtctttgctcaactgtcactttctttgtgaggccgtccctgagctcccttttcaaaactacaatcctctcccagatacagtctctatcccccttccctgatttttctccataggactcactaccatgtcatacaccgtctgtttgtttatgtattattattaccccttgcctacttccctacactaaaatgtaagctccatgacacagggatttgtgtcagttttattatttgctccagcccaggtgcctggaacagagtgctggcacaggtgctggcacagagtgagtactctgaattatgtattgaatgaatgaatgaatgaatgacggaaatgtcctctccaatctctcctggccatttctgacagttcctaactgtaactctgcagaagtccctgggctgctttttcttctctgctgcctgatagtggatccatagattctcaggaaacccaggcctgtccactgcgatggctgccatgttctttcatatactcagcatgcagtaattgtaggcatagcatacttaccgtaatagctgcatttactgggtgttaagtctgccctaagtgctgcattaggctttatatatattttctgttttaatttgagcctcacaacccaggaacaaaagtagcaaggtttggtttcttgctcgtgtgatcctttcttatttctgattgtgacttcatgattaccatattatctagtagcttccagttaagccacagtggccttttcctcctgacttttttgaattctacccttctcgactgcactggccacctctctggagtgggcgattggaaacaataagaccagagataaagagtctagaaggatcatttggtcatattggttgatgctatgtttagggacatagccacaataattgtatgtatgtattaagcacatactaagagttagagactgtgctaagaactattatcttatattcaaatgctattcctatgtcagtgaaggaagtgaggcttaagaaggtaaaacaattggctgaagggcatacaactgagtagtaaatactggttttaggatttagaccctggtcattcaaactcagagcctttgatcataagcatcatggtcttaggtggaggtaactgtgggaggattaactggactggcatttttcaaatgcacactctgttccagtcactgtactaggtgctgaggatataacaaaaacagaggaaggacagattcttttctcattaagcctgcagtccagaccagctggaagatattcattatataatcataagtagagatatatacgttgatcacctacatttttaagtgttttaatagctataaatatgagtcattagaagccttggacatctaaagcctttggaagagtgcctgacaatccttcagtattgtagtctttatagcgtcccttcacagtagccattcaggcttgtgtagtgggtcctcttcagcctcatacctttaatttctattacatgattaacatttcattggtaactttgtatttttatgtatatgtgtttggtttgcttcaccatactatattatcagtctattgagtgcaaggatgttctatttatttccatattcccctaagattcttagttgttttatcttcaaatagaatgttctcagtatatgcttacaaattcatcctagttcgggaaacactttcttatatatactccttttgaatgggaagatgaaagtatcagtgggtaatttatcaaaaggcatgtagctgggggtggaatcagaacacccaaacatcagtgcttagaatataaagtatgtggtttagttccctgcatccttaagaaatatattcagatgtcagcagtagataaatgttaacagaataggtgtaactaagctctttgtataaagagctgtgttttagaaaattaggcaagcatattcattaggtactaaggattggtgactttcccatcagatctgcagtgaggatagggagcaacgcaaagcggtgattttaaaatttgcaattatctactttacacattcaacaggtgaaaatgcaggttccccagcatcagaaggtgctcagatctgtactggcatttctgaaactttgaatgcaaaacattcctttcaacttgagtttgaaagagtaggcagtgagaaatcacagggagactttctgcaggcagttggtactacctgttttgttttgttggttttttttttctccccatgggaaatttcatttattatacttacatttgccatgtaaagcgactttttcctggagcaacagaaaacctgcctgtgccatagctgacatttttggagagcaccatgatagaaggagactaatatctttattggttatctctccttccttaatcagtttaggtagatatatagaaataggtagtttttcaaaagaggctcagaccaaagatatttggtctgagcattaatttgacagcaagatattattctttagggctaggttgaacaattgtcccagttttcctaggacatagagatgttctgggactgccagagctctaaattaactagggaagtgatgggtatgtcagaaaaagctggtcatgctatttaggtagctcttctaagcttttaataacttcatcctacaaattaggagggaccacccacctagtaaagtactagaaattgctaaatatttagaattaacctgcctctgaggggcaatgtattctccaaaagttggcgatgaggtggaggttaccaaagattggggaactggtataagtgactctcagccaaagaatacatatttatctgttgctgactttttttctccccgtttctcttgggtaaatttccccttcaggcatcagagctgaaagaacagtgtcacagcaagtgtgctcagctcaccatggacctttatttcctgagtctcacagttattataggcacaatagccacctcatgccactgaatgcctaaagttttgtggagatgccctcagggacttggacttgggcttcacaatagatccccaaagaggctgcggccctttgtcccgacaaaggagcatctgttgaaggcattttgcttgaagtcattcaattcagtcctagaccactagcctggatcctttaaaaagccagctccattgttcaaggcatttcttgaaggaggagtacacacgttctctaacttccctcctctaacttccctcgtttagttaatgctgaaaatgtctggcctagggtctgtcactataagatgggtcacaataacaagagaaaccttatctctaacttaaatttgtatagctcttcctggctttctctgtacttgtcacaaaagttatttcttctaattcttatccagatatagggaaaacagcaatgattatacatcgtgctcattttataaatgataaaatgtgcttatttctccaagtccatatgagctgggttatgacaaaaattagttcaatgctggttgataaattgcattaccagaatggattattgaattgtgttttcttactatttgatattcaggtggtttcatagttgaagtcaataaaaaatagcgtttgagaaggcagatgtgtggcttgttgcaagtctctcagctccaagccctttaaagaacaatactgctttatagacgttttgtctggtctagttccatgctcctcaaaaagggatatgcggcagggggccacgaagacactggaaaatatgtccatggtgggtctaacataaaaatagtggcgttttctaataacagcagtatttttatgttaaatcaacgaagtacagctatgaaataaaatgaaagttcacataacatcataatgtagcatgggaaactcgaaaaacatttagccttataggggcctctctgcttgcccattctactttgttgtttggaggtgggtactacttcaggggatattttttggaggatactttaaaggaacagttgaagaatcattggttctagtctaattctgcctcttccacatgaatgccacattctatacctctcaaaagatttgctgaccttgactgagctcatagtatttatcttgtctgtaatagcaatattggctattcgaccaaaataaaagaattcagtgatgacttttcttctttatagcttaggctgaaatgagactacatgtaattttctgcaggtttcaaattagaacacactgcatagctagccttttgagtttccatgataaaaagaaaatgtatctaatgtttactgaatgctcactctatgccaaacacttagctaagcatttcatatacacttgttacaactgctataatttgcctttattattatctaaatttggaagatgagcaaatcataaccaacttgcccaagcttacacaggttgtcaatggcagaacccggatttcaaatctaggtagcctgagtttgagcccatgttccaaatcactctttgtgtggttcttcttgctgtaaaagtggtttttttaaaaaaaaaatatatatatatattttaagttctgggatacatgtgcggaatgtgcaggtttgttgtagagtatacatgtgccatggtggtttgtggcacccatcaacctgtcatctacattagatatttctcctaatgctatccctcccctagtcccccaccccccgacaggccctggtgtgtgatgttcctctccctgtgtccatgtgttctcattgttcaactcccacttatgagtgagaacatgtggtgtttggttttctgttcctgtgttagtttgctgagaatgaatttttccagcttcatccatgtccctgcaaaggacacgaactcatcctttttttatggctgcatagtattccatggtgtatatgtgtcatattttcttaatccagtctatcattgatggacatttgggttgattcgaagtctttgctattttgaacagtgctgcaataaacatatctgtgcatgtgttcttatagtagaatgatttataatcctttgggtatatacccaatagtgggattgctgggtcaaatggtatttctggttatagatccttgaggaatcaccacactgtcttccacaatggttaaattaatttacattcccaccaacagcgtaaaatcgttcctgtttctcaacatcctctccagcatctgttgtttactaactttttaataatcttcattctaactggcatgagatggtatctcattgggggtttgatttgcatttctctaatgactagtgatgatgagctttttttcatatgtttgttggccgcataaatgtcttcttttgagaagtgtctgttcagaccctttgcccactttatgatgggactgttttcttttttcttgtaaatttgtttaagttccttgtagattctggatatttgtcctttgtcagatggatagattgcaacagttcctatagagcagtgtttgaatgatgagccctattactctgatggacattttatgtgcatatacattcaccataaatcaactaagtaatagttatgttcattcattcaaaggttttagagccctaactatgtgccaggttgcaggggtacagatatgaggaagaaaagctctcttatagcagctcgtagtctagtggtacagatggacatataatcaaaatatgaaacaatcaaataatgtcaagataaaacagaatacagagcaggaatactttaccacatggacttagaatttatatggggaagcgagatgatgtagtaaccacaaaaaattgtccatcgaaaaagattgatgttggtagagcacaaggagcagagacaaagatgaaagtatgataagttccaagtgaatctttcaaactcattagataattttgcagggctctttggaaacatttaattgctaattcttattagtttctgaaatcaatttcattggccaacctcatcccatgcctccaagcaaaacttcaaattaatggtagcatttgtttctcattaatttatttggttttcttaatggccaatttgaaggcttattaatagttaatatgtttagcaatgtaaacatttgcattaataaaacagatgcaaaattactgccccagccaaccactgccatgctaaacagccaggagacataaacactagtagagttgaattgagcttatcctcagaggacgaataatgtccttccagattgtctgattttcacatgattgctgtctacacatctatttcaaaactcataagagatgttgcaacactaaatttgtgttagtttttttttcttaagatataattttaaaagtaaagtgtgttcttgtctaactgctcctctccttatttcaggaatagacatacaaccacaagtagtctatgactgtcttatgtttacctttggaccactgacatttttgtaaactgacaacaataagctaactaatatatgctgaatttaggcttttactcatcagtggaaaacaattttgatttatttatttatttatttatttatttatttatttatttatttagagacagagtcttgcgctgtcatccaggctggagtgcagtggcgcgatctcagctcactgcaaactctgcctcctgggttcaagcagttctcctgcctcagcctcctgagtagctgggactacaggcgtctgccagcatgcatggctaattttttgtattttagtagagatgatgtttcactctgttgcccagggtagtctcaaagtcctgagctcaggccatctgcccacctcaggtggccatccgcccacctcctaaagtgctaggattacaggcatgaaccactgtgcccagctggaaaacaattttcaagctatctcctaatggtgttgctattagccaacagtttattttagacaatataaccatcttagcctatagagaggcatttatatatatgtttgaatatttgaatatacttattttataagaatgagtggaaaatgggaggctaatacttatactaatgataaaaaagaaatacagtctaataaacattgataatcacagaaataattacattttacaaaaattgtaaaattttagctttaattgggtgcccacctgacttaggttggtatattaatcaggatatactaattgttgtaacaaacacaatctcaataaggctttttaattgctcatattacagtaaaatgtgagtcagtaagtatctctctttgttccatatagtgatttagagatccaggcatccttctcctagtggccctgcattactgggacctcacagtcctctagcaaatcccctgcctccagctgccagatgaagagtaaaacaccagttggaggaaggagagcatacagatttgaggagaaaggcctggaagtggcatacatcacatttgatcatattctttggacagattttactcacatggcagaagtgcctaggaagcagagcttggtcttatgctcaagagagaaaacacatgggatttgttgattataggacattgcctctggcacagtcagtcaaatatgtatttgattgtgaagaaacagataaaaagaatatttagaaatgtataaaatgccggaaatagatgggaaaaattatctttaaaaggagaatataaccagggatttgacagacttcggcaccttaggaatagccctgattctcctcccactgctccctggctcagttagctgtaggtttattatgagcttatgcaaatatgtacaaaagaacatttttagtaggactgtgaatgtctccccttttgcagaagttgggttccagagaatttaaagaagagatatgcattgtgaacattttccctgcaagacctagaatgtacctgacagcattcacctttctggtccaatatcctagattattctgtgtgactttcagatctcttgtaacattgaggaagggatctgagtcttttcacttagtctgtatactctgggatccatcagattagtagtcatgtcagagtaatgcccacagagaggcagaagtggattacagaagtatgacagaaaacattttatttgaggggtttctaagaactcagccaatggatgactttcaaatacataagtcaggaaccccagtgacttcctgtacgagtgtccccttttgtttgctaaatcccaacacacaaaataaacattccctaatgggaaacaaagtatcacattttctgagaggtttaaaacaatattaagctatgaatcatctgttgatctttttaacgcacttattgtctctagaattaaatgctgagggcaggggctgtaaccttcaaatcaaattttgtgtcacaaacacactaaacattaaagaactgccatttacagtaacagataggcataatctgctgtaaggcactgaaaaagaagaaactccactaatgctgacctcgaagtactgaggcaatcctcagtcttctcctgggcaatagattatgtgagttctagtctaataactgttcacacgctgagaatagaatatcaactcctggctgggcgtggtggttcatacttgtaatgccagcagtttgggaggctgaggcggaaggatcacttgaagtaaggagttcaagaccagcatgggcaacataccaagaccccgtctctacaaataacaaaaatttaggaaggcatggttatgcacacctgtagtctcagttgctcaggaggctaaggtgggaggactgcttgagcccaggaagccgaggctgcagtgagcctccagcctgggcaacacagcaagactgtatctcaaaaaatataaataaataaaacttactctgctggctgatttcatctttgatatgtaaaagagaacacgtgcagacctttttcatcagtttgtatcattatggagggttatcacttatgcttcagcattttgattagactaaacaaatcatgtaagaaagattacattctatcgacttaggtaaatgtaaatgaaaacaacaacagaaattattcttcttaagaaacttatttcagcagcacctaactctgggttatggtgataacttgaaatatatttctaagctgaaatcccggcatgagggacaaaaaattatatagagctaaaggaagtgaacctgtagtaaatatatatcagagtaatgacgaagaatgcagcttccgctcacaggtacttctaagtcctgcaatcagataagccttacagaggcttttaaaatcatggacaagactaataaagaatggccattctcaatggttttggaatactttgtgtaaccttgctgaaccttgaattctcattattgtttccctcatagagaaatgtttgatattctgtcttatgtgaagggcagaaaactgaaaaggagtctccaacaatgaagtcagttttcgctgctgaagaatgacctcactgcttcatgaggctgagagaagggaggaagggatcttcttgaagtcctccagaagttgcaccgagtggggttacataaagtatcctggagtctttattaactagattttcatccacaccatttcctaatttcatgccatgcaccctgagtgcaactttgtacaagaatggattttgagcaaggtgtgatagtctcacagggctcttccagtccagtgaaatgagtcaaaagtgagcttccttttaccctcaatagacaaaacctcctaccaccctctccccttccccttacggttcctagtcctgggatcccctgtctccccaccaacccagcttccttcccttttcaggcccaccatctgtgttcatctggcttcttttatcccatcaaaagcaattagtcttagctcctttactgtcagtgatctgcttggttgaccaaagctaatctgatggaggaatatgcagtgttactgttggagtacgtttgtctttgccatttatttcactaattcttattgcagacttactctgtgctattttcaacggggtatcaaaatgaataaggaataatttatttccagaatgcattttgtcctctagatctaaatatatgttctctctctgttaacatatttgtatttccaaggcccttaaggccagcagcagtggctcacgcctgctatcccagctactccagaggctgaagtgggataatcacttgagaccaggagttcaaaaccagcttgggcagcaaagcaaaactgtgtctctacaaaaaacatttaaaaattagccgggtaaggtggcatgagcctatagtcccagctacttgggagtctatgaggtgggaggatcacttgagctaaggggtttgaggctgcagtcaactatgattgtgccactgtactccagcctgggtgacagagcaagaccctgcctcaaaaataaataaattaaattaaattaaagacccttaatttcgtagagccttaaaccaaaggaacaaagagtatttcaaatttcagacagagctaatatttctgaaaattttatttagaaaagttcattactggtaggcaaacaggatttttgaaaaacacaaagcttgttttcaaaatcacctgttgattgaaatccactcaatgttttcattatttttagaagcttatttctgcctgctcatggtttagtggaaaggacactgaactaggagtcaaaacaggcaggctctggtctctgctgccaggtttgtggctgccaaagctcccagccattcattcattctaagacctcacatcttacaggaaaagcaggacaaagtggccttccatgttgcttctccagttaaaatgctaggattctaaacaattgtttgatgacactggtctctcaagtcaattggcatctccaatgatccattaccttcctccatttctaactcaatttcactgtattaatctgtttttatgctgctaataaaaacataccagagactgggtaatttacaaaggaaagaggtttaattgactcaaagttctgcaggtctggggaggcctcaggaaacttacaatcatagtggaaggggaagcaaatatgtccttttcacacagctggagaaaggagcagattgagtgcccagtgaagggggaagccccttatgaaaccatcagctctcgtgagaactaactcactatcatgagaacaggataggggaaactgcccccatgattcgattatctccacctagtccctcccataagacttggggattatgggaactacaattcaagatgagatttgggttgggacacagccaaaccatattagtcactttactttccctcaagacctttgttttattcctcagcagagtcattgattgtggccctagactcaatccctcctatcagtgactcttgaaatggtgataatggaaactccaccaaagccccttccaccttcctcttctgacatcctcaggagcagcagtgaccctgaactgcacttataggccacatttctttttttttactgctccttcttccaggcaaactttaaaaaaaataaatttaatcaagtgatataatgctgctaaaaactgcaatgtctctaaggtttttaaggataaatcatattgaaccctcagaatggctgacaactgagcccttccttaagctacattaacaacttaagcagaaaagaaatcacttcaactttccatacataattgtaacagacctagagagagagagagagagagagagagagagagagagaaagagagagaagcaattcatacaccattaccacactggtttaaaggtggaggggaagtcgggggagtaggaggctgtcattggtggcggagattttagaggccttataagactcattaaaagagggataaaggaaaagaaaatccaggattccaaattagccaacttttcatgcttaccctctgccttctccaagtcccatttgctgatttcaagcctgtcagaggcatcagttgaaggcttcaagcttgagataataatggatttaaaatggcaggctacgtggtctttctgcctggtgatgaaagcagaaacttctctcatgggctgaactcactgaggttgtgacttcatctgtccctgcaactgcaggaggccacagcctccattctgaacagtgattcctgtagagttgcaggattttataggtgaggaaacagaggtctagaaaagtaaagtaaattttccaagattatagaacttgttagagacagacccaggataagaattcagatctcttccgctccatctggttcctcctgtatcataatggttttctgtctcagagagcccacgggaaagactttctcctttatggaggacagtgaaatggggaccccaacaccggttatctttagaccattgttcaatggactttaccatttggtctttaaaattctcattccctaaattgtctaaagttttggaaagtaaatcactcctctgatattagttattctttggagcttcttcaatttgcataagaaaacacagataagttatgtgagaactgatcataatttcagtcatcatgatctcaacttcctacccccacattgacaagtgaagggcctgacatctaatcattgaaattctgagtggaaacccaggaaatgtttcatctatctgcattttactttcttcatgtctagagatagataatacttaagcaactttatggggatttttaaagccctttctactaacttccagatgggaaatagaatgttttataaaaacactcaaattcagtaggcactgtcagggtgaagctaatatgaaaataactacttgtaagaaaatgaacatggagctccaatagtggcagaaaataatgtgtacaatgtggataataaataataccattaaattcttgtatcattcctgctttctgtcaagataaaaaatgtgatatttattgcttggcccgtaattacttttatgcttgaaacaggaaggaatggagttgatgatacaggaaggtattagtcaagtgtctttttctatgggggtgggggacagggagggtttttatttaaaggcaaagcgagttcttctcatcagcatctcctttctaccaaccacctaagacagaaagggtttttgccatttcagctattagaagtgattgattctctgtcatacctttccgagctgtgtggttgtgaatataaaagaggaaagagggaaggagagagtgaccaatattaaggacaggcatgaagaacaagggatagattattagcttagagtaataatgatgaatttctcaaaacaacattttttgcctggttatatagattatttgctattaccccagaaactcagatcttgatttcaatcaggatttcaacctccatctgctcccattccaactctagtccatcttcttcaccttatatgctttgaagaaaatcttttgaaataatttcaccaagaagattagttcttttccagataacagctgcatgcactattttggaaagaactttgataccatcttcaaacatttgaatcctgaaacaactgaagcaaagctccagaggtagatacaaccagcagtctcacaaaaatcagcttctttacctacagcacaggctcaatgaaaatcaaaatctgtcctccatgagtttccaggctaaaaataaggtacttgcagcttcagcacctgagggcttaaatcacattttatattccataaatgtggccacattgtctcttttcccttttgttctttttcatttctgacagaaaccatttgaagttttatttcaaatcacctggctgtcggcataacaaaccttagatttagatttgcgattgtttaggggcgtgtgtgtgtttgtgtgtgcattcgtgtgagcgtttaattaaacggatgtgaaatgctgtctgagccgaaggcagtaatttttcttttattcatttaatgttgcgcagattatggcaagcttttcatttgtataatctgtcatataataccactgccttttaagcatgctggtctagtcaaagcattcatttagatgggaataaaagtttaattactttctttcacctttaaacatttgttacaaattaatgtggtgtctctaagacactgccttgaatgaacaagattcccattttagtccggggtctggttctaaggagctgtgtatgactctggataagtcactgtctgcaatagtcaggataggctaactgctaccaaaaaaaccttgcagttggattctatttcttattcaagtaagacttaaatttggatggtaagatgaggcacatattacctctgacataagtaagggaattttgtcgagcatcacttatgagtgctttggtaaaacaataggagagtaagctgaaagtgcagtattagaggattggctcctctgtcctagttgtatgcaagtcaaacacaatttagcagggagcttataaagcaattatatacaaggcagcccgtgcaacaccgagccatgggaaagaccgccagcatcttggcctcaaaaaccagaaccaggcatttgtgtgacatcaggattttcatcctctggctgctccctctgcaggacggattcatttcctctcactgtgggtcaacgttttccactacgttattatgtagagacatggtggtgatggcttgatttatgtatcatcaatctccatcttctgtgaaagaatggacttgactgtgggatcaccattccctgcatcatgcgaagagattggattctgatatggttgagtgtggttcaccaaagccatcaatactagccaagacacagggttgccctatagtcacataagggatgttggaggaggtatatgagtggaggggaaggtagcatcgttttattctttcccatctgaattaccatcttcctgacagaatgccaaaggtaaccagtgtgaaaattgtcggaatcaaaatgaagtcacttgtgtcaaactctgacaaaacaggttcagagaaggccatgaagtgagtgttctcatgcatgatttgcctggtaacagggacttccacaagaaattttcccaaaccatagctttctacaggagtcacacaagggctgccagccccacaaggctaggcagatgcttatgcagaacactcgcccaacaccccatctcacaaaccctcttccaaactgcaagggcctaaccttcactctaagatcacaggttctattgagcaattcctaatgtttgacaatcagaactctccagctcttgtgagacactgtgagcaccaataagtttgatttcaaaacagctttcataacctcctctttccccaataaaccctaactttttactttgttcccaggctggcagtggcacaaacatgtgtcactgcagccccaaactcctgagctcaagtgatcctcctgcctcagcctcctgtgtagctgggattgcatgcacacaccaccataccccgctaatttttttatgtttagtagagatgaagtctccctttgttccccaggctgctatcgaacttctgggctcaagtgatcctcctaccttggcctcacaaagtattggaattaaaagagtgagccaccaggtccggtccctggtctatatgtatatcctgggttacaatcctacattttatatattatttttgaatgaaatttgttacttagagattaatttctcttgattttttatgttgacatcagtaccctatggttgtgccctcaataggaagtatcctatactatcaccattatctttcttcctctcatatcaaatgtgtcttttctttgacctatttcctcatatctatgttctctgctaggttaatctgataaatgaatccctgctgaagggtttatgagtaattgtgatttaaggagttaatcttctcatgggtgcatttcacacaagtctccaatatctttaattgtagaggaatgttcagtgtttactgggcacttattatatgcaaaggcactgtattaggccattctgtcattgctataaagaaatacctgagactgggtaaattataaagaaaaaaggctttattcgctcatgaatctgcaggctgtacaggaagcatgctgttggcatctgctcagcttctggggaagcctcaggaaacttacaatcctggcagaaagccatgggggagcagacacataacatagccacagcaggagcaggagagatcatcaggggagatgtcacagacttttaaatgaccagatgtcaagaaaattcactcattatcatgaggacagcatcaaagagatggggttaaagcactcatgagaaatccacccccatgatccagtaacttcacaccaggccccacctccaacattggggattaccattcaacatgagatttgtgaggggacacagatccaaaccgtatcaggcactgtgctagatgacataggtaataccatgtcaattgaaaaatggctctgctggcatgggaatgaaacttgttgcttctggcattcaattgctaaaaagttcacctttaccacctgagaggtattatctttggacaagttagttacattttttagaatggtgggaataatagtaactacctcatagacttgtttgtgaaagttaaatgatatggagagatatgtacagtgcatattagtacagcaactggctcattgtaaagggccaatgcttcttatcttttaaatacttaagcacatatagattttctcttcttaagaggatggatttaatctatctttttaagccatatttctaaagtgaccttttgtgttactgcctgttagaaaaatcacttaccaccaaagacacatttcaccagcttgaaaaatttaacttagcactgtggaaacattttgttcatattcccttggtctttaatttgaaattttcatctgtagcctgtagtttgtttgtgaatggttttgggaatgttctttggacaattaaagctactaggacatctacaaaatctgtgtaccagtgtccctggctccccctcctcatctctctctctctctctgtctctctctctctcactccctacctccctccaccccccccccgtctcccttcctctcactaagttctatttcaagtggtactctcttccttacacactaattccaaaattatgattgttagctaatccattcaagtgtaatttgaggacaaatgcagacaacattttctgttaagtttgatcttttctgtaccaacatggctagaataaaaagaaaatcaataaggaaaatgaagacttcctacactgaagtgaatcttgggagacaatttctttttttctctctcgtgggttctgagctctgttttaaccatactaagagaagtatttcacggacgacttctgctctcagttccatgctattttttgattggtagcaaactatatcctgacaatagaccctcctactagtcctaagtaaatgctaacatttatggatcatcaattctatgtaatgccctctatatagttctcttgacaacacagtcacatttattattaacccctaagactcagaatgatgaaggaatttgcccaaagttgcacagccagtgagtataagagctgacatttggaactgggttagcttaaatctaaaggactttctctttctcttctaccatctttactattcaatattatattagcctaatattccagaaagaaaaaacaaacaaactgctaaataatttattaaataagaacaggggatagatctacataccttggttatctacttattttaataatttttggcttaaaatgaggattcttttcttgtttctggacattattaaagtgagacaaacaatagaactgtgaatgaccacatatacccctagaacatacgttttcttcaaagagaaagatcttatgaggtctgagttctcatatgtataagcaaacctattccttagaagtgcattggtagagaaccagggatctatcaacacaagtgtcccactgagtttgtgcatgccactttgtataaaaacagtgataaaattaatagcaccaatctcataagcttgtaagaaacaaatgagtgaatatatttgcagagtaattagaacagtacgttgttcctaataaatactcataaaatattaactatttcaattattagaaatgcaagaaaggtgtctttgtgttttctggttgaatttgcccttttggcagccacagatttaaagaatctatagtttttgaagctgcaataatttaatcttatttggatttcttccctgtcatccaaattagccaattcactatggtatttgagatttgaatataccccccaattttttttcaacaatctaattctaaactccaggcctccttttcatttgcctgttttgagaagtccaagtatttaggaacatctctttaaaattactaagagtaatttatttcctttttcaaacatttctttcaccatgtacatcttagagattaaatgaaaaaaactattacttttaacaaagatgtccttgaatacctcatctactcatttcatatataatggagataatttttgtgtgtaaactcaggcacaactaaagaaagcaaacatacttattgaggtttaaatattttacttcattttcatgcaaattaatttcttcaaattcttaaactttctcaggcttaggtattggttcaacccatgggagtgaagtgttgacacaagaatgcaaatattgtagaggtgcgtgccagcctggcgcatgtggctgcaaggctgtattccttttccttttgggctcacacagttggccaccttccggctgtcacctgcaatcctgggagtggtgctttccaccttacaacatttgctatttaatctaccaagggtaggtgagactgagattttacctggccagggaaacttacattccctctattgctgtactacccgccacccccggccctactcgcagatttactctgattttgaggcaaagactcaacaccaaaaaatgcatagacacaactttcatcttctgatggagtatttccagcagttttttttttaaaccaaggttacgtgcatacataaagagtctactagttctacaggtttgttaaacagcctgtccagattcccttcctgatattttctaagaaatgctgaggttaatgttggaactctaacagtgacgacttagggtccagatctggctctgacactgtctgctgtgtatgttgcctcaaggtcctcatcagcaaaatggggataataacacctccccatgagatcgttttgaagaaaaataaatgagtaaattatcaaaaaaatctgaaatgtatgatcatgtattactaaaattatttagctttaaaattatatttatttcattaaatattaaatatcttattaaattattataaaatgtattgttactttccagaggatccatttgatatttcctaccatatcactaacatgcttaaatagtgttttagtcaactttcagcgtcagggatttcgttttatcaaagaggaggcttttgctcattccccacttttgccccgccatatccactcacccacccatatgcaacgcttaataccaacccagctgcacaccacacaaacacttgcacttgcacatgcactcacttccacccctaatcctcctaatagagttgtatcataattttgattagaacaatactcactatttacattactatgactcttcactaatctttatttactttttcattctaaattgtatttgcttaattacctaagtacctcaccccaaattatttgccagttccctaaatctccttttgcaacattagttgtcaccaggaaggagtctattaatgtcatagtcttagctcaggctactataacaaattaccaaatactatatggtgtaaacaacgaacatgtacttctctaagttctcgtgtctgggaagtccaagatcaaagtgctggcagatgcagtgtctgatgagagctgtttctgttttagcagatggccttcttgtatcctcacatggtagaaagggagcaagaaagctctctggggtcccttttataaggacactaattccatttatgaggtttccaccttgcacaatttagtgacctctcaaaagctctacctcttaatcccatcacatttggggtagaatttcaatatatgaatcttggaactacatagattctcaatccaaaacagccttcttgaagatttatcttccagagccaattcttaacttgctgcagttattttgtgatctctcttcacctccatcctaatgattctctttacccctttcgtatgttggatgtctcattttccatatccccttgtattagggctgctgtcctagggctgctttaacagattatgataagcttggggactaacaataattgaaatgtatttattttcagctatggaaaccagcagtctcaaatggaggtgatagtatgctctccctcgaaggctcctgggataatcctcctttgcctcttccagcttttggtgactccagacatgctttggcttgctgttatataactctaacctctggctccctcttcatatggccttctctcctgtatctctgcgaaatccgcctctgccttcctctaataaggatgtgtgtcattggatttagggtagcccctaaatccaggatgacctcatctcaagattcttaattacatatgcaatgactgttttccaaataagatcgctttcacaggtctagggtggacatatctgttggagggccatgcagccaactatatctttagcttctattctcattttacttcttcagtttattatacttcagagaaagtagaacactttctccaatagttggagaaaaatttaccttgcacttttttaatgaaaaaaatgcaaggtaaattttctgaaacatcacatgtccaaaatgtccttattttacttataaatattattaacaatttgtcttgaaatagacttctaggttgtaaatcatacttcttgaacgttttgaaggcattatattcttgtctagcttaaactagtctaagcaattttcatgtcagaccctttttatgtgatcttttccctctctggagtcttgtaaattctttttgcctcagttcatcagtctttttagaatcatgtaagtacttttaatctaactgtactaggcttttcctgggtttctcaatctggaaaaccatgcttttcagttctgtgaaatttttttcaatttattgatgattttctctgttgttctgatctctctttctggagatcctattcttcgaatgttggattttctagtattgttctgcttttattatcttttctcacctgtttactattctttgatctttgtgcactactttctgagagatctcttaagttcattttctagctatttctgctaccatatgtttttaatatctaagagctctttctgttctctgaatgttccatttttgtagcattatgctctgggaaaaaataatattgatttaaattttattttgttttgacttttcttccccaccttaaacttatgtgaatgggctaggaaataggaatcaagaagccaaccttatgaccatgtaccttctggcaatgggactttttctttttgtttaaaactgcattctattttcaccatcctgctcaaaggtaatttatcaagaccatcctactcagtctgcccattcttagagtacagtagagctttgtctgagtctcatttagattcagggcagagagacatttgcttttggttggtcatacctcctctggccattattttccattttattatatctgttttgcctgaagggagaggcggaaactgtgataagccccaatccctacttcaggaggaactctatcattcttattattttcccattcagcattccttgatcagcttctgattttgtatgatttagtagaaaaatcaatgaactgtgaatcagacacatggaaactggtgaaattctgttattaataatctttgaggctggagtgcaagtaatttagctcctctaggtctcagttttcctcatctgtaagatataaggagttgtactaaactggaagtttctgagctcagctaggtactagttcttctatagaagtgcccaaacagattgctaccaagagcaaaaagaaattgagtggcttgctgcacctatcaaaccaccatggcacaagaatacctgtgtatcaaacctgcacatctctcccagaacttatagtaaaattttttaaaaaggaaaaaaaaaaaaagaaattgagtggctctcactcccttctctctccagtcacagaaggacacttttatctgtttctacctaagtgcctaaaacttttgttgtctgattgatatttttctggagaccaggctttcctgtccaagaaattgttttaaaatcatccggtcttagtggtttcaatgtttctgtctctaaattctgtgaattgatatgatacttttgtcttcttgcctttaagacttggagcatgaaggacctacatgatgactgctgatctatagcatttatgagtacactaacaatctctttcataacatgacatgtggtttcttctgtagttctcgaactggactgtgtatggtgctgcagagtcttggcaaacagcttaaattaataaagaaatatggaacagccaggaggtcccacactgaaggcttcaaaaagattattatggttctgacagcatagaaattgttcttaacttcttaaaaaccatagaatacctcagcaggcagatacttgcagattaataatcactttacagcactgttggagatcagttatccatcatcgcaatatggactatatcgccggagagaattttaggaggtttgaatgcagaatgcacggcaaatacagcactaaaagagttatttcttccatcttatgaaatgtattttagtctagcagataaattgtgttattagacatttttatgcactgtctggctgtgtactggcatcaacagcttttatccactccccaccccaattacaaaatacaggagagcaaatggcaactcttcttgagtaccaggagacctgttgtacacgtattatgagtgtttcatttggtatattttattatattccagtgtaatttccagaataaattaaggtgttaacaaataactagagttcaaagggcagaaaacattgtttcaatgacagaaagagaatatggttaaacatgcaaagcaacctcttttaaattcaaagaataattcaacagtggaatatgatctgtgaaattaatcaaaaataaaataatttttatttgaaaaacaactatatttttagatcataaatatcatataatttttatgataaaaaaagcatgcagaaaagaaaacaaagacactggtatgtttctatcctttcccagctgatatttatttattttgttttattttagttttagagacagggtcttgttctgtcacttgacagacagcattcgtgcagtcatagctcactgtaaccttgaattcctagtctcaagagattctcccaccgcagcctcctgagtagcgatatttattttatcgccttatttttcaagattatagatacagtttagatcacagtattttaaactttagtgagcatcagtatcacctgcaagacttactaaagccagatgaagagcatcccatggttactgattcagaaccctggccagcgtttagaaacaggtcttcaagagggtccagtttataacatgatccaactaatgccgtaatgtttactgaccagccatttgagtagtagggatagagttcagggatatagattcctgaacagctagacctgatatacaccttatagcctccaactgatttcacaaaatagaaagcagcttatttataccaactagtcaaatgaattcatattacttgctgtaacagattgtgtgatagcaaagaaacaaacaatcactgaagagatttgtttctcttttaatcaacaaagatggataatctagttatgctgctgtacaaagcaggaataacacttatggccctggaaaatttctccctggctcattttctttcatcgccatgttttactcatcgtaaagatagaatacgaaccacaaatctgcgagtcttatatctgttaattattgactaagagaaagctttatggcaaatggtgggtttcagctttaataaataatggggttgattctgcccaatgacagatgtgtgtaattctcattaaaatcagtggcagctacacaagtgaatcaaagcaaaatggtgtcttttacagaacgttctgattttgtaaattattcactatctctcaaacatatgagacatatgctattgttctctgtagggaacaagaaaaactcttttaggcagaatgtagtttcaaattttagacttagaatgtgcaactaagaaaagatataaaatgtttttacccacagcctttaaataaaactgagttaataatcgtttttgaagatgcttccagatacggtggaatgggaagtgttgaaaatgcttccaatgctgtggactgggagggttggtggatgaagatacctgcttatctctggattttgcaaatataaggttagtctagcagtctttgccaaactgtggcaacaatcaatagtatcacaaccagtgactaagaaatataaagggcacctcattatcgtaaaacacagatgcaactagaagggctcaaagtgttgaaaattaagcaatgagttaggaggctgttaaactgaactctggtctttgttctatcattgagatactcagtacctagaagtgcttcagttaacacatctataaaatcgagaaaatactatctgctcattttgcctccctgggatgctgtgattaacaataatgaaaaacttgaaataacgaaaagcactaaattaattagaagaataaacgttagaggaagtagaccgggcacggtggctcacgcctgtaatcccagcactttaggaggctgaggcgggtggattacctgaggtcaggagttcaagattagcctggccaacatggtgaaattccgtctttactagaaatacaaaaattagccaggtgtgctggtgtatgcctgcagtcccagctactggggaggctgaggcataaggatggtttgaattcatgaggcggaggttgcaatgagtttagattgtgccgctgcactccagtctgggtgacagagtgagactccacctcaaaaaaaaaaaaaaaaaaaaaaaaaattggaggaagcacactaatgcccactgtagcagctccttgacaaatacataaacctagactctctgattaacaggataatcgggatgagtctccttcaagatgttcaatctaatgcctgagatctttcctaagccacagatttatgcactaagaaagatgatggcaaagcatgtcatatgatcaattgttcccatcccaatcaaatgttcccttaattcttggtcagcaatacatctgcataggtttgggaagaaaaagaaagaagcactttaaaaggaaagaaacaaaatgatgttttgtgtttattcttggttggttcgttccaccactgttttgttttcccagaattattcctcattttttgcagactcttctttgattagctatgtttcttaaaatgctccaatagtctttaattgtctgtagttccaaatataaattttaactggaaattgttgattaaatacaatttaattgaaaaaccttcctactttaatgaacttatagcacttgagaagaatgtggaaacaacgtaactgggttttttcctccaatattaatgtgcttgtgtataccattaggataggataggatagatctgaggtaggactgtatgatgaggaaatagaatattcagtggattgagcacttgcattagtgtaggaaaatctgcaggtagaaaggagagagaaaatgcataaatgaaactagatctgaccgctgctttgtcatttctctagagatcttcttgtgaactggcattgaattgacattgactgctctctaatttgtgggaccttccaagcttattctaaaatgctgtaaaagtctcaccccatagacaccaagacttgattatttaaatgcaacgtttcaagctacattgaaaccacctgccacatcttgctgtttctaggcaggaggcatctataagactgttttattaaagcaagatactagggatcaaataagttcattgtgttctctgcatgccctaaatgtgaaaagaatatccaccataaatttgatgtcagagatttggttcaatatagagcaaatttgggaaggaggagttttgcaacataacttcaacaaaccacctttccccgcctcttcccccttcttctcttcactctttttcttcatcatcttttttagagttatggtccttgtggtatcatgattaaagtttcctgatacacacatcgatctcctactctctgtcaaccctttattaaaatgtttctcaaacattaatgtgagcacgaatcctctattcagtgtgtactgaatctgaaattgcaaattctgattcagtaagtttgaggtaggaagagaacctgcatgtaaactggctcctagatgatactggtgctgctggtccaggaagctctccgtagtcaactttaggaaaagtatagatttagattcctaccaactttctggctacatagttgtctcaaaaagatctgaaggcaaagattcatattttaacctgacctcagttttctacaattattattacacactacagaggttttgctgcataatgaagtatgattttgatagtaaacctagaggacttagagattgctaaaggcaaaataaaaccaaacacacagagggagatagaaataaatgttatatgctgagatctcaaaaacgtgagaggtaaatctttctgttgaattagaaagattgattctcagtagccggtggcttggagaggggaagcaataatttctggccttgattctactcactgctgccaggagacctttgctttgttgctattttatccacaatggatagatatttgtgttaagtccccacattgtttaaaatgcaaaagatggtgcttccctcactctcccccaggtgaagatcagatttgcctatcactgtcctagacaggactcacagaacatagaagcttcacctgggaatgaaatctctttcatctgaatttgctgggttgacaagtctaagacccgacaccactcatcaccctgatctgacctcatctgagcccattatctttaattttatatgcagcttctacagtaaatatgaagtggaatgttcctctttttacaaacatttattgtgagtagcataaacattttgacactgtattattttataagttttctgatgcatacaattagtgtagatataaatcaaaatgatggcagtccttctacggttttttgaagttcccaggagagctgttgggctctttaattgcttactaatgtaaaaatatcattgttagtaaagcataaatcatggcaattttgccccactagaggctaaaagcagcacaagatgtggtaattaagatatactaatagacctggcaatttctataataggagcttttaacaaggtaggaaaagaatgtcatctcttatgctgcagtgaggcaacaaataaaataggaagttttcctcttgcaaaagagatgaccctgcttaagaaacaatagccagaaagcaggtaagaaagtgtttttttctttcttattcacttgttttcctagtcacatggcagcttatgaatataaccttagggtgagaattagctttgtaaattttaaagatgagaaggatctttggaacctactttctttgttttcatgacggggaaactgagactaagacaaataaaatagctggttttaactaattgggagcagagctgggactagaaaccaggcacttgcttccccgtgaagggcgctttctgttttgttagctttgtatgtcaccaaagaccttcaaacgttttcaaatcttgaatattctttttcctattttgtagtccccctcctttttctgtgatgtttggtgtatctcctttgaagaatccttgaagttgggcatcattggtaacatttggattgcatagtaggaaattatttgttttggggtattagggacagcaaagaccccacctcttgtgagggataagaaaaagaatatgtctccagaccaatgctaaagcttacctatggcttctaaagtgaaacaagagtctgtgttaaaataaggagttgtgcttttcagacacgatgttcaggagctgtatgcaacaacaaaaacaatcaatttcttctttgacacaggtttaaacccaattagcattaattagaagtaaatacacacagaaggggggcccacattgcaaaggcaagcaacttcagttccatttaacacctcttcactcttatatggagccttccatcaaaggctttcaagatgttttcagacctagaatgttcttttcttattttactaagttttttcctcttttctctttatcttaccccatttattcattgatccattaagctagaacacctgcaatatgttgtatgtcatgctctctactaggtaatagggatagaagatgatcaaaacctctattttatcctccctgatggaatttgcagtctaatggaggagaaatacaggaatcaaacatgcaaacaaacacatatataattgcaaactgtggtatgatacataaaagtaaagttggttgcttaattttttatggggtgacctggacataatatgtgagctagggaagaattatcttaggagatagggagaagagcatgtgaaaagtgtgagtgattggcaaggtcagtatgtttattttatttttcaaaataaaaagtttttaaaaaatagatttctccagatactcccagagaatgcattatcatggcgtaagcccagagagcattgaagaaggcatttcaatagtgctggtgaaagagggtagtggccagaattttggtggtgacaatgaagacagaaaaatggagggagaggagatgtattttgtagatacaattgattggacttagctgaaacatttgatgtatgcaatatgggagaagggaaactcacgaatgcttaggaagtttacttgagtagctggtttgtttacaacgttgatgtgtattaatttaaggatggccagggaagattgggttagtggaaactgggatgtttggggtgtatctgaggtacataggtgatgattcctgtctggagcgcagaggagtggtcttctaggggtggtgtgacataaattggataataggatatgatgagacaaaaaatatgtgtccctaataccatgtcctggggaaatcagtgattagatgttaggggaaatatcaagggccacggatatagcatgaagaccaggaaagaaccgtcgtttacttcaaggggggaagtaatttcacaaatgagagggtggtgaaatatataaatatttctgagagtttgagtaggaaatttgcattcattagatttagcaacacaacatcttgattgccttgataagaaacttggggggtagtgggactggtgaacatttgagagaagacattaagtagacgattctcgagaaggaaacagggaaagatagtcacaactggagatagatgtagaattaaaatagttattttaagaaaaccagggtactctacaatattgataagagtggtcaacgaaggtgtgggagacatgatggagagataagatcactaaaggaacaaggttcttgagagaaaaagatgagatgtggagtgagtggccttaaatagaagcaggggtggtttcttcattgagacaggagaaagaagaaggatgtttttgcaggtaggtgtgagttttgttggttggaagatgaaatgatttgagtttcatgatttctccttgctgaagtgtgaaaggaactataagaaaaatagggaagtggatatggggcaagtttaataggaagaaaaaaaaagacataatactttgccataagaactgagcaactgagacttccccaacacgaaagctgtgttgccccgcagtgtgtgtgatttttctccagaaatgttcagctactcaggtgagactcattaacgaaggtacaaggtagagtatgtacacccaggatttggcttttgccagacatggatttctgtaaaagaagagaggagcatgacagttgatggtatttgcaaagttgttactatgatagccaatcatatgatagcgggcagtcagggttcacttaagaccataatgtgaaggggcatgttgagataaagttgaagacataggctcatttgctgcctatccagtggcaattgcagagcatgcagaagagggtgtgaaagaggaaaagaaaggatgcagatatacataaatgtgtcagattagaagataaaccaaaccatagggaatggccaaggaaagtatgacttccagcaaatggctgagatacacaaaaatcctgatgggtgtttggagaaaaggatgtgtacattttccagggagtgatagaaattccagaatggctgctcctcccagacttcagggctagcaccttacatttacatgagctcacaggaagattagaggattgactctggcaagtaacatgaccagagtcaaagaagtctgcaggacggttgttttgtaaactcatctttttttcaataaaaagcactagtccacaaaatacaagaaaaattaaaaaacccaaagaaacaattgaattctcttttctagattggcttatattcctggaaactcttcaaacagaaaagtgaaagttctgatattattataatcgtaatagtttatgttggcaatatttgcatggtgaatcattttcaatcctcaaaatgcccaggtttctgtgtccttaatgttatattggggttcatatatattattttatttgttttctatttgcctcaatgatttcagtgctcccatttcatttcatacctttttaaaattaatcattttataacttcgagttttctccctattaacttgttagtgaccgattaatttatgattttttgtggataccttagagatattaacatgggactttgatttattacaatcacattgaaattattactgtcagtaatggtagaatctgagaatactttactgcatttacccttttttgtcctctgatatgtgttatgtactttaattctaaatatactttaaaggccataaaacactaatttcccttgaaatataatcacatatttattctttctgtttctcatcattccatctggcattttcttgtttccttctgcttaaagaactgtttttagaatttccttcagtgcaggtttgttaatgacaaattctcttgctttctgtttttgttaaaatgggttattttgccttcacttttgatggctatttttgctgggtatagaattctaagttggaatttattttctttgattttcctcatttctgttgagaggtcaactattatttctcctttgagaaaaatgcctgttttctctgtttttaatatggttttcttggttttagattttagcagtttgattatgatatggtatggtttgtgatgtgtgtgtgtgtgtgtgtgtgtgtgtgtctgtgcctgtgtgcataggtgtgtgttggtgtttatcttgcctggagttcacttagattctcggatgtgagagttgatgtcattaatcagtttggaaagtcctcagccattatgtcttcaaagattgcttttgcctcattttctttctcctaatagtattccaattacctgtatattagatatttatactgtattccaacatcttttatgtactttccgatatttttcattttcaattaatgactgggcttttttattgacttccttcattttactaatcctgttttatgcaatgtctaattgtctgataagcttatatattatgttcttaatattagttattatgttttagagcttcagcattttcattggattctttttataaattccagttctatgatgaaattattcattctttgcatctgtttgctccagcttgcttttcttgtatgtatttgataaactcttcgtcttctaattaaaatacctggctcactgtggatctatttgtgtttgtgttgtttttattttaaaaattgcatgttagtaatattatcctgtatcttgtcacacctagtaatttttttattgaatttatttactatgtataaaaatttagattattgagcatccactgtcttccttcactcttttctctactaggaagataaagtgggagctcactaatttaacccaataagggactgagctgaatcaaggctggattatatttctctcattcacctttgtttctaggatggagtcctcaatggctttcaaccaagagcctactaagatcaactgggcccctcccctgatgggtctcacactttaatccttgtctccgtcaccaaaggactgtcagaaaactccattctgcttctcagaggctttgtaattagctttttatcctctcgtgtagcttcagaatctggcatgtgtgttgagaaaactggcagtatttggttttcatttccctcttttaagtgggatcctgacagttcaagtcttcgtttttgtctctgcagggccacaaaaatatttcttcttgtttctctatccccacccatagtctctgcccaagtgaaggttggattcttaagttcatttcatgcaccaagaattgtcaaatgccccaagagagaagtttctttagaatatcaccccagctttatgaagttcttcctttctctgaaatcttcaccccttagttctcactgcttcagcaaaaatctgatgtctttaagcaaattttggcaagtacttcctacttttctagttcatcttggcagaaaccatggtttgctatataggctactccatcttgcccgaaacagcagaaatttcaaacaatgtcattttacaaagtaaatcatcttaagggtgtttgtctttcaattgagtgagcttgagaagctgtaaaggctttgaattctggctgcattttttatttattttatttttttatttatgtattttttttttttagcaatttggagtgttgtgatgcattgttctgagacaatattattagcagctaagaatggtggctttgacatcagggaattctaaccctggctgtccgatgcaatcttggccaaagaattagatctctgtagacttcatttttaccatctatcaaatggggaagaaaaccctgctttctatgtttataaggaggattagatgatcaaatatttattgattacttactttagctatactaaatgccttacatatattatctaattttaatatgctatgtaccatagtacacactaaggattcagtaagggatagcagtgttattacttatcctgattacaaaccacaccctattttggcttcaggtaaaatcacgaatccccccatggttcatttctcatcccctgcccttttaactacagaatatcgacaaggtaaatacaggccaaagataattttttagcttataatattcatattcatatttttgtgctgcagttagcaatcaagagtatgtacatcaataaaaacaacaaaaataaagcttaattattaataaccatgagcatcgggacaatgtagaaatatgaaacatgttttcccatgtacttttaaaaatagcatagctagttttatatgtgggttgaatatagtcaaaacatcagaaaagttattcaggataaagccttaaaatgccaggttttactttttggtgaaaatgacatgttggactgctgcctgatgaatttaaacctagacagttgcacatttgtagttcacaagttggggagcctgtagctttgggtctcagtagctcctggggtagtatttgcacttcatttctggccctgtatatctgatttgatgacatctgttaaggagacagtggagggaagacatgcatatgaaatttcagtgaacacagcctgcatttcaatgatctgaggctgctgttaccttgtcatttattttgtagcctttggggctttgacaggcaatacccaatctgtttctcatcagtttaaatctcaatatttacttttagatgttttattttaaaatctttaaaaaatagaagattgtgcttgtccatatcatacagaatttgcttctttcacatgaaaaaaaacagatttgaatagaatataatcaaggagaaaagagccactttacatataatgaaaaaaattatgaccaggcatggtggttcacacctgtaaatcacagcactttgggaagttaaggcaggagggtccctcaagcccagaagttcaagaccagcctggacaacatgacaagacttcatcccttacagaaaattaaaaaaaaataattagccgggcctggtggtgcacatctgtagtcccacatattcaggaagctgaggcaggaggagctcttgagcccaggaatttgaggctgcagttaactatgatggcgccactgctctccagcctgggtaacagagtgagaccctgtatcaaaaaaaaaaaaaaaaaaaaatatatatatatatatatatatatatatatatatacacacacacatatatatacacacgtatgcatatatatatacacacatatacatatgtgtatatatgtatacacacatatacatatgtgtatatatgtatacacacatatacacatacatataaagaggaacaacataagtttttttaaaaaagcagaactattaacaaactatgaatgctagttttgcttgatatagttttctttccacaatggtttgcaattgccaacacctaaactggaggatctttttcttttttattctaaccatcccctaacaagtgatttttaaattttaggatgaatcccaagagaattgctattagtagtaggtgctgcttatgtaatcgacaagatcattaaggcagatattcttctaaatgaaagtctagatcttatataacatggatcttgatatctccctcatcaaggggtggtctatacacagtagcagcagcatcaccacggggagcttgatagaaatgcacaatcaaaaactccaacccagatataaggcagcagaatctgcattgtaacaagatctccaggtgatccctatgcacatgaagttttgagaagcttgccagactagaacagggattgacatatttttgctacagagggtcagatagtaaacattttaggttttataggctattcagtctatcttgcaattactcagctttattgtgcaaacagcaccagagacaatacaaaaaggaataagtgtggctgtgctataataaaacttcacttatggacattgacatttgaattttgtataatttttacctgtcacaaaatgttcttctttttttccccaattatttaaaaatgtaaaatccattcttaactcaaaggccacacaagaacaggtggtgggccagacctagtttgctgactcctaatcaagattctatcattttcttgaccttgacctttcttgggttgcccttggtgcttgtcttaggctgcttgggctgccataagaaaataccacagactcagtgactaaaatgatggatactggccaggcacagtggctcatggctgtaatcccagcactttggggggccaaggtgggtggatcacttgaggtcatgagtttgagaccagcctggccaacatggtgaatacctgtctctactaaaaatacaaaaattagccgtgcatggtggcaggagcctgtaatcccagttactcaggaggctgaggtaggagaatcacttgagcccaggaggcagaagttgcagtgagccgagatcatgccactgcactccagcctgggacacagagcgagactctgtctcaaaaaaacaaaaaataacatataataaaataaaataatgaatatatattttttctcagagttttagagaccagtaagtctcatattcaggtgccagcacagtctggttctgatttcttttcctggcttgaaaaggctggcttcttgctgtgtcctcacaggatatagaaagaaacctctgatgtctcttcctcttgtaataaggccaccagatttataggattagagacccactctcatgaccttatttaaccttaattacttactttacttatgtaaggaccttatctcctgttaccttgagaattagggctttaatatgtgaactggagggtgaggaggcacagcgcagtccatagcagtgcccacatcttctctctgacatcttctctgaccgtaccacccggaatcattttcctgtccatgatgtcccattgtcactgttaactgcctgtcatctttgctgcttaaatttggccttatacatttatgacagcacattctgttccttcaaagaaactgcaagctccctgaatgcagatggtgctgatcaaggatctagtgacaagttcaaatgactgcgttgagcttagaagttaatgattgactgatagcaatgacgcagcctgactttttctgctcttgagtctcccagtttgttaaatgattacaggatccttatgcatccttttgggctattttctcatctctaaaatgggggaaatgtggatgtgaagatacatccagcttctctacggagggatgaaaattacctattagcggcctgttttgaagagccagtcctctgtagtatcaggcacttagaagtggcagccttatcttcactatttcatctactttttggatgcaataagaccaactatttcatttcctgatcttctgatggagtgtcctttcttcccttccatatgctttctcccatcatatttctatttggcagccatcattaacatgaggtccttgcttaacaaagacctttcagtgcattttatttacctttaatgtttcaacattattcactatccatcttaaatatgaggtcactgtgagttgattccctagagagccattctattattcctcccttctgtatattttctagtgtttttcctagtccctttttaatgactacccacacagagcttccttcatttgctgtggaaatgtttgcactagtgactcatggtgcaaacagatggggactcgggtaaggtcctcataaatcattctcaaggattatctatgtcacaatcacaatttaaagctttaggagagactgaatgaattagggataaatcctatatatcatctcatatgctttgcaggccgttggctgaaatcagcacggattaacacctttcccagcctccattcttctatagtcttaatatttttagctaggaccagggtccctgattttattacagttttagacatacagtgctgttctggaaacgttattttcactagtttttttttttttgctcacaccaaggagaaatgcaggtgacaggacacaagtgttcttgatgtgttacaaacatttgccacaaactggttgcaccctatatttcctggttgaagtgagctcttgtcaaatgcctgcaaacaatgcacctcaagtcaggggagcaaggacgcgtgtaaaggattcatgaatggcaaatgaagactgaacagaaacactttgagcagagctgttgattagcatcctgaaagagtgatctcttagggaggaattcacctcttgatatttcattgactctggacttatcatgtgtggaatcaggcagtcctgtaggatttaatttggaataagtgaaaaagaaacaattagaaccattgtaatacttgttgcagggaatgccaaacaagcttcctttgttgtacaattattttggcgctaataagtatgtctttatgccctctagattggtgtcttggatatttctctccctaccttgtctttccgtgtaaaaactttagatgaatacaattttctattaaaaattaacttgtatcatttgaaattagcatacattaacatttctttaaaactagagctctgcaaagctttttcataatgtctctctcatgagtgtgaaatgatttttgatttttttttaatccagctgcaaggagagaggataacaacatttctgcatttctgagttgtgtgacttagcctttttgattcttaatttcctcagctgcaaaatggggataaaatatttactccctaaggtattgaaatccttaagcaatgtacacaaagcatttgaccaagtaattgacacgtggacatataagatggtcaatattttttctttgttattattttgaatatttgaagtatgcacattaaaattatagtagtatccactggttataaaatgccacagattccctcaaataactgcgtaacattgagaggaaggaaaaaatcatctcttagtgagagcatctttatttgaaatcttcgcacgttggtaattttatattagagattttgctcatcagtttctgtacagccaagtgcatggctttacacgttgctgctgaaatgataagcaacagccgtcttattcctaaagactctcagcacaattttattaaagatggagcaggtatctggcacagaattggagtatagtaaatcgtgcaacaaatggtatgccagaatcaatttactgcaggcccccaatacagtcgctttctccttaccagtttccagcataaatctctgtgcacaccttatatgaatgtatcacaagtagctgaatgcctttacgttgtctctctaagcagaagtttatgccataaaggtaatgtgaaaaatagagaataactatcaagtttcagtcttcctgaattgtattcagggaaggggggagaagagggaatcacaggatatcagtgttgggtcagtgcttggtgattgctgctgacttttcaccgatgaggaaactgtatcacagagtacggaagtggcatgttggagaacgctacctgagaatgaaagagtcagaatttaagcccatgtcggtcacctctgaggtccctttctcttttctgtataatatattgctgtcaaaatttctgagtggatattttttctaattagttgttgcttagggcacatatactttcttctcctggagcatgtgatagaaaacagactaaggtatcttcatctactatgtgccatttgctttggatgcagtttctcattatctgtgggcagtctctggtatcctgattacacggatagtgcagttaaaaattaaaaatgttaattctgtctctccagggcccacagttcgtaaatgagaagggggcttaaaacttgtctcagatccactgattcttggggtaaagttaatggataaatagaagttctaaatatgagaaactgtgaaatcctgccttccagctctgcatttgcatgcatgattaaaagacacagcacctcagaaacttgaatttgtacttcatattgtatataagtttgtattatagatatatattccaatggataacttggttctaagcctttttgttttggtaaattagaattaaagaaattataaactagaagaggaataatgcagtaaataaagaaaaaaatgttcaatccacctctgcagggacaagaatattgactatatctcaaaggttatgagttataaataagaacatgttaattatttctgtttccttggggtggatgttcatttctaccagcctttcctacgaaactatgcatcttcaaatatctttgattctcgacactatttaacattttttccaaatatgcacattttcaggaaagatactgggtgatatccttgcctgttgggtgggactctattttagattttctgattgttataatgataagatatactgggccactgaacatctagaattgatccttccatccattacacaggagtaaaggatattgtatcatgcctatagaaatagcagggttgcaaatagccaatccattgctggttccaatttggaagctgacaaatacttactttattgccctgccacatgcgaagtctatctttctgcctacacagcacaagtcagtaacctacataattcttccaggatattctaaaagccccgaggcgggagttcatactctgtatatttggcatttggaatctcatatggaagtgcattcagtgacatcgtgggagaatttccaaatataccaaaacatttattttgcagttcttcctatttgcattatttaatttgtgctgtcttgctaatatttgcctttgtcatatatttgtcatattatacatttgccatttaaaaatttgacgcagcagtacaaacgtatttaagctgccgtgctgctcagaagggcctattatatatcaggagtctgaagagtcaaatcaaatcacagaggatctacttttatactcttacttattttactgaggtttttcaacataaacaaccacagcaacatcttaaagtcatatatatctctttgattccaaagtgaaatactccattcataagacaatgaggagaaaaagagaattagaagccgaatgactatacaagtcactgttaaactaggacactctcgagagtaaaagggagctagtagtcatcacactgcatgtgttttatgcaaactgggactcagagttacccttgttaaagatgtgttatattgctgatctgaactgagttctcaaaaagaagcccaagcaaagtagtctatttgttgtgctaaatctaagcccctccctactcaaaaatccctgaaatacaatatatttatacatagataagtatacgtttacctatgaaaaaatatacagtaggaaaagcatgcgattgtgctcagagtttatgttcctgagttcagcatattttgtgttctccgtagttctggtgacagaattctctccttgttccagtctgctgagatgaccatgggtccatctcttcttggccttgtcactgccccatggtaacatcttctgaggtggtctcatgctcatctgaatcttaactagccagtccattcctcttgattgcagggtcctccattataaccaagagaaccctcttgtttcacccaggttgggtgtctcatttctgtcacttatggtcacttgaagaagatatttggctgcttcctgagccctgatggggtattcagcctactcagggaaacagtgttagatgcatctacccaaccatcctacacaggtgactctactgcacccttctctgccatggggaaatagagaactctttaggggtatgtatgccataaatgcttcaagtgggaagcagaataaaaacaccctctactctcaaccttataaacataaatggagcatttctgccagtaagatcccaccactcttttcagtcttagagatactaaccaggatctcactgacccttctttcccaccccttccagcttcccgttcaaagaggatgcgttggggaggggggctggtacgggtgattgctgggtagcctggatcatgtattctcttaatactctactctatatctgtatcatggtcttcccccaccaataaaagccaagactttgacagatgtattctctggttctacttttagcatcatggaggccttgagtctggcagtgtcaatgggagaaggtcacagcaaagtaaaaggatggggatgacagggaacatactggtaactagtgactggctagtacttcctgtccttctacccctctgagtttcttgagggagcaggaagcaagttcgttcagctttgaatgaaagctcgcagctcacaaaagactgaacaagctagggcctccttagactgatgttaaacacaagtaaagcacagtggctgtggggtctttccttagagtcatattggcttggttgggatccctggcccctgccagcttggggtgactgtattttataggtcaaaatctattggaagatagagcaaaatgaattaagtgatagtcagaagtgggatatctcaaaattatgaaaagtttatctgctcgggtgttaccacactctctcctcctgcttcccccctcaacttcttcctatgctctacctttgtgccgcccctccccccggccacctcagtgtaaaagccaccaacctcagcctgcttctccagctctcacaacttaaatcccacgcactgtctacagcaatccgacaattctggttttggaaagaccatcaatgtctgtcttgacatacagtgagcaccctattaatacctactgaatctctctcaacctttttgtatatttcaaaaaacatttgaaatgatcctagaaaagctcagaataaagcagtcctaattgtttttctttctaaagacacagctgaaagcctcaagagtttttacagagcacctattaatttcagggcaattagaagggaggggaaagatcagagaacgtatcaacttgctgtaagaggcaaacctgtgcaaattaagtttgtcgaaattatcagcaaacagttggtttctgtctgcccctaactggatttcagcagcattttattcagtttccacctcagtattttcatctaatgctctgtgcttttcaaataatattcatgtataattttatttttagaaaatcccatgagttaatgaagatgattcctatttccacaattttgatctcaaggaaactaagacagagagaaggtaatggaattgcccagtttacatggctacagaatagttaagatttcaacacagttcttctcccttggtctctgattcttctctaacacatttaatttttagaacaaaatatgtatttaaagaaaatattgaatcttcgctaaacggcacaaaagaagttatatatatatacacacatacaatatcagaggaatttagattatttaatcactttctaattgctagagcaatcaaaaaattgttgacatcataattaaagaaaactggtagaatctgcccttttctttaagtccacaccatctgagaattgagttaaagttgaaaaattccaagactcctattttgcctatcttgtggacacattacttgtcataggaggggtttacttgaaaattaaaattgtaaaaataataaaatgaaaattagaagaatggctgcccctcatgggcacatctgattctgtcagaatagcattgtttttttcaaagaaattctgaaacagctgtaatatttttgaaatacttgttagtgcatatcagttgtgctaaaaaaggtcgtttataaaaatctgcaaattttatggaaatatttcctttggttgtgagaaaacacatttccacatgtcaccatgttcacagagctggctgacagggttaagaaaagtgtgaatttattaatgtgatcatagcatcatccttctatattacctatgccatgccaaattcccataggaaaagtattagggtaatagttgtcttcctctttgttttacagctggatattttaattttctataattataatttggtgtgtaaattatttgcataatcctatactatgtcatacatttttaaaagacttattgacaagctaaaatttggaaatatcagctataatagaatacctttttaatgttcacgattcaatataaaatccttcatgtgaagcatatgatttataatctattagattttttaaaactatttaaggttgacctgtgaaaacccatataaacacaatttatgatataatagggtttagctggatggaatacagtaataaataaaaggtacacaaacaccgtttaaaatgcatatccatataaatggttaggttgtgttatgatattgtctttgtagattctggttgtatgtgctcaggacaaataaagcaatatctattgtctgataaaagaaaattattaaaccaaaggtatttgcctatgttacttcaatctgagtcactatgattaatgttatatgatatttttctttaaaaatctatttttatgtctataaatcctctctttccccactctggaaatagtgtctttctaccaagaaataaatattcagcattgctgttaatgaaaccatgattactgattattgttattttatcatctctactgtcactgctggtcatagatataattatttcttcatttcagtaaaatgtttgaagaataattttagcaatgtagtatatggggaatttaaagtgacagttgttacggatattgtgtatcattgatagttgtagcattgatattttaaataatcgtatttaaagttcaaattggtgatggattctattgattaaaggcagaaaagtgaaccttaaaaaagtttctaaaagagagctttggaatgaatccaaagatgatatattgcaaaatgcaaaatgggcaccaaatagttaaaaaaagactaagaaaatgaggctgtttgctaactcaagataagatgctaatcctttatagcctaataggaatctcatatcctcccctatgagtcttattctctgttgagctttagtatttggttcccccttgttattattattaatgtgagccaatcaggttgaactaattaatttctgtcaaatgaatcaaagtctggtgaacaggactaagatgttattttttctaatcatttcaaatttctccgagtcaaatatattaacacagtgcttgtaagtgtattagtataaaactgattgcactgaaggttgatgtataaaaagctttgaccaggaagagattaagcatttgcattcttaatatgtaaatcatagataaaagatggaatagtaaaatggctaaaactaaatcagagatagtcctgtaagaaaacttccaaagaaacagcagtttcttttgctgaattcaacaattaacctgttctttgccaaactgtacatttacatgagaagtaaaatattgtatctcctgtgttcccagcatgagccacaaaagtgaagccagtccaagaagtgtctcttttgtccatcaatgtgtccccagctaaaccttttcttttgctttctcaaatagatcaaaatctaccatttctagagtgattgaatcctcagagcatcttttggtatcaaaccgttttttctttttttctggtttccctctgctattagaaaatacaataataatttcaggccaggcacagtggcttatacctgtaatcccagctctttgggaggccgaggcaggtggatcacctgaggtcaggagttcaagaccagcctgaccaatatggtgaaaccccgtctctactaaaaatacaaaaattagccgtgcatggtggcaggcacctgtagtccaagctacttaggaggctgagacaggagaattacttgaacctggaagcggaggttgcagtgagctgagtttgagccactgcactccagcctgggtgacagagcaagactctgtctcaaaaaaaaaaaattattattattatttcatcctaatctacggggaccagtatttataaatgaccctcttcaattagagaagaaagatgtctgcttttctgttatgtctcattctgcttagggcagtatttcacctactaacagtttgtgctcagttgaggatctccttgttttagtgtagttatagatgtattgggtggagtagagaatcatctttatacattttatcattaatacaaacatacctaattctccacaaaagctgagaaggttcagagttccagtctaaagaaagaaaaataaattctttctatagatacatataatttcagattacacagcatgcctttatattaaacagatgttgaaccacacctataatattattttcaaattttatcactgagccacataaaagatatgaaaaaagctggagaagtttcagagaacagtaactcaattgattggggctgtaaagtaattccacacagcattgactttaaaagattggggatttatattcaggaagtgttcagatttagaaatgatatcattgaaaactttgaaagcattcctaaagaggagaaaaagttacttaatcccagaatactagtgcaggaaatttcttcttaaagtttgagaggagaaatattcaaacaaataagattctactctacacataagttataaaagagatgtaacaaggcagtgttctgatttacacaatttacagatgaaaaaaggctataagagggaagaagatgatgacagagttcacatgttgcttgagcagagatgcagcctagatttgcactgccaagcacagtagccactggccacgtgtgcctgaaatgcgactggcgtcactgactgaaatgcgggtcttcaattttatttcactttaattgattttaattttatttaagagttaagagtttaattattggaaagacgtttttgaagtaagtgtggaagaacttgaatatgtaaacctattttttcaactgtaaattttataaaatctagaaatagataaaatatttccaatgaaaattttgcatttgaattgaaatgtgttgtaaatgtaaaaatatagtaatacgaacaactaatttatttgtaatgtggtattactattttagctcattggtaaatgtttaatattgatagattttgaactgataatattttgataatttaggttaaaatattttcagttaaaataggttagtgaaaatattttcacttgtttccctttacttttttcatgtggcagctccaaaatttaaaagtacctctgtggctcgtattacatcttatatttccattggacagcactgatttgaccatgaattgatttaagtgattagaccaattaacaaagtgtttagacaagcctatcctaagcttacccacaaaactgagggaagattccctttatgagatgaatgtcagcccacagctcattgccttcttccatctcatccagaacctcatggctacataaacaaatgtcctacaacagctggttcactcctaatttcttctcctatctgcactgactgtcacatcctgcacccacttacccgaaggcatttactgcgatttaggatcttgtggccttatgtttctccaaattactttgaaggcagcaagatcttagatgctacacccccacggatgaaccgagttgcccctctcttgattaagtctagtcagcatgagctgggcacggtggctcacgtctgtaatccagcactttgggaggccaaggcatgtagatcaccggaggtccggagttcgagaccagcctggccaacatagtgaaaccctttctctactaaaaatacaaaaaatcagctggcgtggtggcagacacctagttatcccagctactctagaggctgaggcagaagaatcgcttgaacccaggaggcggaggttacggtgagctgagatagcaccactgcactccagcctgggcaatgagagcaaaattctgtcccccctgcatccccttcaaaaaaaaaaaaaaaagtctagttagcatgactgggcttctgacttagggccactccttggtccattcagcttagcttgtcttgtaactcaggaccctttgaagacataagcccttctctgaatgtgggctactgtccaaagtatatgcatcctgtcattcattggctagcactctcccagtggctggaactggccttgcttctctgcattccagctgcgggctcaggtctttatagacatcagtgcctgtaggatccgtggcagcctgcctgtctcctaggtagatttgcgatcttggattccccatgacactgcttgccttgcctaacttaactgatgctgaagacatttgggcttaataaacactgggttgccccttagagcttgatactttaatgctctattttcctggagaaagcctccttacccatcaccccactcaccatggtgcccttatttccactcattcctaactctgaccccatcttccttcttgagccatagagagtgaactgaggaaacctctaattaagtcagctaatatcatggagtgttaacaacaatatatttttgtgaaacatctttttgtgcccttatcgtagggaatgtactctattagaaatatcatcggtcttccctggaacactacttctgagcgtgaaagggtcttcccagaatctctgacggtgtcccacagagataatcacctattgtatgtttctgtatggtgaactcagctcctctcttaaatgatccctgagagagttatcattacagtgtcctgatttacaaacttacaggtgaaaaaaagctagaagagggaagagggcagtgaaggagttcacttttctcacatagctctagggtaaactataaaaaactaatttgtctctaagtttttcaaggtgaatacaacagaccaggtctttaacaagagtctagaaggatcaggagatcgaaactatcctgactaacatggtgaaaccccgtctctactgaaatatgacaaaattagctgggcatggtggtgcatgcctgtagtcccaactacttggaaggctgaggcaggggaatcgcttcaacctgggaggcagacatcgcagtgagctgagatggccccactgcactccagcctgggcgacagggcaagactctgtctcaaaaaaaaaaaaaaaaaagaaagaaagaaaaatctaggagaccttagagcctggtttgataaggggaattatgtagataaaagctctgggaaataatttgaaagaagagaataaatagtctctcatttagtattaatgcatgtacctcttcgacgtggaaaggaaagaaggtaccaaaagtgtgcagcaatggctttcaaactgggaaggggttgaggttgtactccccagggacagttggcaatttctacagatatttttgaatgaggacctggggggcagaggagtgctactggtgtctaataagtagagaagagagttgctgctaaacctcctacaatgcacaagacagcccccataataaacaatcatccagtcccaaatgtcaatagctccaaggctgggaattctcgcgttaaagttcaccgacattttaatctcacaacattttaatcccacatacaaatagactgaagctcacagatattaaacaatttatttaaagtattaggactaattagaaatgtgattggacgggaacacagagagtttcattttcaggactggctttctcgtgctaacatgctgtctttcccattattcacatgttcttctgaatttattaagaacagtttcatgaaacttttcaagtttgatgaagctgttgaaagggtgcggctgtgtttatatgatgtgtaaagcctgcctttcctgaaactgaataaataacacaaagacagctcccatttgacaatgctggccattaagcaggatacaagaagtctaagttattattcttactttacctgaaagaagctaatgatcttagtgaggagactgagctcagcattatgagaatgtgtgtaatagattaggggcttaggactcaccgatccaactataaaagggttgtgcaattttattatttgattagttcatcttagccttgtgtactttcctctaccattcctgtggccaagtcctccatctacatttcctccttagctgctgctttttatcaagggaattatttaatcttggtgccactaacaaatttggccattactttatggcttcctcctccacataatcacatgattacatcttattagaagggtaagatgttcagtatcctggacaactgcttttaacttctcgcccactgaagttctttctttgctggatttagctaatttttaggccataagaaaacatttttggctttaaattttaattaaatttgataatggatgttctattggattttaattttttcatggtgacatgcattcaaaatccattgtcatatttcttgaacacctactatgtgccagataaaaattatgagcgcttagtattcagtcatacataccataggcagaagccctgtcctgatggagcttacatcttagtgaaggatacagatggtgaactagtaaatatacagtagaacatcaaggtatgataaatgctggggggaaaaaagaaagcaatgtaaagggatagggattgacagtggttactgttttgaatgagatggtccacatctcattagatgtggtatctggaagagtgctaaggatgatgaacaaaaatatgaaaaaccctgaagcagaatgttttttattcattcaagaaatattaggaaggactgtgtggcctcagggtggagagaagaaatgaagatggcttataccaatagagagggagctaggagtagaaaatatagatccttgtgggcctgtgatcctgatcctgtgatccctaaagagaactgctcttgctcctctgagttgaaaaactataggtggaacaagatgggggcaggaaaaccagtgaagagtctattatagttctcctaggaagaaatgatagtagcttggaaagaagggatagtaatagacagtttgcttgttttgttttgttcttttcctaagaatgttcataatacaaacaccttacatttaccatttgcttttatatttggcaatgcaccattctaaaccatgagacacgacttcctgagtttccatcctggatccatcacttgttagcagtgtgatcttagatctataacctaatctctctgattcttttccttctctgtaaaacaaagttaatactggtacccacttcaaggactgtgtgagttgaaatctgtataaagctcttagaattattactggcttatgttaagcattatggttttttaaattattattatttgttcttcaaacaaacctataagtatttgttttccttctagaaagcaggtcagtattatttaaaataatatatgttatgtacatttacttatttactttataaatgaagaaacttaatcaacagctaatagatgagtcagaatgcaaaccaaggtcttttggctctaaaactaggtccctttcctccaaaactaggtccctttcctccatactacatgatggtcaggttgtcagatgctacccaaagctatttatgggcctgcactcctcagtctgctattaaatatctcaatcacattcaacagatgtccagcaaaagttctttgaggtttgtttcatttcgattaacagagaagtgctgcagcagggatcaggatggtgagaagtaacctaaaagccacaattccatcatgccatttttcccagtatttcaccttcacagtctataggtatcatctgttcctattgctttatttatttttggctttctcagagtaacttattacttccacaagatagtttggactttaaaagcatttttaatctattaaagaaatttttcttaagagttgcactcttctcttgacaatatagggtaatcatttaattattttttgataaaatcctctctctctgtatatatgtgtatatatatataatgtatgtgtgtatatatagtgtatatgcgtacacatgtgcatatatgtgtatgcatgtatatgtgtgtgtatatgtatatgtgtatagagagagagatacaaagttatagttgggaatgtattgaaagattcaggattgctgcttagacatggttttttttattgatatttgaggccagataatgctttcctgtgaggtgatgtcttgtgcattgtaggatgtttgacagcatccctggcctctaccctctactggataccagtaacacagattacctctcccccagttctcaaacaaccaaaaaatgtctccagacattaccaaatatcccctatggggaataaaaattgccttcagatgacaaccagtgggttagagacttggaaatgtgattggttttatttgtatgcatgagactgctgatttgtctccttaaaatgtgaactctgtgcctttttagaaaagtctgtgctgcttattatcaaatgggtatgttatcaactgagtataattttccatatgcctttcaaattttccaggcataagaatagaaatacaaatgtgattggctcattaccattcaaatgggaaatgagaagatcaaagctatatgaaataagtagcttgatcgaaaataagtggaaatattgccatatttagatctaaattttagtgacattgtaccctatcagtaaaaatgtttgaacatgaactcctcatctatgtatatttattggaaaacaaatactcagtctttcccagcaaacagaaaaggagagaatattccccaactcatcctatgaggctagtattgccacgataccaaatccagacaaatacagtaaataaaaactacagttcaatatctctcatggagttatctgcaaaaatattcagtcaagacaatgtgatattagcagaaggatagacatatagaacaatggaacagaataggaggctcagaaataaacccgcataaatatgctcaactaatttttgacaaaggctcaaagccaattcaatggagaaaagatggccttttcaacaaagggtgctagagagattgtgtatccatagccaaaaatataagaaataaaaaatgaacctccacgtatatcttataccttatacaaaaatgaacataaaaatagatcatagacggctgggtgtggtggctcacgcctgtaatctcaatactgtgggaggcccaggcgggtggatcacaaggtcaagagatcgagaccatcctggctaacacggtaaaaccctgtctctactaaaaatacaaaaaattatccgggtgcagtggcaggcgcctgtagtcccagctactcgggaggctgaggcaggagaatggcgtgaacccaggaggctgagcttgcagtgagccgagatagtgccactgcactccagcctgggcgacagagcgaaaccctgtctcaaaaaaaaaaaaaaaaaaaatcatacaggtaaaatgtaaaagaatacaaaaaaaaataggatattgtctccaagatcaagggctaagccaagagtcctcacactccaaaagaacaatgcataaaaggaaaaattgagtcactgggtaacatcaaaattaaaaactgttgctttgtaaaagaccctttgaagaagttgaaaagacaagctacagactaggagaaaatgttttcaaaccacatctctgaaaaagaactactatgtagattatataaggaattctcaaaactaaacaatagaaaaaaaatccagttagaaaatggaaaaaaaaaaaaaaaagaaaatgggcaaaataaattaagaggatacccagatggcaagtaaacacatgaaagattttcagcatttttagtcattggggaaatatgaatggaaaccacaatataatgtcactacacacctaacagaataaaaaatagcaatgactccaaatgcttgtgagggtaaggagaaactggatcacccctagattgctggtggcatgtaaaatggtacagccactctgaaaaacagtttgacaggttaaaaaaaaattcaaatatcatacagttcagcagttgtactcctgggcatttatttcagagaaatgaaaactcatgttcacaaaaataaatatataagtgtttatatcagttttatttctaacacacaaatctttaaataggctatgtgttgttcagcaggtaagcggttaagcaaattgtgatttgtgttgtggaatactactcagcaataaaaaggagaactctgaataagattggtgggccacaccaaagtcaatatttgtgtgtgatactttattatagttttgctaaatgttaccattaggaggaactgaacaaactgtacttgatcttctttatagtatttcttacaactgcatgtgaatctacagtcatttcaacaaaaatacgttaaataaaaatgaaaaagataagataaaggtgaaataaaccacgttatatagtattaatgataatggcttaatactgtcatatacatcaaagtgcattaaatacctgaaaaggtcattattgccttattagatatagattcatagttcaaatagtcttcttaataacctttattttttttcctggcttcacatcagatctgattatattgtcttttgagaagtaagttaccttgttaagaattcattctacaaagattggaaatgtctattcttctattttcctatttgcttagacctgcatattacaataattattttccacctgccatttatttgtaggaatctttttgaggcacttgttcattttaagagggatttttaacataaggtaatctgtgtctgtgtaaccaggcacacgtaagctaccagatactgcagcatgctgaaaacagtaaacaaaccagtaagagctccactggcttcccttggcatcttaggactctacactcatttcaggaagctttgcatgtggaccataagtgacacccaacctccgactttcaatagaggaagggtgccagaagcaatctgtgttgtaaacattaatagagttaagtgtctttcatatctgttctagatgaaattattattataaaaagaagtccaacattttcatcttgaacactaaaggatctttctcgatagctgcggtggtatttgccagttcagagaccactagtttaaagaataaagccatgtgtggatcaaaaagacttgatacactgcattgcaggtagaaaggaccaggcagtgagaaagccagcaaggtgctgcgtagaatttaggttaactgaatgctacaggccttctgtatcttgcttatgacccctaaacccagttactagctaattgagaaagtcctagaaatgaagacatcatcatatctaaacatccaagttgtaccaaatagcaactccttaggtccaatttatctctttcctttttattaagtaaacatttccttaaagtataacacacagatggaaaagtgcatatgtcataaataaacagctcaatgaaattactaaaaaggaaaacactggcataaacggtccccagatcaagatatagaatgttactagcacttgtcaggccctcttgttcccacttttctaattctgttccatggagaaccactatcctgacttctgataccataaattaatgcttatttgggggtttaattttaaagggattaggaaatacatagtgttctgggtctggttttatccatgccattgattatgcttgtagttcattcattctcattgctgcatattattcttttaaattattataccacaatttattttattgttgatggacattttttccttcacttttgactattatgaatagtgctgttaaatacattcttacattctcctctattcttattccagattgtggcattgttttcctgtaaactgtggtactaatttccctaaaaaatctttgataccttatattgaaaaaagaaaaagcaatcctcctagaaacaattagctttcttatctatacagtaatacaaataattcctgatcatctatagagtttgagtccaaaggctatgatagcatgaggctgagtaaatatgggatgttgaatgagccctctaggtctgagattccgtaagaaaaagccattgccatgtgctgggaggggtcagggtagagttcccaaggaaaggtggaacccagagtttggaccttgcaagttgcaatatgtatttacaaggaagagtagtggttcaaagcaagagaaatataaaaaggcatggaatgaaaatattattggcttgggttgaacggattagaataggataaagtgtaaattactccttgtgtcgtttcctctttgattctccaatttacaggaaggtagtcatagaataacactgaaatccttctgacttggtgtatcttagaaaataaaacaaaactgtgctagtctcagaaaaagggcagtgcagaaagtagatctgaatacatgtgaaatgagccggcatgatgaatatttgtctgttctcactttctcttctctgttctcgtgtgtatgtgcccacttgcaaagtgaacagtgatggtaattattaaaaccattctttgctcataaactgagaatgtttgaaaacagagccagagagacaaaaatgactggacccctatggtgcatttttgttttatttgcttttacgaaaatatctacctgcctctacatactgggttgaggctccttctcaccttacccttctctcaggcagattaatcacctgtctaagcatttgaggtcctgattaatttgtaaccctaaatgaaggccagagaatgctaaccatgtcctctgagttgaaacagttttcagtaggtggatgaaaacccatcttgctaattatagttttggataacagattaaaatatgtagaaaggtttcctccttagatgattagatctttctgaatgacaacttttctatttattagctctgcatgccttagaaaaaatgtgcttgtgtgggagagctccagaatgtagctgccagattgggagcagaccttgtattcacgtgtgcctttctgaagctcagtttacagctttcctaggtttatctgttctgtgcctgggttttgcttataaagtaaggtcttgcatgcctcaagaagtggactttgttaagtgcagtgcagttaagatctgcagtgcagtggggacttttttctttatataattttttaaaaagaagctgatgggagaaataagagccccagggaatggatgcttatgtgtagattttgctgatataggagaagaaaagataactgtgttttgaaaagacatgtgcaatagtttaatcatttccactagctttactagttaggatatctggataagttgcaatgagggacaggcaatgggatgggggaaagtaagagaggaacaggtaaagcaaagttaaaagaaatggaaggaatttggttatgtttgcctctttgtgttgaatctttttgctctaaatcagggtttttgcaggtttataaagtggagcccaggagggatccacctcagctgttatcaggccatgactatgtaatgtggaactgaggatggaaataataggatggctgacatctggctaattgccattgcaattgaaagctgcctgacagttgtgtgaaaattgcttggagatgaagaactttcaatgaaccatgatggacagaagtatctgagcaaagaaatagtgggcaatgaaaaagatggactggaggacagggaggaaactgcctgtcatattctctcctctcttgtcttctcctcccattgtatctcaagagtaaaagcttactcagttaatggcaagttattttcaaagagaaaacagaaagcagaggtttgcaagtctggagttacattaatttcccttaattttgccttcacccaaagcctactgaagcaccagtcatccaagggtctcttcctaaaccagtgcttccaagctgctcagttcccaagccctcaaaacatgagcccccagtgctgccctccacagtgacaactccgtcgtcctcctccaagcacctagtgctgagaagtgacttctgaattgtcaagacatttcctatgaatggtcaagacatttcctatgaatggtcactcccagaacaggcttgccgaaccctgtagcataagtggttactgctataatcagtaaatccaagttaacttacctaatcaacattgtctccttcatctcttcccatcctctcaacagaggcttctcaggtaatacatacacattttaattttggctgtgtggaaaccattgttgatcattaaatagagtaatattaatggtagggtttcccggagatgtccaagattgtggataatggtcctaaagaagaaatttgcggggaggccttgctttatgaaacccttcacaccacccctgacttgtgaggagggaatagctgcctactgcctgatccagttctttttatgtccctataaatacagtcgttcagattgagttttaaatactttttgttatattatgacaaggttttttttaagaatttaggcaatgattttttttttaatttagaatttcctaatagtgttaagggccagagaatcaaagtattctttccattttataacattggttaaaagtgccttacaataatagtttgtgttttgctgctttagttagtgttctcatgcatgagttacactgctgtggtcaaaacctgtaaacaaattctttggacttacaaacagttttggaaattgccatatactgtcctgacaagtaattttactttctgtttaattatgcaaacttaaggggactattgaagaaaaatagtgtatttttcaggccaaaaatatacatggtggtatatttaaagccaaaaattctgttgagagaattcattttgtctaggaaacattcgtattctttttctcgctttgcatgtgtacattcagactatgatgctcaggatttgaaaaaaaatgcatacttgaattgtgaatttttttttgagatttaactaagttaatttttgtaattagaggaaattaataaaatattttggaagaaacttaaatttatatgtcaacctctgggtcaaatagattcatttgaggttcacatttaaactcccatcatgttcactgaataattttaaggctgttttagtcatcttgggctgccataacaaaacaccatggactgtttgctttaaacgacaaaaatttattgtctcagttccggaggctgggaagtccaagatcaaggtctggtagggttcagttttcagtgagggctttgtttctggcttgcagatggccaccttcttactgtgtgcctacatggccccatcaccaaatgccatcactttgggagttagaggttcaatatattcgtggcagggtggggcaggggatatcaacattcagtctataacaaaggccttaggactctgctgataaactctgtatttgtcttcagtttgggggaggtatacaggaatctgggttacactagtttgaggaagttatcgtaattttaaaactaaactggaaaaggtgaatggttttctccataggttgtttattaataaacagcagctttctcttctatgttgactaaaggtgacataaaacttcatattgattagtagctgagtttctatccctcatcctactactgcctctccagccaaagcaaattgcagagttaagatggcactcaataaatatttgttggaaggattaatgaataaatgaataatttaggcaaaatctatcaagcctaaaaaaataatcctcaatcttattcagtaaacattgtctgcaagctgactttgaaaaagagcaatggaatagaaatgcccaaattttaagaaggtgatgacttagttgaaaaactgagagatagaataaaattactaaataatcataaggcaataatagattaagacatagttttgggttactcatggataattacatggtccagggataattatctacagatacatccatggcagtatctacctgtacatggttttaccatttctatggcataatttttatttggttcaagataaaatcaaataaatttttacaggcattttgtctagatctagattccatggaaattatggacattcccatcgttagacacaataaccaagctgagagatgcctcctcttgttctcttccaggtgtagtatcttagtgctgtccaaggactacaccaaattctcaatgagaccccctgatccagaactaacaacactctcccgaaaatctctccttttttctttctctaatttcagagtgccagataaaatataggatacccagttaaattttagaaaacaagtactgcatattgcgttatttacttatatcaaaagtatcctatttttatttgccgaattggcaacctttctctaagcctgtcccaagtgccactttatcattgcattgtaattttaaccacccttcaaaacacagtctatttgaaagaaaggattgcagtcatgtataaatgtctcatagctagattaatgtatagtcattaaactaagtatgtttgtatatttatccagaggatcagtcttctggaggttaattttgaatataaatattttatagtaccccacctcaagagagaattgatactttcttctcaagtttgaatggtcaagaagaggttgggtgtgacaatcattgcagatctgtaagagtggtaattctagcaccacagtttgagaacgggacccagctatagaaagcatgtgatagtcatggccacagactaaaattattctggtaatattggtatgaagtgattgtctgttctgatgtgcagaaacatttatctttttatttacttactgtcctctgaaatgtggatgaagaacactgggttaggagtaaggaaacctagatcttattcccagatctgccattgttttttaggtggtctcaagtgtactgggccttagtttctcacttgcagattctacatgattgcatctcaactttatataagaagcagctgaggtgtctaggggaacatggagatttctgggtttcccatcagacattttgattctggcaccctaggagtgggccaggatgatgaatatttttaacaagcacacaagttgatcaaatgcaagtagttctgtaccatgttgtcaaacttagagtagatgacctctcagtccctttctatttagttttacaaatgtggacatctgtgattcaaagaaataaacaaacttgtttatgtagaagtgtgttttcactttttagaaacaaattgtttattttagaaaaatcaaaaaatatagaaacataaaaaagcatccattagaagtttaaatgtcttataacaatcccacaaaatgcacaaaagctaatttcaaaagctgcattaactctacattgtgaatgcctctggttacttgtttattgggcaacttaatctaaaaaggttctttcatgaattttcatcaattttgcaacaaagccctgttgcaaattgtgaattatgcattaacatatgttcatgctaatttatacactggtgacaggtttttggcatgggatcaataacttacaattacaatttttaaagtttgtttattaataccagcagggacttgggattatcatttagttaacaatgtgtaatttgaacccaattttttaaaaagagcaagttctgccgttgtcttaagtcagtatatttgtccaaggaacaacaaatgaatctgaaactaacaagataaatgcttcctgctcttctcaattaataatttttatagttccgtaagattgtctgatgttggtgtcttgtcatcagacgtaaatgtggggtgttgttacaccaagtttctctaatatctaaataattataggcaagcctatttaggtcacaatacttaaagataaaaattataatttcaactagctgcttctgaaaatttaatgtgatgcttcatttctttatgcatattctttaaagttaagacaaaaaattcctaaaaagaaatcagaataatcttaagaagcttcaatagtatgtttctctctctccagcatgcttttatttaaacacattggtttgtaaataaaccttcttttgaaaagccctggtatacaaaaaatattctaacaaaacaagtaaattagaggttgattatttgcaatgcttcaaacattttctgctttaaaagtataactgcatttcccttgaagaagctcctgcttattacactgaaatgggatttgtctcaaataattttatgccaactttttggaagcacattgttatgtaagtggaagctcagcttttctatacacagcagcaagtatttgatcaatcactattactaatttgtagagcggttttagctaccacatctgacaattatatttcaatatttattttataaaaatgaagttactaagaataaatcaattatatgctcactttatccctctggtgatgaacagtggagccaaagggagtgcatgagctttgagtatgcctgctgttcatccttattaacaactttgcaggtgcgccttgctggtggtgggagaggtaggaaagaaaagagcatatttttctaattagcagttctatatcagatagcatataatagaaggccaagggtaattattcctatgcccacaataggaatttttaggtttttagatttttttttatttttggtcatagaaggaatacaattttgaatagcagagagctgattttaaatcttggttctctccattgttaatagtgtcaaggtatgtatcttctctgagattttgcttcttatctttaaaataaacatgataatgctctgtttagtgggttcttgtaagaataaagttaaattatcctcatatatatatccttaccattctctcgtatttaggaggcaattaatcaacatttaagtgcacatttccatccactctgaaataatgaagctgtctctgtggtcctgatttgaaaccaaagctttctatgtcccctatagccactaggatgtctagtctatatgatatcattctgtatctgttggtaggttgctttacgtttgttagtaaacctatatggtcatccaaactagcctggtagaacctttagcccctttcatgcccatcttccaccctctgcaccacaacttccctactcctacccatctgtagcaatctgtcacaagcattgtcaaactgtggcctgtgggccaaatccagccactcacatgcttttgtaaataaagatttatctagatatagtcatccccattcatttacacaaagtggatggctgcttttgaactgcaatggttgggatgagtagttgtaagaaatctgaccgcataaagcctaaattattcactatttaaccatttgcagaaaatgtctgtagactctggtcaattacctaatagaatataactagggtttttaaatatggttgattaaaaattaagtacttgttgacaaatagatgctgattaagtggagaacagaaaaatgtgatagttattgtcatagacagatcttaactctcctactaagaatgatgacaataaggacagaaagacaaagtaatttaagagaaataacggaaagatggaagccaaagatgatgaatcctccattaactgctattgcaccttatttgagttatgttatctttgttagcctcagttttcttatctgccaaatgaaaataataatttctgctcaacctaacaccctaaggtccaaatgcacattgcactaactaatgatattcttacattatgtaacctttattttctttatataataatgactcctaacttaaatttagaattcaagatgcattcattcttcttttctaaaagtttcataagaagtggtggttgtccttgtaggaaaagctaggtgtgagttgagcaaagacaaagaagtatctttagacagtgtttgaggatttagtaaaccttatctgacagggaacaaaatttctggcaggcccagtggagagaaagaagggagagtgtgtgtcagataaaagaaagcagagcttggagaaagaggaactaaggggaggagacagatggccaatggccttgcaatgagaatattgagtatggtgaattattagctgttcagtgttcccaacaaaatcagtgacagcagcccctgatatataggcaatcaaaggcaaggtcttcagacactgcaaggggctagaaaacctggtagttggtaaacaacaattcagaacatttgatctttaagaggtttctgagggccacgaaatgggcactgatctagaatgcagaaaccaatagatttaaggccagccttttctatctcatgtcatcatgggtaagtctcagtttcttcatttgtagatttagaatatcttccttaggtacttcatgagacttcaaagaattcaatgaggtaatttgtgtgaacatgttttgaaaactcaattataggcccgtattattattttattgagtacaatagctgaataactacagaaggacatgggcttttaatgtatttctagaaaagttgatagattttctgcctgcacagacacagttacacacacacatggtcagacttatttcatagatccatctattttggtgatctggaagtaggaatatagtaaaatgctctctctgtattaatctcatgggtaattattttcctctcatcaggttacaggtatccccagaaatcttcagaatacaatctacaggtggtgtttaaatatccaaagtcacacgccaatgctttcttatccagtgagcaaaaagaaagctcaatgggaaccttttggtaaaactgatgcacagggatgacattattcttacaggtgtgtaacctaaagcttttactgggttccatctatctggattaacaaagagccacattacaaatgattctgttccctcggtgataaaagaaaaaattactgagaggggatatcatgtcataagactagaatactaggtttagagcaatttgttcttctttttttcaattatgcagtaatggtatccacatactgtattcagtctacaggcaatgtgattagaaagaaacaaacatagccttttttgaaacaaagagatgttatgcattaatacatgaagtggtggttcttttgctataataaatgcatagctggtgattccaccaatgagcaatttgttggaaatgttttattggttatgatttatggatgacaagtttgagtaattgttaagcttaattgcacttaaatgatggattttttcctcagttgtttatcttcagggcatggatgaaagcaaatgtgttggaaaaatgcagagttcagtggttgctaaatgagcttattaatgtttacatatgtaacaatttaggccattagtatgtatatgttggaatgagatgaccatctcatctctcagtctgcagaaattcctgcacaaactatcactattttatttttggataaacacacagctgttctatttcaattacaaattcaagttgtcctgagattaattttgttctatttgtggctggtaaaagtattttcaagaagaaaatgaaattactatacctatttggcatgtacgagggcattaggtcaagagcatctagcctctgacaactctggggagggagagcaactggtcagatccccaaagacttggccttatttccacagaatgattttctaggcagcccattttacttgtaatacagagggtcagcaaggcaaatttgcctgcctttccaaagccagaatgaaacactgactttctaagctctaaaatattcttgttgccctttattacagctaaatatgatatagaatcttgttatggactttatgtctgagggcacacatggtttaaaattctcaggtatgaatacttgtataatagatggagcatgagttaggttgacctcttgcaaaacaaaacaaaacaaaaacaactttctttcctctcattttcccagtatctcattagcttttcaataaatacttgttgcatgagttataacattcttcaaaaataaggctgatacatatgtgcatatatatattccaagatatatttcgaatataatgtgccagatgctttttgttgctaggaacagaaattcactcagttgaactaagaaatgagagatttattataaagatacatatgaaaataaggaagtaaggaattttgaccatatttctgagttttatacaagagtctagaaaaatctgcactactaggtttccaagaagagcaggtacactgttactgccaggttctcaaagactggagcctggattaaaagctggacctcaggaactgggcagacagcattttaagatccatcagccctggtgacctgattatcacattacccctcaagagcagggctgatcctcaccctaaggtttcatcatcagggagatagcacaactctccacacttctgcttgtctgctcctactgtcactgacttctatgacagggctctcctgtcttgtggtttctgctttctcacagtttttagtgcttcatggactctgcttactgcattaagtctacagatgctcaactttatgtttctgcacaaatttcctgggataaaaatacgactggtttagttagtcaccaatattccagttaggccaccagttatcatatagatttgctacacttgagttacatgcccaatacttatcaactggctgtcaccaagttgatacaaatgacaaactgtatgaccccctagtgccaatctatagacaagaggctggggactttctaagtctcaaccttttgctacaatgtggtttctcaactgactgtgacaattagacgtaggccaatattccagtactcatctttgtacctagttttctaagagaaaagaagacatggtttcctaaatgttattgctatgcaatagcaaaaattaagtatctacaaaaattaattggtcatcgtgatagaactggtctgtcatattaaagaaagagcaatcccattcctattgctccgacattttaagcagctgtgttttttggtttgtttgtttttgtttttgtttttgaaacggagtctcgctctgtcacccaggctggagtgcagtggcacgatctcagctcactgcaagctccgcctcccgggttcacgccattctcctgcctcagcctcccgagtagctgggactacaggcgcctgccaccacgcccagctaattttttgcatttttagtagagacagggtttccccgtgttagccaggatggtctcgatctcctgacctcgtgatccacccgcctcggcctcccaaagtgctgggattacaggcgtgagccaccgggcccgtgaagcagctgtttactgcagtaacacgctgttatttcctcaagttcttccaggtttcttcaaagtccatttccttttcctcagagtttcagactctgtccaattattacactcactcatgccaaggacttgcagatataagaattatccttgatcatataagtcctgcccttgaagatgcatccgcctcgagctgtcttcttatccaccttcttatctctcttcttctgtggatatgaagatgataatgtctgctccaggaacagttcttatgatgtgattcagaggaagaaatgcatctacttcctttaacccatttacatttctggaaaaaagtaccatggttaagtcttctctccaatgaaatagaaaattttagcaaagtctataaaacaaaaatctctactagaaagcttatagtcaagtcaaaaaccctcaaaattttgaatgcaattaaacgttaatatattttagtgaaactatatgatgtatagtatatatgacataatgaaatgtaaaaataatatagtatgtgttcaagcacttgtagtttataaatattttcatgtgaattgctatgtttcattcttgcaccaactctattaagtggacaagaataatctctcttcaaggaatggtacatgttttacacacacacgcacacacacaaacacacacgagctgaggcattttttggatgtggagctgtatgaggctgacagcagttaagtgatttgttcaagttcattacaagaaaaacagtaagttggagggaaaaaaacatgagcttttgagtgggtctgtctgtgggtttaaaccctacttttacactttcaagttgcaatgactttgtgatagttactaaacatttcttaggaagtctcagttttctgagatgcaaaatgagaattgttgcagagccataaagaaaacagagaatgcacataaaacatacttagtaaatggtacataggaggtgcttggtaggtaaaactggaacttttgtctttttcttcagtgttcttcctactccactgtacttcaagaattaaaaatatcattttttcagggaaaatgaatgaaattaccaaaaactgaagaagatatgtcttcattatctttatcccaaagcatttacttggcatccaaaaacatattcagaacactgtgctaggtaatggaaaagtcctaagacacccagagagagattgtttccttactctcacagtggatgaaaaatactgagaggcaaatgagagaagatgcctatgtcagcttcctgcagcatcagtctaaattattttaacaggctttagtgacctcaaaatagcaagaaagccttaaatgtaaaagacctagataggtgatggaagatagagacaaacactgaaatttcagcaagagatattatagataaataaggacaacttggcctctaaacatcttctatttactgcacagttcctgttaatttcagtatctttggggtacccttctaagcattcacacatctactctgaagcaggcattgcttataaacagccttctgtctgctgagctgtttcatggggaattccttatcaccagggctgcatttgaactgatgagtcaagcaagctacctggtgtattatcagttccttcaaacttgctctgagatgtgtgacatgtatagaaaataaaaacctaagactttgatctacaaggatgcagcatttgcttggctccagtaagaaaaagaatcctctagaaatccttaaaagcagactggaaaaggctgaagttctcttctacatttgccaaaacttagttaacaccagctttaactaaaagaaatatgatagtcaaaagacaaaccaatttaaatatatttgaaagtaaggcaatatattcattacagtatggtttgtatttggcatttaaaaatatctaacttctttgcctagagagatgtttactatttcatactatcttccttcttaaagtagacaattgaaatatgtttctctgtgtgtgtgtgtctgatctatagcctgtctggtctccatagttttaatgagttttccatttttttttcttaaactcttcttggctggtgaaaattactcaatactgctatcttagactatttcaacgacatcccttgacatccatattcctacctcccttttgtagtttcttctgcttcattgttacctattgtcattactttctccgaggctgaatatctgtactaatacctcctaaggtgttccggaatagtgaagccaattctattttctacgttcaagcatattcttgatcttaaaaacaaaaaaagatgaagagaaggaaattaaatctccagaagcaacccactatcttatgcaactattgccttctgtgagccaatctcatttccataaccacctcctctctttcctttgcacaatgcaaaaggtagagatttcatgcaatttttatgacagtgacttagctcccctcacagccatcatcaaatctacaggtatattggagtgactcctgtgcttttgcatgcatattaaggactgtgtacagaacttattctaaattgaaaaatgatgcttatcttctagtttcttctattataggaataaaatagttatgttggcacttagaaaaaaagttcaaaaaaagcatcctaggcatatacattttgcatgtgattaatgtgaggacttcttatcaaagttatatctattaaatctctcaagaattccttaattttgtttctttttaatttgtgcaagctggagagatcacatttaaaattttaccaaaataagttcaagactcaagaactcgatccattgttgccaattgttctgtgtagtatgtgttcaaagtacaaaataatattaacactaatttggattcaaatgatctttctccacaaggcaaatgacattttaagacatattctgggagctggatcttctgtttagatgctgctaatagggagacaacagctgagaaacgtgcatcaccattgactgaaggatatgggtgtgggaaacccttttttcaaatgagtaattcattgaagtttaagggaacaaatttattgtccatagggtacaagagagaagagagctgtctataaactgtttttttttctgagggcctcttgctttttttctgagggccaccttcccaaacctggagatgaactgtcatgggtggctgagataaaattcacataaaatatatccttctaaagtagaccattcagtggtttttagtatattcaccaagttttgcaaccatcactgctatctaattgcagaacatcttcatctccctaaagagaacaccatacctattagtagtcagactcattcccaccacctctcaccaccccagtccctcttctactaatctactctgtctttacagatttgacgattctggacattttatatgtacaggattataaaatatgtggcctttaaaatatttgctagaagtttttattgaaataatcatagattcaaatgccattttacagagaggtcatatgtaccctttaccctgtttcccccaatggtatcatcttacatcaccatagcacaatattataaccaggatatcgacatttgatacaacctgtcaatcttattccgacttccagttttacttgtactcctttgtgtgtgttgtgcactcccatgaatttaattctaaaaaatattgttacatgtgtaggtttgtgtatccatcactacagtcaagatacagaaaaatttcaacatcataaagatccttgtgttcttgtgtggccctttgatgtgcctgccttctaccatccctagcctctcgcaaccactaaaccgatctccatttctaaacctttgtttttcaatgctatataaatggaatcaaacattatttaatcttatgggattgacttttttttgcttatcataatttcccagagaccatccaggtggttacatgtatcagtagttcagtcctgtctattactaagtaacagtctgtgacaaataccacagtttgtttaaccattcacccactgaacgacatctggatgatttcaggtctttggctattgtgaataaagctactgtgagcatttccatatatttttgtatgtgtgtgaatacaagtttttatttatctgggataaatgcctaagaatgcaattactgggtgatttgctaattgcatgtaaatttcctaagaaattgccacactgttttccagggtggttataccattttacattcacatcagcagtgtataggtgatccagtttctcttcaccctcaccaagatttcatgctgttactattttttttattttagctattctggtaagtaggtagtgaatatgtggactttgtgactggcttatttcacctagcacaacattttcaaggttcagctatgttgtggcgtgctttagtagttcattcctttttgccaccaaataatgtcctactgtatggatataccacatttggtttacccatttgtgaattaatggaaaaatatgtttagtagcaggaaaaatgttttcaattttttttcatattaggatattatttatgtctaacatctattattaaaactatcaggcactgtattagatatttgatgtgtgttttctgatagaggttacataacaactctaagatccaagacttgatgggtaaactggaaactcacatattaaatcaagcatatgaaaaaataataaatttgttaagaatacttatttaacttggccaagtcagttttgagaacaaaattttaatacctccatttccctacagaccccaacataagcttccttacctgtcattagattaattcacacattttggccagcttgccctaatgagaaatttgcatttcccagaccctccctatggtctaagtcatcttacatataaagaaattaagatgtattcatttattgcgcaaatatttactgagagtctaatgtacattaggcccgcagtaggtgctgtgattcagaaagactaacatagctaaggtcacaaatttagcaaagcaatgatttaataccaccttgcagattgagagtaaaattttatttttaatacttattttctctggatcctaattaaagcaatccagggaaatattttaaagtacttcattagggatctttaatttttttacataagtgaactattaggcattattttgaaaacataatttctacttagcttgtcaaatgcatcctattatttaactttacagggaaagaatccaatagccaacctacctggcatattggcttcccattgtaacttttgtccaaccttattatgtatagctggaatacagatattgagcacaatatatcattaagtcactaataaacttcagttgcccctttaccactttcccccatctccccctgtcaatgagtaatttatctccagcagcaatatgcataagttgtctttgaaaaggtgggacatggcattatcagtcactgcatgaacgagttatagccagctccatcatggaagagaacagatgattacaatcaataatcaatcaaagaaccagtgacagtaatcatacatcactttccactgtggaatcttcactcactcaaagcttagtaatgcaaaatccactttctgggtatattggtgccttgcctttgtcctgaatctgctcctggtttggaataagcctggaacgtggagcactcctacttggatttcacccttttgggaaggttagcaacagtagagccaaactgaacgtgagagaagaaaagaacaattgttgtaatccttgcctaagtccttattactcattgtatcccattttgtatacagctaaggctgcactggctaaatctttgtagaatatctcttgttaatcaagtgtatgcattttgtgaagcttgtgggcagacattttataactagacgtgtaaatcatgtccagtaaaatatactgtccaataaaaggtataatctccataaaaccagaattaattgggaaaattgtctgggaggtttattggaaagcaaatgattttgcaaaacactaaaataattatttaagggaaacaatatttaaaaatacaaaagccattctatttgaaataaaaataatatattctgagaaaactgatgcatggggattttctaaactcatacattcaacacccatttgcttagcactcattaagcagtgggaaaacatagatctctgcccttaaggaacaaaatatctgttataagaaaagagccaaagcctgattacacagtgcagagtgctcaaggctgtaagagagtttgttcaaaatgctttgggagcacagaggaggaaatacaacaacctgagggagtctggaatcttccatgagaaggtagcttttacactgagaatggaagaaaagtggtgaaaggtcatttcaaacacaagatcagacagacgctgagatggggtaggagaacaaaaaagcatggcattttcaagcaacaaagtgtgtggctagaaagtagaggaagggaacggggctacttgcgggaggaacagtgatatgtggggggaaggaggaaatggaaccatgtgggtatatgtcggagccagattgtaaaaggtctcatataccaggctttcctagaggggaagtgaatagaccaacttggcacttcaagaaccacttggtcctgaccacagacatggagaaaagacaaaaatgggaagctgcggacagatggactaagtaggctgctgctcctaagttaggcattttgctcggtgcaactttctaatttcttccaaaaaaggacttttagagatataggcttcaccagacatgtctttcctcacagatccaaagaaaaattaccaaactgggagcaagacacagttttatcagcataaaaattctcagtaaatctcaaggtatcaatcatatgaaaacatcagtgtttctcaggaagaggtggcctccatcctagatctctaaacagggctctcaatcttcaagaaaggcaaggcaaaagttgctatgtttgatttaatcacatacctaaaccttccaaaatgagtttggcaaaaccccaaattccatctatcccctaggacatgtcgcccttttcttcaagctagcgtgacttttccttaaattttaatattgaaattgctcttatttgaaggatcctttcaatatttttatgcaagaagcttaattcctaagaagactctgataaatttttgcagagaagtttggatcttttaaaatgatctctttaaagttctgtattgtggccaattatattctttctgagaaccagtttagttattattttcttcatggaaggtttagactcagtgcagtgccttttttattttaatcatccttaaagaaatagaaaatgttaataagagagtgcagggagctagtgctgttaaagtggcaggctattggatttgattatttttgtaccagagagtttaattgtgaactctgatttttcttcatctgtttgatgatgaaagttctctctaggtccttatcttatcatgagtaaaacatctcacatctagaggacaaacagaaactgaaaacaataagttgctgtgcttttgcttcaggaaataaataaataaatgcagtaataagttaacaaatggataaagtaatatttaaaatctcctttatgatatatttagacttgggctgcaaaacataaacaagaaactgttgggaagaattttgaaattattagctttcataggttctaaaattaggctgttgtgggatgggtttttggaaattaagctttttcaaaatgatgttttccattcaatgttggaaagtaaacacagcgcctgttgaggctgctgcctggaggcaaacacatagttagctgaaatcctcctggatataaatatctcctgggatttctaacttggaggcttaaaattacagtctaggggaggcagctacagtccacagcatgtacacatttttggacctcctatagccagcttgtctcaccaactattacaagcagaaaaaaaagaaaacaatgacgacgaatgaaaggaaataacacaaagagaacaaagatgcagattccaagagaaaatggcatatggctcttcactgtctgtcaatgcagagtatttaacgaccattgagagattgtaattatgcctcatgccacttgtctaaagccagccaatgatgtccccatgttttatatctccccccataccttaaagtcctattttgcctctctgatcaagtacagctcttttccatgattactagaattttctgtcttctgcccttccctgcaggattaatttttcttgcctataattcaaatgttacactttttgtttaggctctagctgtggctacctaacagaacttcctaccctggattccacctgtgcatgaaccatcacaaagaggatctttctaaaacattccattccagcatgtaaacaactgttggatttggcacctcatccatcctcagcttggcatcagacctctacacctgtatcccaatcttcctccgaagtctcccagtagtcttgcctgcttacctccaactaccatcacacaacttggggctctgaaatttaatagctttctgctgcctttctgccttcttcacagtactaagtcaacctcaactttccaaaaaattatttctatccttttaaaatcctacctattgtaacattctcttctctcctccaacccactgcaatttatttttacttctctgaacatcataatatattactgttacagtaagacaatacacacacataaccacacaaacgctttcactaatatctataaactctttcctgatgtaccctgttcaaactttatttctttcttttctagtctggccacattttgtctctattatttagtacataataaatcctgccttattatttggtaggttttgtctatctccttccattcctccttgctccagactggatacagttcaggataccatgtgaatcttccttatcttcctatctccagtagccctttcacagggccagccttgctatcctaacacctcttcagagagctgtgtccctactacagtgtcctgcttttcttaatataattttctctctagtgttttcttacaaacatgtttttttttcttttaaccttgattgcaaattcttctgcagcagaagttatctgttctccttttgtactttcccacagagctgtacaaaatatcagccacaaagtagaatttgaatacagtgtatgaaatgaataaataaatgaatgagtgaataatgtgtggtggatgacatggcctcggtactgaggttggttagctggtctgaggctgatagacatgtgagtaaaaataataaaattagcctcttgttctttccagatggaaaggagtctggttgcagtgattacatgttaatcagcaatttgggtttggatgtttgttagaacatgaactggcattgggatttcattgtctctgagtcaatgtacattttgagtttcttcttcaattcaagattttgtggggcttaatttaaactgtagttaacttggaaccatagagagatattttaagatttaatgaatttctaggtaaagttctcagagttactgaatgaaatatcctctaccaagatctaagagggagttcaaggtaaatccatgaaaaaaaaaataagcttgattcaagatttacaggagatctattgttccaggagtccccaaacccccaggccgtggactagtattggtccatggcatgttaagaactgagccacacagcaggaggtgagtgcaggccagtgagcattaccacctgagctccgcctcctctcagatcagtggcagcattagattctcataggagtacaacccctattgtgaactgcacatgcaagggatccaggttgagtgcatcttatgagaatctaatgcctgatgagctgaagtggaacggtttcatcctgaatccatgcccccggcccatcccatggaaaaaattgtcttccatgaagccagtctctggtaccaattatatttggaactgctgtattatacaacataatgatgtagttaataacaatgtattctggaaaattgcttagagagtagactttgagtattctcaccacaaaaacaggataactatgcaagataatacatgtattagttagctcaatttagccattccacaaaacatgttatacatgataaatatgtataaattttatttgtcaattaaaaataaacaacaacaacaaaaaaacccacaaaatttaggtatcactaggtaaagatcagtgggaaatcctgctaattccagtagaattggaattctgaaagctgtattcatgtttttctggttgtgccatgtgatgttcagtggcattatcttgatacagtagaatgattcctagatcatatctcaatgttgggttttttcattttctttaaatgtacactctaggacattaatatctctctggatatcaaaactttatcattgcttggcctggagcagtgtcttatgcccataatccaagcaccttgggaggctgaggccagataattgcttaaggccaggagttagaaaccatcctgggcaatatagcaaggccttgtctctaaaaaaaatttttttaaataatgatgtgcacctgtagtcatagctacttgggagactaaggtgggagggtcacttgagcccaagagtttgaggctacagtgagctatgatggcatcactgtactctagccccagtgacagagcaagaccctgactcaaaaaaaaaccatattttaaaaattattgtccctttttattgacattgctttgtcttttgtttaaaagtcattcaattttagtggcatcaaagcatttgatattcagtatagttactgttatttctcgaaataaatgtgttattcactaccgttaggtgtattcaactgcctttttttttttttttttttttttttttgagactgagtcttgctctttcgcccaagccggagtgcagtggcgctatctcggctcactgcaagctccacctcccgggttcatgccattctcctgcctcagcctcctgtgtagctgggactacaggcgcccgccaccacgcccagctaattttttgtatttttagtagagacggggtttcactgtgttagtcaggatggtcttgatctcctgacttcgtgatccgcccgcctcggcctcccaaagtgctgggattgcaggcatgagccaccgcgcccggcctcaactgccttttattagagggaaatacgtgttctggggcctcaaacatgaggttgtattgcaattgggtggtgatagcaagaatatcaaggatgaaagtagtgttttattgtcctaaaagtcttctcaaagtcatggtcccgtttgattctcatagctatccggtaagctaagtaaaacaggtgactgcctctacagctgagaataagatggctcagtcatttcacgtgacatacccagataacatcgtatacaagtggataagtcaagacgggaagctggagcttaatatttctagtgcagtgttcctcttgccattcttggccacctcactcatattttatccttgttcaaggaccagatggtcttctccttctgctctattgagcaaaagcaattgagctcagagctgtgaagataattttaattatatcttctcattaccctcaacactgttgatgattctctttagtgccaaaaaataataataaacttgggtggattaaaatttttaacctctgttttctatgatgaatggagatagcattcataattctgagaagagaaaaatctaaattctactcccaggtcctctgtgtcctagtatcattacctttggaaagtcatttgggtgcttattcttagaactggagtatcaagggcatggacagataagcacaagcatccgttctaacctcaatattttataaggtttgggcatgagtttgccttgttcatggaacagcgtggagaacttcccctggacttaatccttgataagaagcaggacttggcttttcatccttgatattcttgttaaatggtgtcagtggttctgaaatttatatgacctggtccctctccactttataatgaatgaatctatggctttggtcttgttttgggaagctccttgtatggcatctagacatgagaagagtggcttaaaagtatatgatgtgtgtgtgtgtatatatatatatatatatatgtgtatatatatatgtacacaatccttttagaagcaaaagacttagactatataaaatatatacactatattatatcaaatatgtaatatataatatctcagcaatatgctagcaatatattatatataataaatatatatatttataatacagctgtccctttacatttatgacaccattacctttatacttaaaataaatctatactaggacctatcttgttatattcaattagctcctgaagtaaaaatgcaacaaaatgtatagtttttactacagaatgatccacctctcatcttggatgcatcctctgaatttgaaaaatttttctaaatatttaattcaatagtagccactcgaaaaatgctgaaaaaaaataaatgagtgtaaatgttcaacacaggcatggttgaaatacatgaccattttaaggtttgaataaattttttaaatgaagtaagtgtcagcaaaagtaatttaaattaagccacagaaccaaaatatctagctatacagttggagaatcatgtatgctgtgatgtcacaaacactgtagaatttctgttttaaaaaaaaccatcaaacattgtaatgaattgaaggggtcaggggtagttctttggaattctagtctaaaagaccaagttgaagagcagggccgggtgcagtggctcacacctgtaatcccaacactttggaaggccgaggtgggcagatcacttgaggtcaggagtttgaaaccagcctggccaacatggagaaaccccgtctctactaaaactacaaaaaaatttagctgggtgtggtggtgcatgcctgtaatcccagctactcgagaggctgaggcaggagaatcacttgaactggggaataggaggttgtagtaagctgagatagtgccattgcactccagcctgggtgacaagggtgaaactccatctaaaaaaaaaagcaactaggaacaggattgcagatttatcatagaaggatgagttgaagatgttgtgaatgtttatcctggagaagaaataggaaaatgtgttaaatgctattgaatattcgaagctgggcttaacctgccctttagttccatgaattcaaactagaggttaagatgagagctttttacctcagtatgagaagtagtagtttcttggtcagatctatcaggagagagcctgggctccctggggaggctgagttctttatcaaatagaggctagacagaatgtttaagagaagtgctgccaaatagaaaataagaatgtgaacagagaaagatgtgtagttttaaaatttctaataaccatattcaaaaagtagaagaaatagattattttaattgcattagtctcctattcaacccaatatatttaaaatgttatcatttcaacattaaatcaatatataattattaataagaagtttttacatttttttctactaagccttcaaaattcagggtgtattttacacttaacagctcttctcaatttgggctagcaacatttcctccatagctacttgtgtctaattcgtgctgtactgagtagtgcaattttagagtaagcaagaataaaaaccaaccttgaattgctgtaattcaagaaagtattcttatttgactatcacaggggaagaatggacatccttttccaaataaaggcactgtgtggtcaagaaacagatttgggctgatgggataattgtgaaacccttggggctgtggagaaaaggtgaagacaaaccatcatagatcatctttgtcccatataccactctcgtatgaagtataaaacagagccccctctgaacagataaaaaccaaaaaggtgcccctgacccttctcccataccaggacaaaaacttaaatagagagcagagctgggatccagccctagccttgcccattgagctgagcatcctgttgaggcacttcctggcatctgtgtacctgtgtcctatcagaaccagtttctgtagtagctgcaaactgcagtcttcaacaatgatactgcaactttaaataggtcacaggtctctctcagaatctgataaatgctatgaaacgcttacaaaagaaaaattgtcaaaaattcaaaactcatgaacactttgaaatctgtggacctgtgattaacaaaactggccacagtagtagctgactgtattttcttgtgaaagctttaatttggccctgttgttctgagggacaggagaacaggaacagaaagaaaaatgtatgcttatcccacccgtgcctaaaatagctttcatgaatgtgaattgaacgatatttgttttcctttttattttgccaagtcattattccgtttgaaccatctgaggatttttgtcctgctgtcattggctcttcccgacattttcaccttgtcatgctgggggaagagtacctggtgataactaaattgaagcactgaatattttgacaccagccaaggaacaagatggtcatttggtctatttttaatgtcatccccattggcatttccttccaggtagtttttttttctgtttttctttctttctttcttttttttttttgtggcaccacaagacattccttccctgctgtctgcttcctgctgtgatcaatgctgatgatcacacaggttacattttatatcaagaacagttgactcagtgtgctggggctgtagttcacacccccagttcttgctctcctctgctattccatgcatgtcaaggctttagaacagtgagcagaaaggaaacttgtgggactttagccacctgtatcataagtctacagtatcatctggaaaaaatatatgtagatatagatagatatagatagatagatggattgatagattgatagatatatctattctgtcttttaaaaaaatacccccttagtttgactgaatgttgtctggaaaagttaagagtttggcacaacaggtagcaggtttctctttccacctgagttataaccattattctcacccattaaacctaatgaaggttagattattgagagaaatactgcactgtattatgcctttgcaattgccactgcagctcagcttggagatggaacaattaagaactttttaagaatgcttagcagttcagaggtgtgtgataaatggataagaaggaaaaaatatagctctaagaaaccaacggaacatccaacctgcagggaagataagatgctcaattagatggtggaagcatggaccgctctcattcttagtaatttttataccttggggaagagttgcttttgggatttagtttatcaggatatgtgagatactgggtcagacttgatagcttctccctgggaactgtggggaagtactggcctggagggcaattctcgagattgccttggtggagggatgccttcttgtatcaggaagtgctgaagagagcaggcttttgcctgccctgatgctttcctgcagtgatccccagaagctggtaagtggacaggttctcttggttggtcactccacaactgtgagccaatcatagtgtaacttttttgaatgatgctcacagcctcaagccggttcagctctctcaatggtggcttcccagaacttttgttatgggaaaaaacaggtaaaaggttcagtatcaccatgagggggattggtccattggacagtgcttaatgaacattgaaggaaatagttcccttgtacccggataatagtataaatttacatatactgaggtcccaggagattatcataggttattgtaataagggtcatctttgaagaagggaatttttcttagtttacttctataaacagcttcatgggaagattattcatatcttgagaccaggggtcatatattttctcactttatgtgttagcagtagactggcatgtgccttctataagggagtgttgaattcaggaataaatagtactaactgtttgttattacttacacatccctacccatttggatacagtttcttacttcaatggccacttgttacacaacttttccaattttatattgggctaaatgcagtcaggagtaaagaaattaaatatgtaccaccaatgcccgtcatttaagtgtcaaatacacattgcttacttagcatgtctatatgtggaatactattttaggtcctatgaagaatttctaacaaaccaaaacaaaatgattcctaccctcatgtggcttgcacttgattcgagaggtgtcttcctaaatgtatatatgtatgggtgtacgtgcacacacacacacacagaggaaatccagatagctagaaaactaaattaatacaaaataagatcacgttagcaaagtacactggagatctatagttaaaacagagaataggagtggtgttgatggggatgtgtggatgcctggggatgtgtagatctggaatttgtagacgagaaccctagattgacaaagaagaaagatcaaagccacgacagtatacagcaaagaagtagaaacaaataacatatatgtagggagcagcacagcctgggttgtccagagcttatgaagtagatttttcttcctctctcagacaacacctacttacctctgacagttcttgactggggacacctatcagaaggggactcatagcctagcatggtaacaggatgaaaagatgttactgctggatagagcgtgggaggcatctgggcctagtccctcaatttgcaaacagagaaattgaagcccagagaaattatatagaatgtgatcaataataatatcatcatcatcatcatcatcatcatcatcatccctggtaaattgtaaagctggtattggaacccaggtatctcgagaccttgtagtgaactctttgtaccatgtcattctatttttcaattggcacttgggttgctgcttggccaattctcatgctctgtaaacctataaagcagatgggaactgcatgtagcttggggaaagaaagccaaagaaaaattgcttctaccaaattgtgcacgatggatccaatttagaagtctgtcagaacacgggcagctaatagagatatactcagaggctgtctggaccttccaagccactgaagggaaaagagcacaccgtctggagtcaggggatttggtgtgagaaactaactagttgccttatgagaatcatttaatctaaagttcctcatcattaaaatcattaggtaaacttagaatccctttgaaatgctaataaaatgtcactgaatttatgctgacgtgactataatcttcaagtcttatccaagacatccaattgcaggcacaaactgatattcttgccaaattggcaagctgctctatgcacttaaccatgtagcattatattttattgggacttttaaaacaaaattcttaatcttaaaagcgaaaatgttgttaccttgccttgatcatggaactattgtaaattgggagaaggaggaaaatatgtttatcaattgctgctggatatgcattaattttagtccactcattccactccctcatttatttgaatgtgtacctgcattcaatagctatttagtgagttcctattggtaaagataaattaggcagtgtgggagatagataggtaaattctgcccacagcatgttcatagttaatgtgaacaaagccagttacataaataactctatataccatgagatgagttgtttagacatttgaaagaccagtgaacaaatactcataactgaaagccttataaggctttatagggaaaatgaaagtttaaaagacctgttaggcatactgggatttcgttacacaaaaatgaaaagagggggcatgttaaggtgaaggaacagcatgagcaaaggaacaaaggcagggatgttaaagggaggaccataaattactaggacaatcatcgggacacatttttggtaaagggcaggatagtaaatattatagactcttcaggttataccatctctggagtaactactcaactttgccatgtagcccaaaagcccaaaagcaaccatagacaatccataaagattcatggctatgttccaataaagccttaattacaaaacaggcagtaggctggatttggccctcagcccaaaatttgctgatttctatcctcaggtatggagagaaagaacaggaagaacaggctggaaaggaagctggatcagaatatctaaaaccttctattagctctcctaatgttaacgtcttatttgttaacatagccttttcttttcttttccttttacaacattggactcaaatttccaatttgttgccttttgaaaacacaggaatggttgcttccatgattatgcaggcaacactttcttaaccatccttaatataggccaatattccaaataagttgtgaaagtcaccctgactcaggggcttaaatgtaaataattaatatgtgtttcccatcatatatatcagtgctggggtaaacaaccatcctgcttttcctgagactgaggggttttccaggagagaagactttcaaggctaaaacaggggcactgctgggcaaaccagtgtgcttggtcaccctaattagtcaacgttagcatctcaagtaggcaacaagcgtccacatcagttctaggctggttatatatccagttaaagtgggcaattgctaagctagccattgtttcacagaaataacttctagaaagagagagcagataagctaagtaagtggttttcaattcgaaaactgggttagtgtaatgcaaggcacagccaatacaggcatcagcgaaatctcccagaaccccagcctggagatcctgagaaagtgttggatggcatttcagcaaaaatgtttacattcagatggaatatttggggtctcaaattctggagaaatttcccatttgtagacaaaatgtaagtgatttgatcagtattacccaataaagtatctgcttctatataattactcatttctatgagatactgaagaaaatgtatgtttagacattgagattctaaaaagttttgtgaaacattcttcacagatttgactatacttggatctaaatatccctgcactgcattcttcctacacatatttcccttttttcttttagaagaaatcactgctgagatactgaaaagtgattagaggagattaagatattaaacacaatatgagcaattttctgatatgggactctgaatgcacttttcatggtctttacaaacttaaaccttcagtgatggaatttgatctagtatttgaagctcctaattggattttggagagaatatatagataaaaattaattcatgccatgttatacactgtcagttcctgcatttagcatctcattcctgatgtgacaactagagacaccctgtgtacactggagatacggacattctagctttgatacattccatctaaatatttttctcccctcttctaaccagctccttctatcacatgcagttgctattctcttatccccatttgtctcctgtctggacacttaccttataagcacagtccactttttgctcataagcaactttccccctccgactaatttgtctttgtacctccttcctaaagacccaacaaaagaagtgctaatgacttgtcctccacacggtgaaccagtgtttttctacctattcctgtagcctcattcctaccaccactactagagtgaataatagaatactagagtaataaggtaactgaccatggtctaggacattcatttgaattgttaatttcatctttttgtagtagcatctcctattttatcaagcagccttactaacacagagtttcatcttttgccatgcatgacattacctgatatttagaatataaactatgatttgtatggctaacatttattttatactttttttcttttccaggcactgcttttttttttcctttacagaaattgtctcatttattctttataactctacatgttatgcagaagaattttgaataatctaagtagatactcccctttctcaatgaggtagagcatgactctgcacttcctcagtgtagtgtttaattccaaagagtaacctatggaaagaccaaaaaaagtaactttatagtagagaaataggacacacatcaccttagccaagtgttcaaggtggatatcaacagcaataggtcatgttgatagtatgtaccctttgtaggatgtgatgagaatgacactttacctctgtgttctttctctctaaaaaaaacatcgcccaaacataatcatgagaaaaataacagaaaaaaacccaaatgagaaacattctacaaaacacctgaccagtcctccttaaaactgtcaaggtcatcacaaaccaggaaggtctgagaaactgtcacaggcacaacgagcctaaggagacatggggattaaatgtaacgtggtctcctgaacagaaaagagattaaaaaaaacaaaactaaggacatctgaataaagtatggattttattttaaaacaatatatccatattagttcgatatctgtatgtgttctatttgatgaacggtttctcacttggcattctttgttttagtgacttatttgtctaagcctatgggctttgatatctagaagtccaggcaaaatcattactaccttctgtttctcttacatgtatcaatactgccccctgacacacacaccaaatccacacaaggctccaaggtacatatcctaatacaacaagaggaagatataaactttgtctgcaacttaagccctggaatagacaatactgctcatgaggatagttgaaatccatgataggccaccaaagctgactgtggtacctctttccatctctcctctattaggaatagtaattcatgctgcaaagtgtgtaacagatgcactatactagtgtaagatgttaataatgggagaaaataggtgtggggtgtatgggaactctgtacgatcttcacaacttttctgtaaatctaaaacaatttttaaatgttattttttattatttttattattttactatttttaaaagtttatttttaaaaaaatgaatgctaatgataacctggaataagaggtacatgtgcagatgttagggacaaatgtatttgtatctttgtgaataaaatgtttctacttttcaaattcagaaacaatactgttgtctacagcataaaacaaggtcaaagaaaagagtattttaaaattatccaacaagcagagaatgtggtcagtggcaaaagtactagaactgtgtgccaatgatggagatcatggcagagcggacataatgggcacttggcaggcatgttctcttaattgaaatgtcagccctgttgggtacgatctatgtaggagggctcggaatagaaaagaaaaaggtagcaaggtagaatcatacttctgaaatattaatagtggcaatgaacttcaacttgacagtgaaattgatagtaaagcatttaagaagaggacacagcaaatggagaaaaataaagaaaacctcagtgacgctctaccatagcttgttatagtaatatgattacctttgaaggaatactcacacttcagaacataaagttgtgctaacaaaaacagaagaatcaacaagattaaaagcatttccatagataagacaatgatccagaagttcaaaagagggaaagatgttcttcctacatttttagtagtaacactgctcatttttacaagcaggctttgaataatgaatgagctactcaaattcatgaaatgataatacagaataacttatgaaaggtcatgcagcctccctttatcaccccttactctcctctacacacacacacacacacacacacacacacacacacacacactttgcagcatgaattactatttctagtagaggagagatggaaagaggcaccacagtcagctttggtggcctatcatggatttcaactatccccatgagcagcattgtctattccaatggttgagctgcagatgaagtttctatcttccttttgttgtattggaatatgtatattggaatcgtgtgtggatttggtgtggggggtattgatgcatgtaagagaaacagaaggtagtaatgattttgcctggacttctagatatcaaagcctataggcctagagaaataaatcattgaaacaagtaattccaagtgagaaaccactcatctaatagtagaacacatacagatacagagcttacaaaaagtggcggattgataggtaggtacatgaaaataggtacatgtgctgaaggtcaaaggcaggtagattctacttttaacattaggaggagacccacaggaattaggagggcaaagcaaaatgaccagagaaagcataggccattcgaaggaccttgtttccaagaaaaggaattgttatcacaggaaacctcttatgtgatttccggtaccattcaaaaccattcttgagatatgtgcatcctagggcctgagttgaggatacagttttaaagggaaggttgaataggttggaaacaattaaagttgatttgggtatgagaaaaatgtggcagtcaataaagaacagaattttttaaatgaaaaagttaagctgtttataaagaaacagaatggataagaagtgtatatttatcaaactatatgagttcatttttaaaaatttggggacagtaaaagcatctagcaagattcagtgcaactatttggatattttacctaattgtctacaaatttttccacgtgctactaatgcaatgagtaatcaaggcagttaattaactggcttaaggcaaaaaaattgtcttcatttattttagtaattaagataattctaattgacttgaaattatctaattgacttgataattctaattgacatgtgtagatgtaggctacatgtaaagaaataaatgggctaaaggaaaaaagaaaaaagtatttctcacacttttcactgatgatatgtatacaagaaaaatagcacatacaccaaaaaatattttaaacataatgtctatttgtacctaagcatttaagtggaggaaaatcatatgcagtttcacaggctgcaggttacagcattattgggtttaaaggttcaaagggaaatgtcttttttaattcaacattaagattttgacacatttagttcattccaaaacggcagaaatctgatagtaaagggttaaatattccaaatttgagtttaggtttttaaaattctcaggtcacttctgattagagagaaatgtatgtgtatatatagatgcacatgtatgtgtatatacatacttatacaaacatatatacatatacacacacacacatatatgctttaagcagctgatggtgtaataccaagggatgccagagagacagcagatcactcactttttcctatctgtgtttcctctccaagaaccaaaagaccttttgacttgaccatcatagaacaaatatctgtaaagacataggctaagcagggactgaagtgatggagtgggagggtgaagtggtataagttttgaagctgccctgaatgagttcaagtcagcttgaccaggcgacacaaagagaatggatcaatgaaccactgccaaacatgaatttctgttcaacaaacatttattatgcacctccaagaggcaggcactgtgtgaatttctgagaatacaaagatgaatgagtgaggaaccctgtcttcccagtgtgagtgcacactctgggaaggaagccaaaaatggtagacaataatgacagtgtaaggagggcaattatagagctcaaagggggtctagaggagagtaggggaggattaatagaaaggatgctgtttgtgctggttaaggatgaataggagttttccatatggaccagatgtgaaagccatttcagaggaaacaatatatgcaaagtcatataaaaacagcacatgcaaaggcatataatgaagacataatgatatatgtcacacagtgccacattacaagttgtcatgtgatagtgactttaagaaagagtacagagccaggaggaaataatgctaggttcaattccctctctatagtacaccagctgtaccatttgaaaaagttatttaccttctaattttcagtgttcttatccataaaatggggataataagggagactaggtcaaagatggttgtattaagtgaaacaagtgctctgtaaatgttagctgttactgttatcagggttaattaggcattgttggatcacaaagtagaaatggcctcaagttaaaggaaaaatggcagatataaactctaaagaaagataactagtgggttagtaataaaggaatgcccaaaggatgggattaatgagacattatccattttcatgacatgccacaggtttcctgtttatcctgattaacatttccatcaacctggatgaatgcttctgaaactcatagatgacataaagttgcaggggctgcacttgacttggagtgacattttccagcttccaactgatattgattgactagctgaaagaattgttgaaatctgacaagatgaaatttaaattttaacatgaataatacacagtcctgactttgactttacaaaagatcagtgacagatcagaaaaaggcctgtattagcagaaacgtgaaaaatcaatgattggggattttagttggtgctaaacttgatgttgttcaacaataacacagagctaatgtgatttagattacataaataaaggaaagggatacctagcatgatagagacaatggtctcattcttctgtgttttggccagaatatgtcttccatgacaaattctcagagacatttacagaccaattaaagtaaattcacaggctcactatcaggatggtgaagtaacttagtcctctcatttaagaaatgtgtataagatctgaaaaggaaaagactcaggaggacatagtttctgctcttaaatatatgaaaagtggtcatgaagaaaaggaattaattaatttgaatagaattgaagggtagacttagggtgaatgaatgaaagataaaagatagaatttaggcttggcataagtaaactctaagctaacttcttttgagttcaaaagactgaaggtggaaggtgggggtgagctaataaagacttgctggtctcattgtaccaggtaaaaactttatggaggaaactattgtcagtagagtgttgtgctagctggcttttaaagtgtcatcatacctgaacatttctgagtctgtcataataggttttgacaaagaaaactcacagtcgaagagcagtgtaggtattttagatatcgtctaaaagttggtcaaagaaaatttggactaacataaacctgaaggaggactaacaaggtttaaaattatcatccacagtaaaaacttttctagggtcatgtgctgtggagaatttcaggcaaatgttgagttctaattcaatttgctatgtattaatgatttgaagaatgaatagcatggacattagagtcagtcgatgtttcctaatttagtgaatacagaattataagaagaaagcaatgtacatttttttcttttgttatgccagtagagccctataagctgaaagaagaatgaactagatgatctattcacttctgttttgcacatctatatttctacagtggcaaaaagaatatagtgaagactgggagcatggatattttgatattggccattaataatgcacacaggaagcagaaggactcaggtttgctttttagtacagattttggtttggtaatttcgttctaagaagactgttttttaaaaaatctgttattatttaattatatcaaacaaaaggatagcatctgatttcgattcatttaaccttaatggaaaagaacaagtcattacttaaaggatgttttatagactgtgttatttctggtatttttagaaatcatttattcctcttcaaattgatgtaatataattattcattaataactcttcttgatgtctctggagtcatcccattacccacagtcattatgcatcattgtgtgaatgtttgctctaatactgagatatctatggctcattgagtcattacatccattggtgtctatccttttagtgaagaatatacaatttattttgaatcaaatttcattgaaatactttccaggaactgtataagctgctcctaagtccagggagaagaataatacagatgtagcccctaaataccaatcctatacattcctcatagaaatcgctaccttggctagaatattcaattcctgttgctgaggtggtgccccagaggagacttgttcgtaacttatgagtccaaagttgtaacacaaaacaacttcccgtagaatcattgccataactatattatacatttaatggtagtttgtactagaacccattatagatgggttcagtagccatgaaaatgtctaaaaacataaagacaacatagaatatgatttcctctggataatggtaggtaggttagatagagtggtcatagcttcccttgaaggagaacaaacttggtaaatagatggagagaacaaaccacattctgtgctcatggttagaacatcctgcagcaaggaggtagaagagcagaaaggaaaataccccaattcatgcaagggcagaactcatgattagtgtccttcattttcacagtaaaaatctcacccctggatggaaatttgagatgctaatgagacatgtaacgtatgtactagcatgtacaacaatagcacatgcacccccaggagaccacccagaacatgcttaatggcaacactccttccccccacctcatgaataattgcacatactcccataaagggagtttccccagtgtcaattggtgccgccgtctcacctttgagcagctccctctgatcagccatcagaatgtactttcgttttatgaggaattatttgtattttggactaactctcaaattctcctgtgtggcaaagtcaagaacctgaactggcccaatggctataacaacattttggataccaagcaaccacagtgtatttgttaaaataggaatacagacactgcttcatagattgaaatacgtagcacggtaaggataactttttaagttacaatcagctcaaactttaaaatcactagctattttctttaagttaatctaataataaattatatgctgtgtaaatatttacacatattcgccccatttcttagaaaagcacaagtataatctttcttcaagcaaatccagtgtatgaaaacagttaacaaagtatgttagtgtatggttattcatatcacaagaggtttttagttacaaaaggatagcgcctagggtttctttaaatgttgcgtcccattatgcatttaaaacagtacttagattatccaaaccttcaggaataaatctattatgtaaagtaacagatacatatattaccttatttgtgaagtttggtgaaattagttatttggtagatgattgacacaagtctggcagggagccagcgctgtgaaaaccaggaatttctgatccttggggttgttatataataatctgcttccattagaatatttatgatgagttattttaaataataatactattgatatactactttcaaaattaaagtataaagtttactttctcaactacatagaaactttaggaatagtttttaaaggtgagaagtctgaattcattcattccacaaattaaattttcaaaactaaatgtctctaattcttctacctaatttactctgtcactcaggctggagttcagtggtgtcaccctggttcactgcaacttctgcctcccagattgaagccattctcatgcctcagccccccaagtagctgggattacaggcatccaccaccatgcctggctaattttggtatttttggtagagactggttttagccatgttggctagactggtttcgaactcctggcctcaagtgatccaccctgccttggcctcccaaagttctgagattacaaacgtgagccacagcagaattcaatatcaaatatttttgttcattttgttttgctttataaataatgttgtgagtatattatatataaatttgtgttcttatgttttccttcagaattttaatttgtgagcttttcatactatgttaatacaaacttttaataattagcatttgaatgatcacagtttcttcatgtagacataactgtttattattgaaaatttaatatcattattggaaaaaattattgggaaaaacaatttattgagaaaaataagatttttgttagtgtaaataacatttattattaatattactattaattaacatttattatgataatacatttattacttggaaaaataatattttgctattatgaataacgctatatttagcaaagcttcgtagaaccattaagaatttctctacacatattgtctaattgctttacctactgttttctatacatacatattatgtatttatatgttacatatgcacacatatatttttcttatttatgggtgaaagattactagtattcctatcattggcagtgagatgaacatattcctctccagattgcatatttgcaggatactatgttcctctattttgccgtgttcatattgtgatttaatacaaaattcctagaaacttggtgaggtcagtagaacggggtttatcacacccatgtagtggggtctcctattatccaaagacaggcatcaggtcagtggaaggagaacccgggtctcctcagtcctggattaattacatctacccgaattttaaatgaaaaatgaaaaacaaagagtgcatctataatttctagccagcatctgagatggaaaaggcattttctagtgatgaataggctcattatgttctcataaattaactggtgaacacatagttagaaatatagaattttagagccaaaggaagcctcagctaaccccatctcccatttgatagacaaggaaaccgaggttgggacgggtgatgtagtttgcttacggttatctcatgaataattgcagaactaggattaattgtctcgatttctaactactcgtttctccactaccccaaacaaactactgcttttgtttttctttaacccaaatgttaatttgcttcattattaagacaggtttttttgttttgttttgttttgttttgttttgagactgagtctcgctctgtcacccaggctggagtgcagtggcacgatctgggctcactgcaacctccgcctcccaggttcaagcaattctcctgcctcaacctcccgagtagctgggactacagacatgtgccaccacatgtggctaaatttttgtatttttagtagagacagggtttcaccgtgttagccaggatggtctcgatctcctaaccttgtgatctgcctgctttggcctcccatagtgctgggattagaggcgtgagccaccatgcccagcctaagagaggttatttgaaatatataattccatctctattaatttatctcctgtaaaaagagattccctctcctttttcatgccataaaggatccagacagccacaaggcttagcatgcaacactgacaaaatgcacaaaagaatcaaaatcgaattaggtaatcaaaaatgaaaaccaaggtactgcaatatgaaataatgtaaatcatgcacagcaaacctatgtataatagaaataccatgttcctgcctgtttctctaacccaccagttattcagtcacaagtaatttactcttagaaaaaaaaaagggccccaaatttgatttatttccccatccaagtaaattttaaaaggctgccaaagctttctacataaatctcaaatatcttcccatattgtggaggagagagagagaaagagagaaaagagcttattatttatgaagctaatcaggcaggcagaggaggagttagcttttaactttttcatttattatttcctcggagttaatatttcattgaaaagcaatctataaacaatatctttgggagcttatacagaaatgacttaaagattttttacattgtaaatgagtacctcttattgcgtatattccatgccccaccatttttattagcaaggttatttaaataacaaagaaaaagttccaacttttagttatttattggtttaagccaaggatcagcaaacattttctgtgaaaggcaagatagtgaattgtatatatttctggctgtgggcgcatgatctctgttgcaactactcagtggtgcctctgtcgcaggaaagcagccattaaaagtatgtaaataaatcagtatgtttgtgtcacaataaaactttatttatggacactgaaatctggattgtatataattgtatataattctgtgtatcatgaaacattgttctttccgtttattcaactattaaaatatgtagtaaaccattcttagctcactgctgtacagaaagagctagacttgccctggggccatagtgtgctgctctctggttaaactgaataccctcattgcaaggattttggtatctatggcctctctcataaacaagtgagcctgtttatgaactagtgagctctcccagatagtctcccacttcatccttctgtagaatagaaaaacaaaaaatgaaggaaagcaaaagacacctcttaaatactctttgatcttgatccttgttgagtatgtatagttccacttaaaaacctatacaccagtccttgatgcttttatctttttaaaataaactattactgtgcatgaaccccctttgaaatgtatcattttctgccctagagatgtttgtatatgtgtcttttatttggatgtgagaatgtggtatggtgtgtgaaatatggcaattactggatgtgatataaagtatttgcttattttcttaaacattgtaatataaacattttttgaattcaaatgtcttaacagaatgattcagatattgcattttatgtaataagtttctgtatcaatttttccttacattataattttatgtgttcatgatgctaaccatttggatatttggaagcatatggaaggttgaatatttcactttatatccagatgtttggtgttattcaatactgatatataggaaaagaatatgctcagccatctttattcaagattttttttaatttctttattgcccataaaagtgatgatttacaaatgtacaggtattatataggagtttggttaaatatattttattggtgtgaatgcctaaatatgatttagaataaaatatctattcatattttagaaacattgaatctgtaattctagagtttttatgattttatgtgtgtgtatgtgtgtatgtgtatataggcagagatcaatatgtgtatatataatagatatttaaatacacatgtataaatatatacattgatctttacctgcatacacacacacacatatataaatatatacatatatatatgtttgtgtgtgtatgtctatgtgctacacacacatatatatatatatacatatacacacacacatctggcagttttggaattgatctctgcctgattcttatctgtaccttagtttatacatactttaaatattatgagtgtgctcgaaaaagcgaatgtggaaacactaagtgaatgaaactttattttttgagctggtaactattgtgaggattccctcacttgcctactgtaacaaccaatccagggctttctgctcaaaaaagaacttcatccttagagctatcatgaaattatatggtgatattcacttcgcggtgggttttacattaaatgagaaaatgtgtgtgaccagtgctttgtaaattgaaaaatgctatacgcccattagctgttacctgttcaacttcactgaaactcctcaatccatttttctccatcttatttcagaagctatttctaaatcagaggataagtgtttttatcactggcttttcttttagtagcccatggatgcattccaattttattatttcacaagtgttaattaagaatggttaattgtctgctatccttagccctacattaaagtgctgtacagaagacagagacatagcaaagtacagactctcaggagactgacatctagttagggaaataaaaacaatctagttagggaaataaacacaccaaaaatgcattggtacaaaatgggatggtgttgagcacaagttcactaagctctcagaggagggatactgagtatggcaaaatcagattcactggtgagttaggattttaccttggccctaaaggaggggaagagttttggaaagtgctatatgaaccgacattctttaattagtaatttggcacattctcctgaaacggtctcttgttaaggtaacagacatgaattttatatggagctaaatgtctaagtcagcctttctgacaatcaacattcatgggtcccagattccttactttatatataaagggattagatgacttgtatcaaaccactgttcttactttatttagccacatagagtttgtttaatatttaatttaatggaaaatagcaaatagaaatgaccttgccaagtttccaagaaatgaagagtggtcaatcatcatgttaactttcagtttccttttcacctttttgtgaacaaaataacaatattcagttttgcatctccaaacactgttgccgcacactatgatttatatacgagtatgattaggaaaaaatgaagagttgaatattgtcagttgtatgaaaaaatggtgtgagctttatgtctatctgaacatattagagcacataaaaagaacaattttaatcattttctttatttttttatttttattttttatttttgtagggacagagtctcaccatcttgcttaggctggtctcaaactcctgggcttaagtgatccttctgcctcagccccctaaagtgctgggattacaggtgtgagccaccgcacctggcgttaatcattttattgaaacaacagcagaaaaattgacttctgaagttagcatctgctatgcatccattagagacttacattaaacattaggacaaaactctgatactttttgaccagttcaaatatcagttcataaaaatgaaattcatcatctctccgttaggtagaagtggcaattttcatcacatcctcagtaattaaaaagtgtctacacaatgggaaaaggaaggaagtcaagattggctatctaaagctgggtctatctggataatcaaagctacatgtaaatattagttttttgatgctgacttttattttacaataaataaaattacagccatcactactgtcaactcataaacataggtattagaagaaataaaaccctcttcaactcttgtcagaatctataagtatgaaaacatacaccatgttttttaaacactaattgacaccagagacaatttgccaaattcctgctcgagcgtttcattcaaatctgaaggagggatgtgtctaaatattagtatgaactctgcggtgtcttacatcttgtatgaaacattccatcttcagcaggcacacataaggatgggaaaaatgatcttttgacataaagttttggaatctttcaggaacactaagtttaaggtcagttgtttcctagtgactgtgccttggtgactatgcctttttgcatttgtatacaattaaaagggccacttgtcattaaatagagtatacacagcttttctatattgctttaaaaattatgcaggtagatttttccctggaactatatagaaccctatctttaaagtagtctcctcggaactgcattgtattagcacttcctgtttcctggtgtcttatttaatagtttctatttagcacatctaattgaaatctgttgtctgtcatttggccaaagccaggaatgccccttagtagggttctgtgccaaaatccctgagtctcacccactgtgttctagtcaattgacttgcaaaagcaaagctttgggaacttatgtagaaaagtaggtcaccggtccaatatagcattcctaatagtaaaaagtagaagcatgttgctggttgttacatttcatgccaattttcatccagttcaaattatggcactcttctatgtttcttgtgacctgctttaaattaaagatgcttactaatagtatagattctgtaccattttaaagtcttctccttggattttcttgtcttcctcaaaggattcagggttccaaaagtaaaagatgacaataaatgtagaagaggtctatgagagaatagattctccatttacatacatgtgcatattatttgctttatagtcattgttctaactttcagagagatgaagttattttgaaagaaattactgggctgagaatccctagctcttctttaagtttgttaaatgtgtggtcctcttgttcagatttaaagttcttaagcatgcactaatagtcatcgtgttttcctcatgttttcaactgtggcagtaagaagtaatatatacctaatctcataattttgtcctctaggttttgaaagacattttgacaaattacatgtgcattttaaataggtttcttcaaacagaaattttaagaataagtaacttcagtaatagaaggaaacaactcttccaaatttagatgtctcttctttcattgatctttgggcccagggtatgggatatcttttattataatattgggggggggggtgttaaaatgcctctttcagcacttgatgacagttggagagtcacttaagtaaaatttacctgtatacaaatacataaaatttcaaggatttcatggaactcatgaagactattcaggaccatggaacccagtaggaggagctctttgtagtctagagagaataaaaatctctgtacatgagcgcagattgcttaggcggccttacatcaaaatgggtacctagagtgtgttgctggagagtaatactgacttcagtagaagccaagaagctgatctctcacactgcttgcgaaagggaagcatgttgaaattagagggaaatgtaaaatgtgtaagggactaagaaggaggtcttgcttgggaagaagctggacctagttgaacaaattgtctagctggaggaactgcagtgtaagacttctcttctaacctggacctcactggattctatgtacttttaaacatttatattttttcaaaacaaataaaaccctgtctctgttctatttgagcatggttaaaaatgataatgtgtcacattttctttatccagtctatcactgatgggcatttgggttggttccaagtctttgctattgtgaatggtgctgcagtaaacatacgtgtgcatgtgtctttatagtagaatgatttataatcctttgggtgtatacccagtaacgggattgctggatcaaatggtatttattgttctagatccttgaggaatcgccacactgtcttccacaatggttgaactaatttacactcccaccaacagtgtaaaagtgttcctatttctccacatcctctccagcatctgttgtttcctgactttttaatgatcgccattctaactggcatgagatggtatctcattgtggttttgatttgcttttctctaatgacgagtgataatgagctctttttcatatgtttgttggctgcaaaaatgtcttcttttgagaagtgtctcttcatatcctttgaccactttttgatggggttgtttttttcttgtaaatttgtttaagttctttgtagattctggatattagtcctttgtcagatggatagattgcaaaaattttctcccgttctgtaggttgtctgttcacgctgatgattgtttcttttgctatgaagaagctctttagtttaattagatcccatttgtcaattttggcttttgttgccattgcttttggtgttttagtcatgaagtctttgcccatgcctatgtcctcaatggtattgcctaggttttctttgagggtttgtatggttttaggtcttatgtttaagtcttaaatccatcttgagttagcatttgtataaggtataagggaagagtccagtttcagttttctgcatatggctagccagttttcccaacaccatttattaaatagggaatcctttccccattgcttatttttgtcaggtttgtcaaagatcagatcgttttagatgggtggcattgcaccatggaatactatgcagccgtaaaaaaagatgagtccatgtcctttgcagggacatggatgaaactggaaaccataattctcagcaaactaacataggaacagaaaaacaaacaccatgtgttctcattcgtaagtgggagttgaacaatgagaatacatggacacagggaggggaacatcatcacacgccggggcctatcaggggttgggaggctaggggagggatagcattaggagaaatacctaatgtagatgaggggttgatgggtgcagcaaaccaccatggcacatgcatacctatgtaacaaacctgcacgttctgcacatgtattccagaacttaaagaataataaacaaaaattgaaatttggacatttaatgtaaactgacccaggtcacgttgcaaaccacagatggtggtagttttataccaattttgtatatacctttatgtgataaaaattaaaattttaaatttaaaaaaatgatattggggctacagcagctttttgagaaggctggaattgggaaaacaagattcacgagactgaagaaggcctaaaaaatgacttcagactctttggggtacagcaaagaaggagtttgaagctatgagctccctgtgcagggcaaagtaaaatggtttatttgggcttgccattaatacgctgtagaaatttggattcaacctagcttggatacatttgacaactatatgacgtaccataaaaatggatgaagttataaacaagctatatgataaaacttctagaatgcctaaacccatgtaatagcatagcagcaaaaagcagggacttttcatgcatttatagtgaagttaggttaagaatatcgttaacttttataaaatacctaggacagtaatacttaagtaccgattgttattaaaattatattggaccctatgaagcggtgatatccagctgtgttttaacacaaaattataatttcataaagctcaacttaacattccttgacagagctaagttttaattatccttccaaactttataggtatatacctagaaatattttagaaaccaatttgatatggtcattcaaatattcattaagttgataaatttattaaattaataaatataaattttatctcttaataagacaggtctaccaagtcacatcatctttagccattattataagtgctgccttgtgtgaaattgatcaaaatggcaggaaaatgtagtgtggtgggaacagaatggaccctggagccgtactgccatggctgacatcctggctccatcatttgccagctgtatgaattcaggcttagcctctactcaacttctctgtgtcacaggttgctcttatttaaaacagaagtgaggtctcaaactcgtggtctcagaaacagaaagacaaataccacatgttttcacttacaaatgggagttaaataatgtgtatgcgtcaacacagagtatggaatgatagacaacagagattctaaagcagggatgaaaggaggatgagtgatgagaaattacttcggtacaaatgtacattatttccatgatgggtacactacaagcccagactttactactaagcagtatgtccatgcacttgtaccccttaaatttatgcaaaataagcagtattgagcttaaaaaaaaacagagaggtgagggaattcctttatcaggatggagcagttctgtactttgactgtgatgataactattcaaatttatacttgtgataaaatgtcacagaacttaatatgcatgcacacacacagagcacctacaaaactgatgaaatctgactaaagtctgtagtttagtttgtcatattgtgcaaatatcaattttttggttttcataatggtttgtttggctaatgacagttctttaactggtttagtacttggggggtgcactgagtgatgggtagacaaggtctcactgtatagtttttctaaattcttttgagtttatatttgaaaataaaaagttagaaaactacacttatcttatgaggcagccgtcctattcttagttattttccttagaaaaataaaaacatatgctctcacaaaaaaagctacacaaatgtctacagctgttctaatcataatcactccaaactagaaacaaccaagatatctttcaacaaatgaatgaaataaatggataaacaaactgatacatccaatgtattattctttagcagtaaaaaaagaaacaaactattgccataagcaacaactaaaaaacaaaagataaaaatgaaaaaatggtgactctttacagagttgttaaatgagcttttatacagatatatgaagttcctctaatagagaccagcatgcagtgtgtgcttcataagtgcttgctattattatttcttcaaaaaaataattgatacttcaggattctaataaatattattttttttcataacttggacaaattaaagagtataattctgtgagtttcatatgtttactatatgtcactatgtgtgtgtgcttacacacacacacccccacacttctcatttagatgtacccatagacaaaaagcacaggtgagctgcgagaattcagcagtgaacgtgcaaggtgtggtctctgcaactatagaacttccactctagaatgatatttttttaaatgcctaagtttaaatttttcaaataagtgcttaaaattattccaatttattacagtttttaaaaattacactaattatgggattgtcttgtgcattagaaatactatgatttaaaaatatatttgtttgtatatatatctcccattgattgagatacaggactaacacttaccatacgtgctgactgtgtaaagtcagcttttataatggagttgttatattttgaagaacatgctttgaatcattgataagtctgtgtaataacaagatagatcataacaggatttaccggatgtttattgccagctacatagccgtccagcactttgccatcaatctgtactgtgtgtgaagcactgggctggataaaagaggaacacaacgcatttcagcccaagctatggagtaagacacacctgggtctatttcctagtattgtcgcttgctaggtgtatagatttgcacaaattattcaacttgcatgctcctccatttcttcccttataaagtgagcacagtcttaatgatcaacctcacagagttaacagtgaaggaaaaaacttgtcacatgaccgggcacatctaaagtgctcaataaatcttagctatctttattgctatgtatactaaaattatttgagggaaacatgacttagagatttaatgatgaagaaataaaaagtggtggaaaattacatactctatactcctatgtagaagcttgtgttgaagggagtctcaaatatattataggatacttgcattaacttcacaggcaatatggaacttcctctagggcttcaagtactgtaaggtttccgatgtttatctagtgactactacaattctggcattatgctaaaaggggaatgatatgagaaaaatgtgatgactgagtaaggtggggtggagttggtgtaccagggataagtagattagcattaaccatttatgttatagctagagaaagaaatgtgggctatgaaaaatataaaggcaatgtgtattacatatcactgctatttgtatttcccaatataaagggattaagtgcaatttgaattatatatatgtatactcaaaataagttagagaatacccatttgtttataatcttaaagtcgtagttgaattcaaagaagaaaaataaaatggagaaagtacactggattaggagtcaaaatactgggatcctagtatgagtgaactagttaatctcttatttaaggtatctagctccctcagttatatatagacacattggacattattaatttaatgttatttattaagcgcattttatttaaataattcaaactgcaagctgcctagagctagcaaatctctaacggcctgacaggtagtttgaagtagccgtaattacacacattctgcctattggattatctgctgtggcttgcttgatggcttaaaaatgaacattaaatggcacttaaatcaaaattcccagtggccttcttaggtggaagcagatgcttctcccgtttatatagaaatatttagatacaggaagcaaaggagatgtatagtttaaaatgtcaagttgatttgacatgtttctgggtttgttggttttgcatgaaactttaatgttaaacaagctttaaataaatcatctcttggtatttgagggggaagatgtactataaatatattgattccttttagtaaaatggtttatgggttcattagcaatgatgctgcaataacaacaatttttagggaatatcaaaagtgaaaacaaacctgttagcataattttcacatttgtagaaactgttttgtgtcatattatgatgtttagaatggatttagaaacttgagcctaagcagcagtttggtctcatgatactaaattcactttaatatgtgacataaagttgatatttttaaaagatttggtagacatgagcttgtgtttttggggcaataatgatcattattttgctgaattcctttccgttattctgtttctttctgtactgtacagttcaggaagttaatcctcaaaggtttggtatcattgttttattaatttttttggtcagagaataagactaattagtttttctagctggctgtgtcatgctaagaggttttagcttactttaggggttataatttgatctataggataaggaaatctatatggatgagtaattttgaaatgcacattctttccttcttttattgacttttgactctgtttttatgccacgattagttacaaggtgcacaaaaactttttctagcttgagtaaaaaatgcattttatttgaaaggcactagaaaatctgaggaacataaaccagagctctgccaggaacatgactcagctccccaaactccaatgtgtggagtcttatttgaaaattcaaaatattcagatggaggaatctgacagagaaagagagagaaggagtggtgactatgaggaggggtcagagagtagcctctatgggtgggggaatcaccctatatatattacgggtaacttccagagaaaagggcaagcatgggtcagtgtttctattgttaatggtcacctgtttttatagaaagaaaaatatcccagttgtccctcttatttcccagtattcttgcccagaccagcttaagaaaattgatagaacaaaacttttgactagtcttactcctgaaaatggcatgtaacttcacactagaattccattgcaacactgcagccttcaatgggctttgcactacttcccagtgtccatgagccctgactctgtgagcctcttgttcccatcagcggtgcacccctcattactaccttacctttgttgccacaggcacaaaacaggtcaaggctgctgagacagtggaggctggtgaggtcttgctatcagatcagatccataccagggactcagcttcaagcctgggagagcattccatgctgcaatcccttgggaaactggttcggttctggtctttcagtcgttggaagcactgacttcaatatgtccatcaattttccacagtagcaacatgtatggaaacatacaaagattccacaggatttttgtattaattattaagtggcatgcgctgagtttgctgagtggtcaatctaatggcaaaattaaaacacacatagaacatatatatggacatagaacatatgtaacatatatgttacatggaatacaatatgactgaagataataacaatactattttgggaggccttaacatttttagcagcataaaaaaataaatgtttggaacatccaaagtcatattatgtgtgtcctgtggagaaaattccatagaaataattcgggctttctaggcttttgcagacacccagcgcctgctggcaataaacagaggcactaaagcaaagcacaagtgggcagccagatataaatatccccctcgtcgacagatacagcgtgggacactgtgggctacagaatcaggaaggagggaaaggaaaaatctctagtcctaagtttttttactgccctgtcccatttttttttaaactactctgtttttccaaccctgcctaatcgagatttcaaggcagcttgagcctgtctttccctggttcctgaggtctccactgatgacagctgaagcatgtttcctgacagaattctgcctcctggcaaggtagacacagactccggggacatagtgtgtcagagcttctagagctcctggagtccaggcacctgcagttgagggccgtgactgtattgttgcccgtggggctttgctttgaaggcgtgctaagggggagagggagtggggccctgcccagaggtgcagcctctgcttcacctcccattcttgacgtggggatccagagcatgggcagaccaagaatcttgtgtacagttagaaaggtcaacgggaagaacaggctctcttcctgggagtgatataaagtgcggggagggagactccttacattaggaataattgaatgtggagaataatccctattccctcagggtacattttaataatgcaagtgactgatccacttaatgtctgcctgatttgaactgtacattgcctggcttttcattaataataaatccacaggtaaacaaatgcttcacattaaatgcctcttaaaagtgtttagtgtctactgccagaaaacctattaagcaccctggcctaagaaaggcaaaattgaacagaaaccgtatgtaatgtgatagaaacacctttgcattgtcttgtaacaggaaagttcacatatacctttagaatgcattttgggaaaattccaaataatggcttattctcttagttataaaataataaaaatgtaataaatcttgtatggttaataatacttgatttactatcaataataaaaatacatatttaaatgtatatttaaacataaatttaaaaaaaataaatgcatatgctatatacttctctatcctatggatataatgaagttagggggcaagaaggagagcttttattcttgtctgtcctcagcctttaagttgcctgaactaaatcatccttgaagttatttctcctgcagtaaaaaggaccatttagacaggtgtcaaggatttaacaataagtagcatttacttaatatatgcttttttattatgttctcacaacgaaattaaaatgcaactttccttaccagatggcctaaaagtgttctaaaatcagaaacttagattttagtgttcttagaatttcatttgtggtgttttcatttctgttcgttctcttttaattaccaagggctgaattaacctctggtgagatcatctgctgtctctttctatttcactggttgacctagcccactgactctttacatctaagatcagagaattttctgaatttggaaaagcccataaagaccatcttgagcactgctcccttttttaactggatgaagaaattaagtaactgtattaagtgacttgtaacagatcaagttagtatcagcagtttctagattttagatgtccagattcctagtcccagactgttccctcttaggatgaccacctcttatcagtttttgccctatcaccatacttttcatgggtttctacatgctctgcctattttccttctgcttctgatttctaagtagcctatccaagtatttaaccacatgcatagccagaaaatttattcttaagtccaacacacatctgtataattgcctccacctcatcttttgtagtctacagcatgtcaatcattcatccatttgttcattcagcaaatatttgaatttctatgatgttgtttaacgtttttaaatcactttgttaaatcattttaaaaatgtaaaagtatattgattatatgcttccgagtttttgatctcctgtgaaatgtcaagcctttcttttcaacccattgttattttggctaaccatttatgaggaatatgtgagtgtggaagcctgcatttatgaatgtggatgtgtataaaataaaagtgcatactttggcattgaggacaaaacaaaatttgatataagagaattcataacagctgtgagaattctaagtcaccatcaataatagcaatatctctttccagcaacacccattttccttaaggccactgaagcataatattataaccttcttcataaagctgttagatagagctatggaatagttctttagaattaaatgtagaaaactccagaatttcggaagtgaattataaagccagactgatttaagtgtaagaagaaatttcacttgaataaattctactcgctgagtcattgcaatcatagatttaatgtagtttgaaaccacaaaacttttatagttttaggccatgaaagtaaagaataaattcccctaaacaactttgttgttttctttctttttggttatagtccactgttgaagtcactctttgtccctttctttcaacatggtatatgaatgttttctttgcctcatgcatcaactagtaacaaaggtgagttgactgtgagaacagtgtccaataacttgtcatatgtgaataggcttccatacaaatgaagcaaatttaacacctgtttagaaatgcaaagtcatagaccttctgaattaggtacactgtactttcaatgacttgagcaagtcattggaactctctgaggctcagatttttggtcactgcaatgaaaaacagcatctgcctcgtggggtttttataaggattaagagtcatagctaatcatgacatctggaatttagcagcccatttatgttattactttttgttgttgctgatgtcattaagatgtgagtagcccaagactttaatgagttatatttttctggaccaattctattttataccacataccagaaccatcttctctctgtatccattctgtagaaaacctgagaacttcttcatagctttgggcatttaaaattagtaaattactaaaatatacatactctatgcttatactaaagaggcaaacctaagtgatactgagaagaagtgctaatggatagaggtgcgttatactcagaaagatagatggtgtaggatatttattactcacgttattcactgcatttacgtggtcaggaaggttctggaaataaaatgttctattttgtacccaatcctaatgtgttagtgtatcagttggacagaaattttcttattctttcttaagatcagttataggtctggaagtcactaaacatgatttcctaccattctttgactatttgagttagtttcttagttgtttttttcctacctttgtagaaaaatcgcactcatagtgtgatttttaggatagtgataataatagtaagtgcctttgaaaaaggaaggcaatttatgtttccatagttatttcatgtgatcatcacaactgctccataaaatagaaatttcgttgtaatttattcttttaggtataacttagggatataaaaaataaagctatatctgccccatctacttgagtcaatacactctttgcccttagtaagtaagtaacctcattgaggaaaggtgctaaggtagtggaacaattgcagacagaatgtttctagcaataaatacatgccaaaaccaataaagcaggcatctgggcttttcattcagatgggtaagcgaaggaagatctctctccagacttcttcatcctgaagaggagattgttatggcgtctactgtttacaagtttaacaacttggtcttttgtggttctttaagatttttgcggcatgaggtttaaaaagatcagttaatcatcttcatggcaggcaaattttgaggaaaagagaaaagataccggaaaaagaaatcaagtttcctttgctagacgccattacagaatgttcctacagagaagaaatggcaagtgcatagatgtccgcaatccaacaacaaagtgtgaaactgggaatggctctgtactagagttagctatcttccagtctagcaatttccgtagccctgctataattgactagcgggattaaggacaaatgaagctgcctggacttttatttttttatcgtgactaagagtatatatgtagaataattttaaagagggcacctcggcggtccattctgatcagaaactggaatgttgccagctctcagaacttagtgtttgcttcctccaacctcatgttttactacctctggttcattcctaaagaaaataatgtagtttccgccgggcacagtggctcacgcctgtaatcccagcagtttgggaggccgaggcgtgtggatcacgaggtcaggagatcgagaccatcctggctaacatagtgaaaccccatctttacgaaaaatacaaaaaaattagccgggcatggtggtgggcgcctattgtgccagctacttgggaggctgaggcaggagaatggcgtgaacccgggaggcagagcttgcagtaagctgagattgcgccactgcactccatcctgggtgacagagcaagcctccatctcaaaaaaaaaaaaaaagaaaataatgtagtttcatctatgtttgtaatcatgctttatgcatccttcctgtccttccttcaatgagcattatatttgtgaactctacacacatttcatgtgcagttttatttcatttttcttactgtataatattccattttatgaacatatggtaatttatcaacatagtcaatatttgggtgttttcaatttatagctgttacagtgcagctctgaacatcttctagcatgaatcaagatgcacttaggcaggatcaacttcagttatacttaggagacacattgcagttgtttagaatatgtgtaacttcctatttatatttccattaacagcaaatggcagttcctatttctgcacatccttgcagtcacctgcattgtcagacattttaatttttgctaatctgatggaagggtaatgatatctctaggtgacttttaatttgcatttactaatcactaatcaacttgattaccttttcatatgcttatcacttactgggatttctgcttttcatggtgtcttttcaagtattatagctatctttccattggatgaacagaattatttttaaaaaatgaaataaaatgccacttgagagtttctgtgctaacgtttgcaatagaaagttcaagcagaatcccaaagttgaattcttaagttgatggttccatagttatttttaactgtcatataattgaaaacctttattcccttcaaatttctttttcttttctagataaagtcttgacagttcttttttcttatcttcttattcatctcccctccccacttagatgaagtaatgcaaggcttgtaatttagagcttagagcaatctctaaggaaagaaaaatgcaggaagattgcccttggccttaggctttagagaatcttccattttgcattggaaataggcatattcttggcagagattgctgttgtttaaacctcttctgatgccacctaatgggaggctaggaaagggaaccttcaagagatgccaggcttaatattaaaaacaagtagttggacagcgatttagtgagcataaggaacataatgacaggtaaggagagaggagatgatttcacctacccgtgctaaaaatggctttggaatgatttatatgccatcaactcattacagccctaactatcaccaaggatcaccaaggcaacgaggattattcttcacacacatccctcaggctttatctccatcttctaaagcaattttgctattccttccaacctgattatttacacatggatggcagtatttaggtggggcaaaatggatatgctattgccatccacccatgtccagatttaatcttagacagtcatatgtctcttatgcagacaacaaaaactgtattgttttatgcttattgagagctgttatggcagaaatacagaaagtgaggtattccttgaattcaaacttggagtcagagattcaattttagttcttaccagctaagttcttatattttgcccacatgtatcactgagcagagggagtcaaacgtacgctgcatgagataatttcaggagctgatgatacattttatggatttaagtttccataacccttgatagacatttaggtgttgtttttaattcgaagtttttgttgtatgtgtgttatttgtatgaaatttttgtcctctgtaactctgagtatccatgatgtccagcattactttctgttttgttttctttttagcatcctttattttttcactttctttctttcaatgaagttttatttttgagaggtctaaggcacttgccttatgaaactatcttctgaaagcacactaaaagaaaattacttaaaagtgtattccaaaacaaaattagaggctgggcacggtggctcatgcctgtaatcccagactttgggagaccgaggtgggtggatcacgaggtcgagattgagaccatcctggccaacatggtgaaaccccatctctactaaaaatacaaaaacaattagcctgtaatcccagctactttggaggctgaggcgggagaatggcttgaacccaggaggtggaggttgcagtgagccgagatcacgccactgcactccagcccagcaacagagtgagactccgtctggaaaaacaaaaaatagaaaagaaatcaggttgttaagcaactgaactttaggtaatttaagcaactgcttataaattttcaaattatcctataatatgtaataagataaattcacatatttaaggccagcacttcctcttagtctttgctcacatccttaaaataagaataaattgattttttgataaagtagttgtaatcattttataagctgaaatgaaatgttctcgtttgctgccatgagtatttcaggttggtttcccattatttgagtcattatttttgcttgggagatttctttataaagataaatatatacaaagtattataagaaggctcctttggaatatgcaattagaaagttacagggtatcatagctgggatggtcttagaattcatcttctaactcttatttcaaatatgatttgccctaaatggcacagcataatatgcaatagggcaaagactagaacagtcttttttttgaaattcttcctcctagaatagtaataatagtgataaatcttttattgtgtagtttataagtgtgtgtgtatgtgtgtgtgtgtgcttctgcatttataatcctcacacctctgttggattaggctgaacagataagacctgtatcttataaaccaagaaaccaaggctcaaggttaagagcatagtttgaacttgaatcttcaatctgcatgcagttctgcactgcctttgtgtgttagtcttcttttaaggaacgttaggatggacctatctggaattgtcatgagtcaaaaatgcaaactaaaaatctggaagcaattgaattaaaaaggtacaactgattttagaaaaggcaaaagcaggaagttgccaatagtttcatttgaagagaaattatgtcaaaatcactaactcagtacatagaatcaccctagaaaattgtactggatcaagaaagaagggaaaattatggaaaattttaaatatatcccaggaaagaagaatgaattaataagagcacatatgctaatgtattggacatatgcttttgcaactaaaagttgctattcacctttctttcggggagggaatgccaggataattttcttctagataaatcacgacccgcactcttagcctctgtgctgcaagttgggctcaatttccactcaagagtggaccatgtgcctggtctaaacttatcacaatatcttgttttcctgacattatgcttgattcaaggatgaccttaaggcccaatcagaatcaaagacaaaatgagacttttgttttgtttgttttgttttgttttgagacagagtctcactgttgcccaggttggagtgcagtggcgcgatctcggctcactgcagcctcgaactcacaatgagacatttttagagacttctggataagagacttattactgaaaggagttgctgctgacatcttttgtctctgcagagaaggccagactgggaatgttgcaatttcaggttaagagatatggagcaagagaaacctcgccacagggacccagttttactccctgaattaagccatagctgaagccatctctactgcagtatttataaattacacagacaaattattttttgcttaggaaagttatctggtcacttggaaatgaaagatttatcacatcacatagcttagaaagactatggatgcctggaagacctggaccaacactgagttgggatgcgcacaccagctagagcagcactgttattgacgttgttgtcatcatcattctagctaaggttgccttttaagtgacatgaggaatatctgttttaattatctcagcaattctgaggctatgactatccccatttttcagatgaggacactaagccctgccttttaaccactgtggtattcacactagaaccaggtttccaagattagctatcagtagtcttttgaatcacattcagggttttttaaatactccagatttttccttcaagtatctgttcaatgtgttcagttctgaagctgttatcaattcaaccactgatctgctcttctttcccctctccagctgaaaagaatctctctctgtcctctaggctcatttagcaatttagccatcaattataacttacatacagatttagatataaatatagacagataaatacataaataaatatatagttatacacacacaaacatctctttctatctatatatcttatctatctatctatctatctaaatttgtagtttctcatatgttttaagagtgagtcttggtaccagaaaacatggattggcatcactgcttcataaaggcttgttgtatggccttaggcaaactatttaaactatctcatcagaaatatgctcaaaataatacccaagccatgatattgctgggaagattagatagtttgagaaagaactttacaacctgcaaaattctgtataagagattattatatttatttttactccccatagcactgaagctctagatgtagttggagctcaataaatatttgtggaatgggattcaattcaggggtgagtgacagcctatataagtaagaaaagagataagaatctcttgttggctttgatggcatcccaccttcccatctatacatgtcactttttcttttttgcctctttcttactactgtttacccttcatgctctatgttatatacctctgatttcttcaccccttcattttttttagcaaactccaggaacatgtcagagacatgctggtgactttctagactaacaggctagtgattctgagttaaactttgcaaattatttattcacaatcacaatatgctcaaactgtctttggaagttgcactaacaactttctgattgacagggtaggtgcctttgccaagtactcctatggccagaaattaatcaccagacttagggtgatgaactaactattggtggtcatgaatgcagttaacatacgctagaaaacaataacatgcactagaaaccaagggacttcattccattatcttctaccgtatgcaactttttatgattccttttttagtccatcaggataatgcactgtaaatcatctgctagacaaggcatctacaaagctctattaattcatcataaatacacacatgtgattgtgcacatagtatggttatcatttctgaactctaaatatattaagtttaactgatattcttcagcccaattgcccccatgcacaaatttgcacagtcttccaaaggtagctaattaatgaaggacatttttaatatttgctgagtattgctatttatgtgttattagaaaatgcacccctacctctgatttcccctttaataggaagatggctttcagtttggcacgcacaatttctctcatgctgatgtaaaaagtagttgaattatgaggcttaatggcatttagcatctttaatctccctactcacagttctgctggttatttagccaggggagttcttgtggaaatacgcagcatcttggtttatagtagcaaaccaataagcaaatgtacctgtatttgaagtgacaatgccattgaagttttggtcaccagctctaaagcttcaaatcagagaaaagggcttgtgcttggaatagtgcctctttacatttttactttcttattctccatcactttgtgggaactagataaaagatgactagggacagggccattactttctttgatggcttcaatatatcagaagggggcagcctttcgtgtaaagttcctcaaatgggaatactctcttttatagctagccaccagctgtgaaattgagactagtcaggaaatcagtgaagaagaggaaaatttaggcatggccctgggaaaagagggaagagaagaaaatgacaacttttttttctggtgtctttgacagtttaataacatctctttcatggtggaacacatgagctatctgtgccatggctccaggaaatatagtcaagtccaacatacgtgtttctgaacactagctttgagaatataatcaacacggcaaaaattatagagtatctgagagacagaaaattcaaatagggacctctttctatattggctctctacaatatcattaaaaaaatggtcctgaagcaatctctttgataaatcaacaactataatatctgatattttggtaagctgtatgaggatacaattttttgatctgtttcgttctcttttgccacttcagtgcctacaaaagctagcgtaagataggtactctgtaaatatttattgatcaatgtgcaataaaaacactggagagaagtatttcatttcaactccttccttctgaagagcacaaaggctttggagtaaaatacccagaaataaatctgcctttttaaaatcaagaattctttgagaagttgtcacaaaatatcagaaattaactgaaatgaatttaactgaaatgcatttttatttttacttttatacttttctagtaaaatgtaaagagttatacaaatttagaagaatatatctctttctatttatctatatctatttttatatccatccttttcaaatgataaattgcattatgacctattactaaatattccctgaataattagcttttcttggcaaagtttattgctgttcggtttggtttaacgtgtatatttcactttatactttgaatgataatttagaatcatagccataagtcacaaagtttaaagaaaagtgaaaaataaactgaataagagttaacagtaattctggttgttacagatcttctcaggtttaacaacgtaaaatatgacttaggttaggaaaggtttggaaaaaatgtttttaatttgacaagggcctctaaatataactcactttatatagcaatgtcccatttccataaccttaattgctttctctttcttccttttctttcactccctctcatctccgcattattctctttatgtattttgcattcaaagccacctactttcgaaacttactgcctagaagcagatagtgaatgtttcagaatttgtgtttcttgaaacagcatttttttcatagctgaattataataactggagaaatctgaggatctgaaggttgcagtaatttagtaaaagagatctggaatcattttcccagtgaaaataccagctgtactatgagggctgatttttcttctttgatgaattctacactgtgaaagatacataaggtgagtgggataccaggaaaggacaaggaagaaggaacgtggcttctagcccagcactttggtctcatttccatttatgaggacagagatttgtcagcacatcagcctatcttgggaagactgctcattggacgaatgtttagatacagtaagaacattagatccaacattatatgtgaagatattgatttgatttaaaaaggagaaagagaaagagagagagagagagatggagagacagagagacaggaccaagctgattgaagcaaagccaactggctgttagtttgcagggactctcagtaagctctttgcaaaaggtagcatagtgcagtggtttagactaacgcacagatatacctctgtcgatggacaactttggttcaaatcccagtttctctctttactagtattataaccctgggcaagttatttgctcaagagatacatctgcctcagcctcctgaggagctgggactacaggcacacatgcaccaccatgcccagataattttttttttttttggagagacatggtctcgctttgttgccgagactggtctcgagctcctggcttcaagcaatcctcccacctcagctttccaaagtgttaggattaccgagacgagccactgcacccagcctaaaccactactttaggcagtaatctacctcacttaatcacccaatgctatggcataaaccttgggcatatggctctagtcacattcctttaggaatattctcagttgcacttagtaccagaacacaataattactaaacatttagaacttcattggagagtaggtacatgtcttttccagagaatgtctcgagtagctaacatatcactaagacggtattttttacaaagcacacgctcactgggaaggtgttcactttattctcgaatgcttaaagaatgcattgaaattcagctttataaatgtgcctcaactatgggcttcctggtaaccaacatggaaaccaaacttgccaaatgaggagtgttttctttgggaagacagtcgaatgaggagtcaaaactgtggatgtgttaaagcatgttacatcatacatgtagccatgcccaaaagctaagcactacatagccagacagaaaacattttttccttcactttcagatataaattatcacctgtaacatttctgtagaaaaagagaactcacatacataagacagatttaggagcaagttgaaatagtcaaaggaagcttctgttcatagcagtaaaaataatgaacaattatacaagttaaacttttgtttatctttccactggaatggctaatagtttcttagtttaaaggaaatctttagattggtttccagtcaggaaaaggttgaccaaaggtaagcccctgatgtgaaatgttagacaaattaatgtgagcacttcagaattctttctttggtggacatgtatgtcaaagttgaaggtagttctttcattctccctcacccaataattaaagtcaaaaatagatatgaaagcaaacctaatcatacaattccctaagtattctactcttcttcagaatttaccagcattagggtggttaaattagaataccaacactgtcggccgggcgcggtggctcacgcctgtaatcccagcactttgggaggccaaggtgagtggatcacgaggttaggtgatcaagaccatcttggctaacacggtgaaaccccgtctctactaaaaatacaaaaaattagctgggagtcttggcgggcccctgtagtcccagctactcgggaggctgaggcaggagaatggcgtgaacccaggaggcggagcttgcagtgagccgaaattgtgccactgcactccagcctgggcgacagagcaagactccgtctcaaaaaaaaaaaaaaaaaaaaaaaaaacaaaaacactgtcacacctagcagtcatacacatggtagatcaataaattcttattgaatcaaatctgaataatccaacattaacaataataatgtttaacaaattcagtcattttcttccaattttcactgatagtcttgattgtaatgttttcattttgatattaaaaatatcctagttttattatgatttatatttctattctcagtagaggatgacaataggcttaaatttcatatagttgcccctgtattccatgcatgttcttccttacctcccttgtagagtagtagactgatttcatcttgacagtccagggcaatcaccccacccaacactgcaactcccttcttagcctgttgatttaaaggtaggaggagcccaaagtgtccaggtggcaatcttaacttccagtttaatggcatcattgttgtgtctcctggtggcagcattccttcctctggaactaagatctctaggccagcagaaggtaatgttgcaggaacaggaagcaaaacgtttgctaatggatcactaggggtgacggtgagtggtgccacttctacttccactccttgattcctcgaccctgaattctggctatgggagaaacaggaccatatataggatgctgattcagagcatacatggccttctggagaactttgtcccagctctgcagagtattgtcacatagttggcattgtaattgtgacttcaaaaggccattccaaaattctatcagtccagctccttcaggatgatgggaaacatggtaagatcagtgaattccatgagcatgagcccactgctacacttctttagccataaagtgagtgccttggtcagaggcaatgctgtatggaataccatgacagtgggtaaggcattccttgagttcacaaatggtagtcttggcagaagcactgggtgcaggataatcaaacccatagccgtagtaagtgtgtattccagtgaggacaaacctctgccctttccatgatgaaagatgtccaatataatcaacttaacaccaggtagctggctgatcaccctgaggaatggtgctatatcgcgggctcagtgttggtctctgctgctggcaaactgggcactcagcagtggccatagccaggtcagccttggtgagtggaagtctatgttgctgagcccatgtgtaacctccatccctactaccatggccactttgttcatagacccattgggcgatgacaagggtggctggggaaagaggctgagtgttgtccacagaacgggtcatcctatccacttgattattaaaatcctcctctgctaaggttgcccgttggtgagcactcatgtgggatacaaatatcttcatggtttttgaccactcagagaagtccatccacaaacctcttccccaaatttctttgtcaccaattttccaatcatgtttcttccaagtccctgactatccagccaagccattggctacagcccacaaatcactatataatcacacatctggccatttcttcttccatgcaaagtgcacaaccaggtgcactgctcaaagttctgcccattgggaagatttaccttcaccactttccttcaggaatgtcctagaaaggggctgtagtgctgcagctgtccacttttgggtggtgcctgtgtgtcgtgcagaaccatctgtgaaccaggccctagtcttctctttctctgtcaactgatcatggggaactccccatgaggccattggtacaggctggggatgagaaggtagggtggcaggagtggaaaccatgggcatttaagccacttccttatgtaccttacttgtgtcttcaggaactgctcgaacccgattatgtatatactacatccatttgtgatggaatgctgctgtgcatgacccactttatggctagatgggtcagaaagcacccagttcatgacaggcagttcaggttgcatggtgacttggtgacccatagtcaaacgttcagtttccaccaaagtccagtaacaggccaagagctgtctcttaaacagagagtagttatctgcagaagatggaaggtccttgcttcaaaatcctagaggcctcctctgtgattcacctatagggtcctgccaaaggctccaaacagaattcctactaccactgacacctcaagcatcattggatctgctggttcctatggcccaagtggcagagcaggttgcacagcagcctgcacctgttgcaaagccttctcctgttctggaccccactcaaaactggcagcctttcaggtcacttgataaatggactggagtaacacaaatgctattccctgactacaggatggtagactgtgatagatattgggcttacactagagaacaaaaaatcaaaatgctgcctactctcacatttcttatagactagtcaggaagacaaggcttaaataattacatgaatgaacacataattagtgctaattgctggaaagaaaggtacatatgagaagggaaccaaacttttctgagggtcaaggaaatattcttgtttaagctgagacttcaaggacagttttgggggagaaaagatgcccataaagagggagcagacagaaggaatatgcctgtataaagacccagtggaagcaggaacaggtgaaagaagactagaacacaagtcttagaccatttcctgactgagttttcatcttaaaagcagtgagaagccattaaagagctttataccaatgatatgccaacagcatcttttttttttttactggtttgactaatcagagactcaagttttttagttatttattgcttacgtaattccaggcaatatacaatatttgcctcatctttatggtaatttaacccagtaatacaacaatttgtatactgcatttgtattttgaatttgtactttgaaaagtgcatgcccatagaaggaacaggacatgtctcattgggttttagttcaaatgatctagctttaaaatatgttgaaaataatgtgactgatgaatcatatgtggtctgagcttcaaatacttttttagcaaattgcagaagggctattaggatctggggggtcagtgagacagcttgacaaaagcaaatgtcttgcaaatatatgtagaatgatacttcagagaaaatatagtctacagatactttttatttgattctgctaagcaaaaaagaaattccagaaatgaaatggtcacagaaacttatttctacttttacaaaatgaatgtagtgttctatgacacaaataacctaagtatatccaagagtgtcaaccttctaagcttttgggtttgttgaatttccctgaaggctttggatattatcagggtagataatccatatgcaatatttgaatgtgttctcaagctgtgtatgcatagtcctcatttatttcttgtcaatctgcaaagcagagagggaagagccagcctggtgtttagtgatgcctcttccatgggtttttgtacaatcctcttctctgttctgtctaataaaatgtagctaacattttacttattcttaaagacagctcagaaataaaagaaccatataagcctttttctgtttatagtgccaatcaattagagccttcaagcaattattgactaattaatagctgtcttagggaaaacagagaacttagaagggacttatatgtggaattaaagcaagttgactcgcacaattatattgctggtagagccaacatagataagttctgagatattgcacagtttgtataaattatttgagaaaggcttataaggaggaaagagagattcactgctgaattttttgttgatgatctattgatttgatttcaagtttacatttttgcatttcatggtaaaaatctatgcttttttttaaaaaaagatatactttccataataaaatagcatagtgctctgagaacattttaaagcccatgctttattaaagaaaagtgaaatgtggaattttgatctaggttctgtttatttttgtacataattatccactggtgtgccttggtataaatggtgtgtgtgtgtgtgtgtgtgtgtatgcaattattttaaatttggattaaaaactaaatttggtgcaatttttttcaagctgtatgttaacattatcatacagaatgagatctaaggacatccaatgcattagcctaaccaaagccaatgctatgcaatgtcgatgtctacaattctttttaaaattagcaaattaccagatgtttttggctactgaatatacgctcagccaaaagatagacacattagggagtaaaaaaagtataaaaaacatttttctgcctcaagaagttgtcagtctacatgaataaataatattttttccatgctgatcgtaatttgacactttaggagcctctctggtgttggcacagatctgtttgtttcagaagcactggtttgtctctgtacacagggtgcaagcgctgagagtgcgaagatgaggtcttgcagttgtgattcttggcacatttaagaaatagtgcagtgtgggtactggtccgtcagaatggatgttgtcatcaaccatccatgtggtcataccagtggcccgattcccagtgcccccatggtaacactgatttctgtgcttagcacaaagtacttgataaatacttgtgcttaattaagttctacaaagtaagatacacagataagtctttaccatctctgggtgaccaaaaaggagtttataatctgtatgttgcttttctttttcctagttaaaagaccattaagctattagagtaatggattacacactgtcgattacaagtagatgaatgtcttcacatacatttttcctttaaaaatcaatactgaatgcaattcagccaacattaaaaatatcctgcagttatattatcaaaaacattgaagttttaaccacactgccaaataaaaattttatctttttatttatggaaaatgtctaccattgcttagaatttgatgcattaaaaagcattgattctatcaggaaggaaaacctgctatgacctgagagggctaatccaatataggaaaattcttctggactttgagattttcataattttttaaaattctttttagcattcttttaaaaagcatgctaattatggaaaataaaataagtaatctttactacaattaaaaataatttttattataacaaaaatttcctcaatttaaaacatacaattaaaattaaattaaacaatgtcattttgcaaactgcttttttttcacttaaaacattattaacattgttcccaaaacataattcttatgggttgcatgaaagtcaattataacatatatttctaaactttccacttttaagtgtgaggtcattgtttatgccctcctgcttgtatgaccagttattccttaatataagttcatgaaaatgcaatggcttggtcaaaattatatctttaaggtcttcagtgcacattgccaaattacactgttcaaattattattattacgttttgagacaggatgatcacagctcactgcaacctcgatctcctgggctccagcgatcctcttgcctcagccttctgagtagctggaactacaggcactcatcaccatgcctggctactttttttctttttttgtttttctttctttatttatttcttttttttttttttttcggtagtaacggaatctcactatcttatccagattggtctcaaacttctggcctcaagcagtaggcttccaaagctctaggattacatgccccaccatggccttccaaaggtccaggattaccggtgtaagcttccgtgcccagcctcctttcaaattcttaagcatctcataggcagttctgtagtcactggatgaattggtaatagtcttatattacttggagaaaaagaaatggaagtaccttttcatcttctagttgaatttaaaagtaaacatgctttagtcttttatttttctgtttttacttttgccattattttaaactacagcgacaaaagtaaagagtttgtgataagtcaagaattgagctcccaatattttcaactctctttccagttcacatctggaattgtaacaataatcactaaaaatagccagatcaacacttctctagggcactgcagaagaaactttttgcagaggaaagaaaggagcatttcagaagtctcagaatttgattaatataattattcagctatttccttttcttttcttcaagatccttggtcaaaactggctcaaagaggacagaaatatgtatcacccaggtgagccatgcagtaactagtgtgatagaagtcaaatgctgctagttaggttgttggcggaattcactttacaaaggctcactctaataactcctttctcccggcaaaactggagaaatattgactttgtcggtgacttgagcagaatagccaaaggaactaggtgatatgcagaattaaacctctttgggttttctggtagaaataaggaaatgaaataaggatatggaaataggaaagagggctttcttgctctgttgcccaggctggagtgcagtggcacgatctcaactcattgtaacgtccgcctcctggattcaagctattctcgtgcctcagactcccgaatagctgggattacaggcgtgtgcttccacgcccatctaattgtgcgtgtgtgtgtgtatttttagtagacatggggttttgctatgttggccaggctagtctcaaactcctggcttcaagtgatcctcccaacttggcctcccgaagtgctaggattacaggcatgagccaccacacccagccaagatattaaaggtcaattttacttccactatcaaggctcgatttactcatggtgcaggaaagtttttgtcatatctaggattggccctttaccatgctcctcaggtagtaggtaccaacaaacaggcttattcaatagattcatggctgggtctaagactaagttgtatgtatttacatcatcttctgggattttttttctctccctgcagtgtgttatccaaaacatttttgaagctgaaaagttggctaagcttcttctctgaaccattttccaacttacagggtttttcagaagccaatgtcctgccagttttctaaaggtctaagtcagaacgtggtaaactacacaaattgattattcacgtggtgtgatctgcatcctcccactacgtaaaactccctcagcagcaggatcccactagtatccaaaatacatatcattcatgtcaagactttgggttgaagtctttttgtcaagaaattctcttttaaaatggaaatgggaagaaacaattaacagttcatttatctattgtctgtgacctgctcatatttttattttttggtgctttctgctttcctttattttttaaaaccgtgattaaatattactttcatggtttttaaaatttaatatttacatgtataacctaacatcaatgcattaatcttaacacaaactttaatcacttatgataagtttcatcagcctcacgacaatcgatatttggtgctggacaatgctctgtcatgtgtgggaaaggggaaggagagggttctctgtgcgttgtagagctctatctgctagataagagcaacagcgctcctttcccattttgacagctgaacatgcatctagacattggcaattgtcccctgaggggcaaaatcacccctctcaggttgaaaccacttatctataggtagtaaggcactgattcattcctccaatctggattgagctcctgagggatataaacacacagaagttcctgcttccaggtaatgcaattccagtggatgtaaaaacctcagaaagtcagagacctacaaggccatgtgtttcaatataagagggcaaaatagggagtaggcagctggctggaaggagaacccaaaggggcattctttcttctattcttttactcgggatttgcctcttcagagaaaaggctataataagtcatagctctaggaaaaaatctaaggaaaagggcacccccctggatggatatttggtagaaacttgtgccttctgggtgctttagattaagaactgatccacatatagctggctctttaaaattcttagaatgttctagatttattccatcattagtattattcagatcatcaccataagctgcaatttataattcttgtctcacattgtttaggctatttttccaagcccagtatccctgagtcctcctcttagttttggctattgatgcctctccccttcatgtctgggtgtatattagtgacctgctgactttggccttatactgcctattggagaggagacaggaactgaaacctcattgttccattttttgttactgccttcatcttaccttgacttgattcttcaacaacctatattacatgtgtttggtcattcttgtgttgctataataaataccagagactggataatttataagaaaagaggtttaattggctcacagctctacaggctgtacaggaagtatggtgctggcatctggttctggggaggcctcaggaagcttttactcatggcagaagatgaagtgggagcaggcacatcacatggcaaaaacaggagcaagagagcgtagcaagggagatgcaacacgcttcaccagatcttgtgagtactcactcactgttgcaaggacagcaccaagccatgagagatctgcccccatacccaaagcaccttccaccaggcccacctccaacattgaggattacatttcaacatgagatttgggcagtgacaaatattcaaactgtatcactacactaggtagtaatggaggtcttctatttgtttgacatttttcttttgttaagactacctgaaggatcaagggagagaagttttctactgtaaagactttagctatggaatgtatcacttccctctccaattctcatactggatcatcctgccaatgccttgtacatcacaaaaaagttatggtccttctcctggaaggatgagcaaattaaagcacaaaaacttacaggcatattactcagatgttatcgactaacaagtctttgctaaaaagatcaatcatatctttccaggcctttttttattccatccccaaagaaggctgacacctcccatcatttcctgacatttctgatgttctctggaaataaatagtccattagtctttgcgtgaaagaactttgccttgtctttaggtgggtaacactctgttcctcattataatagttttcctgggatctatattaacagcatcaaaccaaattattttctctattccagatattaaatttcctttttaaactgaacttgctcattatagacacatttattatgcctactgctctaagaaatacattcttccctcattcaaatccgcaccctcattttaaacatgccattctctccacttactacccctgtgtaacccttcacttggggatttagcttccctcaaatgaaagtcctcagtccattccgctatcatcgctcaatggggttttcttatagtgtttgcattttaaccagctacaatcacatttcattgattctatctcagctggtatattatttttgtcaatccacacatttgtgaagccatagatttctggggtagatctctgaaagcactgaactttacatacatgtaaatctgcaagcaagagcaagagaggacctaggacccaggtggcagatgccagaccaaaacttctgagttacagagctccaccatgagaaatctcagccaagacatggttttttcctttaattcttctttcagatgcttctcttaaggacaacatatttaatactagcatttgtatccatattcaggcactttaaaaaggttacaacctgtacagactacagcttttatggaatggtatgttttacaactattggctcctaatttagattactcagcacttacaatctttatggaatagatctggaaggtaccagtctcttgttcacttcatttatttatagtgttcacctaatagcgacctcctttcagggcagccttctacctataagaatttccaagtaatggaactaacattctgctactggattccagacacactcacacgggaaacacaattcaaatataatgtgttcaacttaaccaatctgtgtattgctacttcaagtggtgatctaaattagactaactcactggtgagttcaacagtggtctcagagcacagtgaatctacagaaatcttagagatcatttaacctgataattctcaaagcgtgatcactgaacctcgtgatcattgaatcagcatcactaggagctggctagaaatacaaattttagggccccaccccacatctactaaatcaagactttgggctgggtaatctgtattttagcaagcccaccagataattctgatacacatctgaaaccaatgatctaacttgttctgtttacagttgagaaactgaaacccagagtaataaaatgacctgctgaaagacagaatagaactatttggtgacaatatcagaatgagaacaagtcccaatcctctaccatttctcctacactgtcaatgaggttgctggctatacatatgcagggttaaaatcctgtaaatttcaacagctagagccaaatccttcctacatggcctctttcttcctacatggctcaggtcagcaatcttgcctggcttaagtttgaatgccttgggccattcaggagtctccgtgtttgttttttccctgagcttcgctttccttgcttggatattttgtgagcatctgaccagtacattcagccactttaaaagaatctcccaggccttcctttgcataggggctttgtgattttttttttcctgttttgtttcaccatatgttccccttttgaatctgagtctccacaagcatcaggaaagactcggtgaaattctttctatttttgccagaaaagtcaagctaaatgcaattccatctcctaaagtcaatttgcagaaggtgtctttgaaacggcctataaaattgtgagcaaatgaagtttcatcttgctgttaacgaggttgctttgccaaacctgtcagaactggatctgacccttttgtgttatagtgtctgctccagctggggctattggctgttaatcagaagtgtttacactttttcatgctcacttgatttccactagcctgcccaacttggtattcagagtgggttcattacaaagaatattgttgcagccctgtcctgacatttcactgtcaactggcagcgatgggtcaatattgcttttgctactcctcacaaagtagaaaatatgcgatcacaccaattaggtagtttaagcaatttttttctgttcaaccttccttttagctgccaaaactggtctagaatttaaggcgaaggcaaggaattattagagaccaaacccttggcatcgggtgccaaaaagattagcctagtgaaataccaacatctttagtagaacaaagatcaaagtcaggaaccagaggaaactgtgcagctctcctacaggcacgttggtgagaaatagaataattgatctagtagaaacaggtttcaggaagtcaaagaatattattaatgatcttcaagcaagacattcaacaaaatgctctagattcttctcaataagctcttctctgtttcatggttgcaagctcatttgcaaggtagagaacagtgaagatattctagagttggtttggtttctaagagcactgaatcatttaaatgtcctgtttattaactcagctcctctctattttgttttgatttattgtttttcctgaatttttacatctgcccctaaacagccttgttagttgcatgttaggcagtataacgttggaaaatgtgtacactttggagtcagtaaaaattggattcaaattctagcttgcttattttcatgaccttgtgtggcccttaagcaagatactatattgcacttagactatttatatctgtaaatttggaataaaaaggaaaattgataacgtttagtttttatacttttaaaaacaatttaccatttgcaaagcattatactaaataccgaggttaagagaataaataagagagacccttagtatgagagctaaggaagcaaagagaggggttacatatttttcattcaagacccctgatggggttttctgatgtaagtgagatattagctgagtctcaaaaaaggaatgaggtaggtgggtaagtatgttgagggaaagcatttctggcagaaaatagtctaagaattgcatggaggcccaagaatgcatggagtctcagatgaaaggagtgaacgcttttctatagacagcaaagctataactatggagcaccaggatgtatgatgggaggtaaacggtggccaggaataagcctagagagccagctgcaggcctcttgtgcatgtcaaggagctcaggctctattcttctgcggatcatagcccatgtagcaatttaaatatggaatttggtagtcaaatgaaaatttgcatttggatggtgtctcagtctgttttgtgctgctataacaaaatacctaagactaggtaatttatgaagaacagaaatttatttttttcatagttctgtaggctggaagtccaagatcaaggctctagtatgtttggatgtctgggagggctgttctctgcttccaagatggcgcctcaatgctgcattttccagaggggtggaatgccgtgtcctcctatggcagaagggcaagagaaacaaacttcctctatcaagctcttttataaggatagctaatttcattcatgagggagaggccctcatagcctcatcacctcttaaaggctacatctctcaacactgttgcattggggattaagttacaacataaattttgcagaggatgtgaacagtcaaaccacagatggatcaattaggtagcagggtgattagggcattagaggagagaaatactggagccagggagaccgttttacagtaatctatctgggagatagattttgatgccttccttaaataaagactgtcttagaactgatagtcattttaagaatgttgtgagtggtataaataatacagcagtgcagttccatctaaaaaccaggggtcgaaaaaccttttctgtgcagggccatatagtgtatattttgagctttgaggacatgtggtctttgtcataactattcaactctgccactgtggcgtgaaagcagtcatagacaatacaaaggcaagtaaatgtggctgcgttccaataatccaaatttaaatttcacagatttttcacatgtcaagtaatattattcctcttttgatttgtttataaatatattattttattttattttattttataaagcccaggctggagtgcaatggcgcaatctctgctcactgcaacctctgcctcctgggttcaagcgattctcctgcctcagcctcctgagtagctgggattacaggcgctgctaccacgcctgactaatttttgtatttttagtggagatggggtttcaccatgttggtcaggctagtctcaaactcctgacctcaggtgatccacctgcctagacctcccaaagtgctgggataacaggtttgagccaccgcgcccggcctgtctataaatattttaaaaagcaaaaaaaaatcttagcttgataaccatatgagaataggcaatgactgcctttgtgttgcgtgctgttatcgcccctgttctaaccattgttccttttttcctgttgtctctgggaaccatgccatcccctttctatggttcctaaaggccagtatttatgtaatggataacagtcatattctcaaccttttcaaatgagttttgctttatttctgccttgtttatgaaatccttttctttcaaatagtcattaaactattttactataatttattattttccttgaagtgttgaagttttgttcttcacattgaggctctcagtcgacctggaatagagttttgaatacagtgtgaactttgaatgatttgcttcccccacacctacattgataactagcgtccccagctctatttattgaaatgaccaggttttcctcacaattccaaaatcatgcttctgcatgtggaaaatctgcatgtacatgtgaacctgattttggatgcttttttcctattgcattggtcatttgcactcttttgctagtaccatgctgtctatattattgtagctttattataaatcttgatatttgggcaagaaaacacacctaacttattttttttcaaaaagttttttgcctttttaacattttgtttttgtggtatgcataccagaattagctcatcaagttgccactaaaagctcattggattttaatcgaattgctttgacttaatagatcgatttaagtacactaaacgtctttaccattgactctttttatagataatctttgcatttattacttcatttctttggatcttctttaatcactttcaataaagctttgtaattttctccttaaaaattttgcgcattgttgttgttggtgttgttttttaactaggccacttgtttttagtttttcctttccttgacatttagaaaattacaaaatataactgtgttcatgttaggcttctgccacttactaacaatagcttgaataacatttgtggcttgtaaaatattctttgagtttcaatgtgttaaaagtctcatccctagtgagtaaattgggatttactatataacccaaagttatatagtgccaagattatgaaacaaaagatctcatgtagatgaaaattaatgcagtaaaccttttcataaaaaggacttttacatgtgggtcataaactgcttctgagtcgaatttcaaaaaaataataaaaaagcccagaaatctcattatcaaaggcagaattatctaagttgctgttttctaaggaggtagacatctggctgtattaattcagtcatttttaatgaaacagtctcttactctctataaattcagagagttaatttatgtttacttaatgtttatttgcatgcctacctacaatctattatacatgtgtctttattatctagtttgtgatcatatcataaattcaaatttctattatttatctatctggaattttgactcaactttgtagtttacacttttttttcccctgttttgaagtggttatagattttcttgcttacctgcctttgtaaacatctaatctcctgttatcttactcccttggtcaggctgtcaataatataagcttattcagttttcctctatgtatcttgacttctacttccgaagcctctaattataaactgaaggagtttgccattttatcttttttcttcctcctaatgccacataaatatgaacttttcttttttgaactattaactccttctgaggttttcagttagcatggatagcttaccaaaattgcagccatccttagaaactgctctaaccctctctcctacatattaccaatcatcattttaaaacttgtagaattatcatgatgtaaatactagtgttcttagatctttttgcatgcctatattagcacaagtgtatatattgttctggtccaattttgcttccgtcttatgcaggagtaactctaaaacctttgtattccagggccaactaaatatttgagtcctgaatagtcactgggcacatttttctgtaattttcttactttttttgacttatcttcaaataaattgatgactttatcacttctctcatgcactaagctcttgctcttctgtgaatttccctgacttgggatcagtaatcatcactgcaatttttcaaagaaattaaaggtaagggagcatcacatattagatgaaataagtgtgtacatgtgaatctatccaacatatctttcattcttcaaatgaaaatagtcacatatttataatcctaaagagaggtctaatttctaatgagcacaaatgtgtttacttgaatatatgattatttcctgaaagtctctttggttaccagaatgcttttgtaggtattatgagtaaaatagaaagccttgatttgttcaggggaatgaggcattctcgtaaatatgtatttttatacaatgtagatagctgatcatatagggtcttctaccttatctcttatgattgctaattttctcaaatgtttgtgtctgcttccccttagtatcaaagtgtgtgtgtgtgtgtgtgtgtgattcaacttacaacatatttcttttaaatgctcatttttccctctcaacattatgccagcaggggatcagtgacacctggttcagtatacacattctacccgtcaaaaataactcataagtttaataaattttgtgcataatataaacagttaaactctttctttagtaatatgcctttattaaaatcacgtatattcaacaataagttgtctcatgcttacattaatactcaaaggaattacggtgcaaatacaaaagagacgactttttttttacaatgaaaaatactctagcaaacgagatttaacacaggttactttttatgccctattttgcaggatttagtttattttcaatgttaccacttgacaaaggaatacagtacctttttgccttatgccttaggtctattggtttaaaattgctttgcacaattaaaggtgcaggttattgtcacacttaacctggaatattacctagagttggaaatactgctgcctgacataatgcaaagtatagaggatagacgggcttttcctacctattgatcagtacaaaaagacacatttatgttgacaagaaaagagtatctaatggcctttccttggatgagtcaaaacacagtgcttttgaacatgtagctcacagatcactgcttcaaaatcacctgagaagcacctttatagtgtaatttcaaggactaattccagacctgcttgataaaaatctctagggatggagactgaaaagctgatatttacaataagatgactatagggaaaccaagacatactaaaatttgaggcaaccgtctaactgaaaagaacatgtgtgacagggtggttctagtcccaaatctagctgatgacagagaccttggcccattctattatttagctttgggcctctgctttctcatccattagaccgagaattaggagtaggtaatctctaattcccttctagctctaaaattttgtagatgtagcatttttaagacagtaaagaaaaggagaataggaaaactatcaagatgggaaaactaggtagaaagtaaatttcataaaacctataaagactaaagcaaaataaaagtttaacttaaaaagttgagattattttttaaaaaaataaacgtatttagaaaccctaaaatgtgaagttaatacacacacacacacacacacacacacacacacacagtttattctcttaaaacaaaaattgacaaagcaaggaatatgtcacagaaatctacagttaaataaagaaaaaaggaaaaacagaaaggaatgacactgcaaacattaggcctgaagagagaatttttttgattcaataaagagaaaacctaaaaagaagaagctaagctttctttagagcattttacattaaagagcatatgcttttccttcttgatttaatttacatagattgttctatttttcatttttcctctcattttatgtatgtttactaagaaatttatcactttgttttcttctgaattttgaaatttggccataatttatgtcagaacctatatttccttgtcaatatttgctaggtttgcagtagtgcttgggaatgtgtgaaaggttattttttttttaagtaaaggtggcatctaagatgataagtagaaaagttcttaattaattagcttgacaatccttctcacccaccactgctagattaattttattcgaatgtgttttctttatgtaactctgctgttcaaggactaagagcctcaacttggcatttgatgctctcggtattctggcttcatttcatcaatctgaccaaatgtctccttccttatcaacttcattaccccaattctgtcagtcccatctcaataatcagctagtcagaaagcttctcaaggaacagggaacatctgatagcttctatgtatatcagttatggtttcatttcagccacctaccagaaacagcaatggcttaaacaataggtggctatttttcttccctcccagtaataagtctgaaggaatgcagttgctgtaattttatttaagcaatgaccttttcctcatgtttgaaaagtggcacttcccattatttctgagttcaaagtagaaagaacagagaagggaggaaggttgcaccatctgtgcctgtcccttctttgtggggaaggaaaagtctttaccagaagtcccctccccagatttccactgacatctcagaggccagaatcacacatagtatgtccatttctagctgcaagggaagcttggaagtgaagtggtagcttccctgcttttatagtgcaaggcaaaggagaagagtatgagggaatggacaggggtcatccatctcattgtcatttatttgcttgattacattttatgcagattatacttgtgatatgatctacacagtcatcatataaattatctcctcaatgagtttgtatacttttcaagagcagaggatagtattcccagttggtatgcttcaaagtgattagctcaaagggggctcttaataaatatttattggcatatatttaatgcacactcatctgtttggggcaatatggtttactataaggagctgaagttctggaatctaaaaaaatggaatttgagtcattaatctcctatttaatagctatatcatggtcactgacttgtcaggtaacatctcttagactcatttatttttctgtgaaatggataaagataattaaatgtactttattaggtctgtttgagacataaatgtgaagatgcgggtggaagcctattataaacaattaagcactagattggaaaagttaagcactgttcttaatataatatttttaaaattctggaagaaaaattggctaagtgacaaatttgcaagaggcagtggaagttattctcttactgttatatgacattccttttaaagtggtacagctaaaccaggaaagagactgcaattacaactaagaagctactgcattcgatttgttaggctttcacaactgcttctacaatcgctaagattaacttgccatttgttctgatattattgcagctgcaagcagcatacaaagatgtggtactttagaagaaatttagaactccagaaaatattgtctaatcagcagtcctgctcagtagcggatagagaacagagtgtaaaacatttacaattatatgtggacaatagcattcagccatatattggtattctgatttagatactcattagaaaatgtaccccaccttgtctgattacagttggatgatattgctatccttactctttcactgagctacacttaatgactagactttatttgggatatcagagagtggatattacctgagtaagggcattacttatgaaggataatggaaataattatatgtgaattcagcacccaatccacagttgcttcctctgacaccagtcagtaatctcatgcagcttaatatggttctgtggttgaggttaggtgagtaattgtcgtatcaattaagtaaattaaactaatttttttagcttttattattcagatcacttatatttgcatactacaaagaatgcaatctttcaatctgggttaccctaagtttcactatccagtggaatgacagagaaaagagaaaacagtgtcatataggtggttttgatgagccaggcctggaagtgacccatagtaaattttctagaagtcagtgtgaaattgccacttctatcttcaaggaaggctggaaaatatagttagctctgttccccagaagaaacagaaatgcattttggtgaacacaaagcaattactactacacagtgctaccatttactatctatgtattgttggacaagttgcttaaactcccagacccaattttctagtctattaaaaaaaacaacaaaaaacaccataatacttgccctattggattttgtgatgtcaataagaatgacacatttaaagaccttatccagtgcctagtacaaagtaggtattctaaaacaatattatttctgtttagtactctatggaaagaaaacacataaacatacgtgatcattattctaattacttgacaatctagttgaagagcacattatatgatggcaggaaacatgaagggatatttgatgaatgccaaaatattctcagaagataaagatcgctatgaactaggattcaattcaggagatagttgtagtaaagattttaattagcccctgatggaggggtggaaagagaatttagatatttaatacttgatatcaatcattaaggagattttctagtttgtttctttatatcagaattgcttttgtaactggctcaggactttgcagatagattatgagagtaacatgtggggaagagcaaattaagtaagtatactggattaagtcattaagtcaatggaaatgtttgaaaaacaaagttatggccaatctatcagagctgtgatgacttcctgattaagctattatttatgacttccttctttttcaattccttttgaaacttctggaaattgggatagtgaagaagggaaaagaactttgtatgaatctatacattttcacgcatgttgaaatgctaaaggtcatttttttgctatatttgtcaggatggccaggaacaaacaccaaaatctcagtagctttacacaacaaagatagtatgtccaatatggaatagcaggaaatttgctccctatcgtcactaacagaggctctaggatcatttcatgctgccatgtccacatctcaactccatgaccactgtggcagggaaagagatgaccactctgagctacctcagactggatatggcatccatcacttttgctctggggccattaatcaggatttttcacttagcccctacttgcaaagggatgaacatgtctttccttgtgcccaggatattagaagatatccaggtacagtgagcacttgaagtccctacaacatcggggtaccacttaaagatgggattttcaagatctaattgggcaaagtctaaaggtaatgagcaaattcaaagtgaccatagagcgtactttttggcaataaaaatgctatctatttgactgtctgcctatagctcaaatctgaaccagtgaaatccgtggggcaaggaactgtcctcaccagagtcttctttagaggaagtttctcacatcttctcactttacaaagtttttgatttatttgattttagtgaaatcacttacataatcccttcattttgcgtggtatcataaagaatacaaagagtacaaaaatatccatctcttaagaagtttaaaatattgcaggtagagtttatattctatgacaatttgatatcaatgcaatgtaaaatgctgtgtaaaaatgatgcaaaaagcattaaaaacaaacaaaagatgattagagatctgggcttcagagaaacagggaggttttctgagagagataacacttgagtagggccttgaaattggatgagcagtgggaaagataaatgatattttggaaagaggcaagcaatgtgtgttgggcataaatgtaggaatgatagtgacttgcaacatggaggaacctccgggccctattttcaaggatttttttttcctatattttgagagcaacttctttataaagaaatggcttttctgatgctctatctcccttcttttctttctccctgtctctgccaccctaacctctcaacttctgtgtctgtgtatcacttaccattccctttataaaatcaggagtcagcatttctaatactctgttttaagtagtaggagttccgtcccacaaatattaatgagcatcatgtatgtgcaaagcaatggaatttggggataaatacacaacagaccttgttttgaacaccttatattcagcttgaaatctttacatataaacaatagatgctaatagtgaaagagaagcagagagaggagagtttggtttttgagaccactgaggacctggccttcccaaaggggacagagaagtgttctggagaagacgctctctgaaccaattcctaaagaaagaaggagatttatccacttggaaacgagaggaggggacctctaggcagagagtatggtgtgagtaaagatatagtagtgtgaaagagattactggaagttaatttcccagagatttgatattacttgtgggtacataagaaccacataggagaagtagtcaagaacctgctgttagaaggcactgagtgccaacttaaggaacaataattttataggtaagaaagatgccatttctgtcatgtctagaaagcaggcacttttatccttaaaccttgcactatgaactggcctaggtaaacatacattctcaaatttgcctgagggagtgataatttctaaaactaggagagtgggatgtaaaaaccaaacttggcttcgtgttgccatctgccctgagatatgtgcacaactcacataatttccttacatcaaattctaccatcagacaattgtccgtattttctcaggaaaatgaattcctgtgggtccagcaaatcccataaactccagtgagtatttgaagcaagcatccaactcagactgagagtcaatgcaacatgtttcagtaaaatgtgaatccaggctcacacagattgagacatattacttgtaaatgtaaataaatataaaggtgtgcttttctattttttgacaggaaggaatatttgattcatatgtttaatatgctttgcctcttttgccgaggtacaacataaggaaatgctattcatcatacagagaaatttcagaaacaaatttcttagaaataggaacaaccgatcagagagtgaaaggcgaaaaaaagtgaatacgatttatctaagggggaaatttagttgtgttgacaattctgtgtgttcagtagtttggaggtgttaggactgagacagacgaacagaggttttgatcttattacaatatagcagctagtatgccgggtggcttaagcaacattcactccatttgtaattaacatgtattaagcatcctaaggcttggctgtaatgttggattgggtctggggcaggcagcttcttcgttggatggagctgggtgttaacatggccaagattatttgcttggcacctataaggaccaacttttactgatgatatattctagaatttctggggcatcttgattttaaacattcctctctgttattacctccagcacaactttgctgtagaattttcaatctattatatgctgtggaattctgattacttcttatatctggacggggacctgaaaaaaaaaaatctttgtcaaattatgtgttctgaattttggtttggaaattataggataaaaaatgctagaagatatagatgactcaaatatcttgaactgaactatcttacaagaaaagcccataaaacaggagctaagttcatggtatgttgatgatatcactgtataaggtaggagtgacagccttattgtctggattttaaaggatttttatcttcaaaagggtaaaataggttaaatgtactggtttctaaaagaaatattaacaaatgtttattttctttgcttttaaaataccatctaagactgggcgcggtggcttacacctgtaatcccaacattttgggatgctgaggcgggtggatcgcctgagattaggagttctagaccaacctggccaacatggcaaaaccccatctctcataaaaaaaaaaaaaaaaaaaaaaaaaaaatatatatatatatatatatatatatatatatatatatatatatatataaaattagccagatgtggtggcaggcgcctgtaatcccagctacttgggaggctaaggcaggaaaattgcttgaacctgggaggcagagtttgcagtgagccgagatgacaccattgcactccagaatgggtgagagagcgagactctgtctcaacaaaaaaaaaaaaaaaaaaaaaaaaagaaaaagaaaaagaaaaaaaaaaacacctaaaatacctttggaaatactattttctgtgggggagagttggtgtatactgggtaagactgaccataaaactaaaggttagttttattcaaggataattcaaggatagacaaactcctttccatagaaaaatatacagcagaacaatcgttgaaattgacatggacccctctacacagggaattggcagcctttctcctaaaggatcagaagtaaatattttcggctttgtgagtcatgccgctttggtgacagccctgctattactgtctgaaagcatctagacaatatgtaaatgaatgggtgtggctatgtttcaataaaatcttatttatgggcccttacatttagatttcatataattttttaagttacaaaatcttcttttgattttttttctacccatttacaaatgtaaaaaaacattatcagtgcatagctatatgaaaacaggtggtgggctagattttccccaaaggctacagtttgctgacttttaagtagtgtaaattttggctttctttctcatgttccttctgttcagttttagaattttccccttttgacagagatttaggaatgtttgttgccaaagtggttagaataaatagtggtaaaatgttgtaggtatgtttaatcagttatgttttgtttttaattctcacttttattttctccacctataaaccttcagtgacccccccctcctgacaaccacatcttgtatcagtcactgtaaacttctgctgatttcagctcacagggtgtctttcccaggtgtgtgcctataccccgcacctggaagaaaactccctccctgccatctttcctctgaatagttcttaggagttcatcaaggtcccattcagttctcacatctagtagaaatctttatagccattccctaacatactgataggtacaaatatatagttttgtacctaattttttatacactctcacacatgtttttcagtactccgagaggcagatgaattctttcattaatacattgattaatttttcagttgccccttgatacaaagcatgtgtctgagcaggtgctggtgggtaaaatgtcctgactggctgatgtatgcagagatagtcctcttccaaaaactgtaagtaaactgtcttttagatcttcatgttgggtgtctcctattagctttattgaagaattacaaacagcaacagacaataaatagttcagtaattcaaatctactttagaattcccattctgacactaactgcttgattttagaaaagttaagtaaactgtttcagcctcaattttctcatctgtataataggatcactgatttctaccttgcaaatggacagaataaattacatgatatactacatggtttataatgggtactcagaaatggtagccattattagcttacttcagtgtgctgtggggtagtatgggaatatgaagaatataaatgattacatatgtgatttagaaacacaaaaactttggcatgaagtagacaataaactagaggagaaaacagagataggttttggcattggatttttttaaataagtatatgcttttccctacaagattttattgggagttgaggcattcatccacacttctgtgggttgatgactctcctgttgatatgcttacccagaatttcactccaaactgacataccccaatacttactcaatttctcttcagatctctcgaaattaatctggtataatttgctcttatctttgcaacaagccccttcctgctctagtgtctttggctcagtcaggtgatgccaccctgcactcagttattcaatccagaaacgtggggttcttgcctcctccatcttcctcatctctccccccatcccctgccaacatgcccaattaatcacaaggttcccatcagttctcctcttaactatattcttatcattttgtggtcatcactcatacctactcttgccttctacaaaattcattgctcccactatagtcagagtggctttgattttttttttttcatttttagtacaaaactggccatatcaatctctgcttaaaacccttcactaaagtttcatggctcttaggatggagtgtaaattcttcagtttgactgagcaggcattaacatgactgaacccctgccctctcatcagcctcttcttatctcacactctgtcttgctctctggactctagacatacttgtcttattttattacttctgtttctagagccttgatggttgttcctcttgtattgtatgctctgcatttacttaaatggatttgattgtggaaattgtttttcctttagaaaatatatctcataagtatatgttggtactttaaacattttgccatttttgccttatgtaatctcttgcacagcacctgtctgaatggttgaccagctgatgactgaccacttctgtcgaagagaaactaagaatccttctgcatgtaacatattatgttattttggggtgtttcacatcaaattactcaaagttcgtcttttgctttgttgctactacaaataagtctatatctgtcaggcattttgagtgataagaagctgttcttccttctctactttggatgttatagacaggatggacatcatgctggctgccatatctctaggcaagcctcctctggaaaatgttagtgatagggatgcttcatttgcatgatttttattattttcccctaatgtatctcatgggatgatcacaacagatctgtgatatacatgaaggaggttttcttttgtcttgtttttgtttgtttgtttgtttttgtttttttcttgttttgtttttgtttttgagacagagtctctctctgtagcccaggctggagtgcattggtgctagctcagctcaccgcaagctccgcctcccgggttcacaccatcctcctgcctcagcctcccgagtagctgggactacaggcacccgccaccacgcccggctaattttttgtatttttagtagagacagggtttcaccgtgttagccaggatggtcttgatctcctgaccttgtgatccgcccgcctctgcctcccaaagtgctgggattacaggggtgagccaccacacccatcctgtcttgttttattttatgcttaggaatctatttaatttaaaaacatgtgatgtaacctgtaaggtatcttcatagagttggtatctagtagacatcaatctatggatcaaataccctgagagctggtctaacacttaaatagctgtacccctcattctttcttctctcttccgcataggaaccatgagtttcctttgttatagtggtgaacttttttgtcacatccaggtggaggaaattctgggtattcgctgagagcaaacaaacggacacacgttgggtcctatactggtggtgttatatccaacactgggaaggctatttcctcatcatgctgctttcagggcacatggaaacactagaaaagaattattagaatagagttagaattccagttaggatagaaatgttgggaagtgtgttggtgtttgtgccgggatgttaagctcagggcaaagggattccagactgttctggaatagattatttggtaccaacgctttccaaatttttttttcttgcttctctgccagccttttggaatcaaactggaagttctagtaacacttgcttctgtcgctgccaaagtccctgctggtgaaattaattccctatgtgtttaatgcatataatttaatgttaaaaataaaatggtgagtcttaattgcttaggtggacgaagtgtactaaactgtaagttactgatattataggtctctttgaaggtgaccttatcaatgtgtggccttcagtaggaactctggctacttcttccaaaagaattgagtgttattctccagagatctgaaaggaagattgcatcgtgttcattagcatcttggttttctgacagtaaagaaatactttgtagcccaatctttttagttgcacctaaaaatattaggttggtacaaaagtaatagtggtttttgcccattactttcaaagttgcttgtgacagtgttgacggctacaccaacgatttgtctaagatacgcattttatcatgcaccttgaggataataccccagccttacattccttatagaacttgaagttgtgtctcactctttctataaatgtgtcagggaaaaaatagataaaaaaggaaaattggcaagcattttccctgtcaataataaaaacaagaccagaaagatagtcccttggtgaataaaatcttgaatataaagcatgttacatctgaaaaaaaaatctcaaatttcaacagcatgatggcatatgtgtctctataatgtatcctcagctgatggtatcaggggaacatgagacatttgagaaaatagtaacataaaaacgaacattggggcatgtcatccagagtggctactgagagaatactacttgtgagcaagaagctccctctcccccttttcactccgtttttaactcagcattgaattaaaatgaaagaaagggaaatatatatattttttccttttagcagaaaatgtcatggaaatgtcagagttctaggtgattacatctctcttaaaagtcgatagctgcaaatcatggaatcccttactacattggaaaatattaattttgagtaaaagcatcattttcctgagatgtgggcaggctctgaagctttggaaaggtgcttcagaatggagtgtaacccagagccactgaattctctgaatgactgtcaggttctgatcaatttatgtcagttgcagacagatttatgtaactctttctgtcctgccctcagatcacatcctttgagtgctctgctcattcctaagtgcttctgccgtttagatttacttgtattaataattctgttttcaagattcaaagcggtgggaacagcccctttagaaaatgacattcagagatgttacatggaaagaatggggcaccttcagaagcttctaagtctttttcctggctttaggcagaactgatcttgtgtcatgcagatcagtatctagtcaggctttaaagatccttgtcagtgtcttgatctttttgtacaagccagggtcacattccattccatttgttatcagagagtttctcttcactgctgttcctcagctgcaaattcactttctatatgtagcaggatggggaatagggctcttctaatcatcaaggaagtttggttaagtacccaaaattgagaacaattaaagacaagttcttctgatgatgaataagacccctcctaggagcctgtaaagattactgaaagggcaaaagtggtcagagctgcaagtgggagtagggtagggagaagcttagaaaaagatgtaatatactgggtttttcttagtttacagaaatttatgcttatcaatgtgtatacatttatatgcagatatataaacatatatgcttataatacagaataaaatgcataaaggtgagattttatatatatatgaatgaatgaataatttcaaatttataaaacatttgcaaaggtagaacagagggtttctgtatacccctcactgaattcccatattactagcaccttacattgtcatatgtctgtcagaatcaagaaactgaaattgacactggtatattagtaataactaaactctcagcattatttggatttcactagttgttcctctttctgtttcagaattcgaactaggataacacttggcatttagttgtcatggtgttcagtctctgctggtctgtgacagtttcttttggttaattttttttttctgactttgaggaatattggctaagtatgagatctccgttttggttagacgggactatcatattttaatacctgaaagtgaatcatagttgtttatataaataagattgttcttacaattcaaagtgactagaaattcatctatgccagagatgtcttcaaggagagattgagggaaatatggtagagtatgttagcaggcaatgtttgaagaaaaatagagtatttttctttctgtaacctcactgcgcttggcccatttgacaagccaattacatttgcatttgagaggggaaaaaagactgataactattccaagtatcaatgaacaagtatttagtgtctattaaaactatatactaagaggcattcagaaacagctcatccctgaaggagtttataatctagtagaggatataaaacatgttcccatgcaattcaaaatacaaacagataaatgctaaagcaattgagaaaaaggtgttatttgccctagaatcatgaaaatagtttgagaagttaacaatagtgaaaaaggactctagacagaagttggaggtgtgggagggaagtagaatgtgattctaaacatgggagcaacagaatactgggcttatttttggaggtaaggacaatactgcagaatgagatgcataaaggtaatttgcaagagaggagacaagaaaggtaaattgagcagaggttgaattaagggctgtaaataatacgctgggctaattactttttcaatttgcaaaaactggccttaacagaattagactaggtgaatatcatggtcaaagtattatccgacgaaggtgtactgtctggcagagggatgtggtaaggcttggtgaaacagattagaggctggagagaagacattaagagggacctacacaatgtatacatgtatggaagtatcacactgtaccccataaatatgtgtgattattaagtgtctattaaaaacaaaataaaacttaaaaggcagggggatgggcaaagagatagagaatagtggagttgagggcactcactcttgagagtccttatttattgaggagatgacattatctatagaaagagggaatggggaatattgaatgcttaatgttaatggctgtgaggaatgggataggggcttcgtcatccagaacttcaatgcacacactactgaatcgcattgagaatccatttgagatgaggacacaggacattttaagagatctaagcaatgcagttctttgcctctcactctttttcaagtttttgattcccaaggtgaaccttggttcacattcccctatgaccatatcttggagacaactttttatatgtttctcttctcctaacccagatttggaagggaagaagtggatcatttgtttttattgtcttatctttgctttcttaccgttctcttacttttttttaaatatcactactgaaaaatatgagtaaaatgttttttagaacattttagaaaagaaaaaaatacaaaagtaatgctatagtttatcagtgaagcatgaagagaagcttattttgcttactatttgaggcagttctggccataggatttaatggacttcattttgaaaagctgcctgccagatcaagtaacttctcattcatttgagccatgtctatatagcctaaggcctggctcaaaggtatgacagaaacctaatatgagaaatataattttattacagtgaatccatgcagggtattggacaaggaattatacagaaatcatttcaattgctatgttaaattagaaggttgtacaaatattttacattagagaccccttagtcattaaagccacaagcttgctattactatatatttgtgagcaaatatcatcacagacctgactcacattagaagggaaattctcatcacctctgtcatcctttagaatggaaaaaaaaacttattcataaactcataaaaatcccaacagaagaaagtttaaaaaccatggaatatgacctcctggcaaatcaacaaatttgtttttaaaaaaaacaaatcatggtgactgccttaataattatgcagaataaactatttgtttctatataatcccctccatggttgaagactgtcatctttagcagcctctttatcgtatttaaccaaaaaatgtctctctctaacttcgacccattggtccctagctgtctctgggatctgtacagataaatgtaataactatccctaaaactactcatcaaatattataaaagtgcttttattcacttactgggtcatttttgcaaaccaaacaccatttcctccaacattactcaaatgacatggctttgtttttctcactgtcctggtcatcttgtgtgaaacaatgtttaatctcttaggtttcatacaggaatttaatgctcaaaaatgacacaattcttcagctgtattctaatatattttgtactataggctgtattttatcaataccacctattgctttaccttcttttcagaagcgcccccagacttttaattcagacagagctttgggtcaacaaatttcttagatagcttctatatcaactgctgtcaagacaagattctcttgattatacttgtcctattgatttttttaactctaagtttttagacttatctctgctacatttcatctttttatttttttaattgacacagagtttgcatttgtcgcccaggctggagtgcaatggcacaatcccggctcactgcaacctccgcctcccaggctcaagcaattcttgtgcctcagcctcctgagtagctgggattacgggcatgcaccgctatgcccagctattttttgcatttttagtagagacaaggtttcaccatgttggccaggctggtctcaaactcctgacctcaagtgatccacctgcctctgctacctttcaacttcttgccattgttttaatctactaagagatactcctggccattctattttgtataaatatgtttgaaaattttgtttaggaaagatatctagctagtatccctgctagatatattagatatacatcccagactgtttttccccacccactgatttgatcatattccttttgaaaacattaaacttgaacatggccaatgtcagagctctgtgccactccagtaggcaactgcttctggattggttttttggtttgttgttgtttgtctcttatttttgcccagtggtaacatttagagttcatggtgtttgaaacattttcccttgagtatgggtgatcccaataaccaatgttctttggatgcagttgttcaagttataaatccaactaattgtacttatattttaccaatattaggctataaaatcagacattgtcaaagacctttcaagattcaagatttatgtccttattatgtgtaaaatgaatgagccatcattttctgtcatattcagagtttcctaatctaatattctataaaattttaaccttacctagaataaagaatccacgtcaagaaagcaagaaatggcacatggataaattttccctacgcaaaatccagccccagtcaccctctctctgataaattgagtccattggaaaaggcaaccacctctcagtgataagcaccagtcataaattaatatctaggacttgattattaaaattactacgtactgtgctggaaggaaagattctagaaacttgatggcttagattaaattgtcactacccactagacttgaagaagccattggaaaggccattgaggccccctcgtaatttatataaaggaactgacaacctcattggttttcagatttgccagttaattaaatggctcaggcatgtcattttggaaaagctttggatttggagactgaatttacttctagttcttatctaacttagttttatgactttggacaaaatttttcacctctcaaacaatttctctccttatctgtgaagggaggaggttggacagttatgaacaaagcttgtagctccaactttctattaattgcaggaggcaggaagggagctacactaactggagagattcactagttgaaattcttggttttgctgcagaccatagcctacaattagggctttgagactctggctccataactaccaaaggatgatgtctcgaacaggtttaaattaacccatcttcaaggagttcagtaatagactctgaaccgaataaatctcttcctaagcccatttaaagttgtatatagaagagaactggcacaattatttggtgacggtcattttcttctcaaaatttttgttcttgaagtgatttggtttttactctaagtttaattgtagcttttttcttcattgtaacattttaaattactttttagttatagcaaatgtaaattggagtcatattcagttgttcctggaccctctttgcagttttccctctgtcttaagtagacgatgtcggaggaaaaaaataggtaaccataatatgtggccttattatgtacaaaatgaataagccatcatttccagtactatcataaggagctacgtgagaaacattatagtcaaggagtatacacaagcatggaatttacactggcctctgtgtatatgctgaacgctagttactgattttaaatttcaaggtaacattttctaacaagggagactttccccagaggtattgcttctgtctcccaactcttcatatttgagtgctggtcaggagaagcctgggtgaggggatggagaaatagccactctggatgaaggctgcagagccaaccttcaggactgttgtgtctgtgagtgaaatttatagggcatggctgctagccgccaaatccattgtctcacagtgtcaacattaactaccactgctttttatgtttaacttggttaatatgtttagacgctgctggggtccaaatgctgaaaattcagcaaactgaattaatcgatttttctctgacaggaatgttctgtagaaatagatattgccacaccatactgtgagctgcttaacacacacagctgaaataactgcactggtgatgaacttgaatttgaaacagggattagaactctgtgtctgaaggttgggaaaggaggtaggctatggcaaagtttgggtctcaggagggctcattagatgaagattaagtgaagaagtcttgcctttctccactgccttattccacttactcattgcacctcattcctttctacccggagcttacaacctcactctgatgtgctttctgtgcttcagggtttggccactggcagagcagatgaacaactagcaaagggactgtacttttgcaaaaaggaaattatactgcccaactcatcagcttaaagggagaaaggacactcactgtagcacacaagcttagtaaacatgttgggtctctaggtcctccttggcaattgattcccatctggacacaactcaaagtgtgaactcgaatgtttacaagtctctttgcttttggccaaggttgtcttggaactgatacttatgatacccgaggcttcctcacaacttccttttgaagaggtactgatgcttcattttatgttacttgctttgccatgaaggggaaaagcagctcatccagaatagtacacaactccagacttgctaatttttgacttagagtgaaatatacctcatttagtataaatttactttccaagttctgtttttatttactaataataagaatttatttgcattccgtgaacacactcacagagaaaagagagcgattaaaagaggatcatcgaacataaaagaaagaggtcaaaaactaggcccacatgaattttaaaatttgtcctcaagtataaataatctatagtcaggaattcacattaataatttaatttctgccaccattctgagtttttcttcattttttcctactagggaccaaaagttctctataagaatgtccaaggttctggaaatggagttatcctatttgaacacaaatactcaacagctaagaggcatagaagtttctctagaagagtacattgttctacaatcagaatgggtattggggtcatgtggaaggcctattaaatcacagatttctggcccataccccaaatattttagttcggtagtccggactgggtcccaagaatttactttgtcagcaagatcccacgtgatactcatgctgctgctccaggttccaactatgaggacaactattctattaaaagacttatcgacatcgttggcaccagcccaggggttcattcaggaccttctctttctttccatcactgcccctattctaaacacttccttcaccccaaatatttcggttcattaggcctgggtgggtcccaagaatttactctgtcagcaagatcccaggttatgctcacgccacttatccaggtttcaactatgaagacaactattctattaatagatgtatccacatggctggcaccagcctggtggttcgttcagaaccttccctttctttccctcactgccccttattctaatttcttccttcactgccacacttttgattttaggtgaccaaaaaaaatgatcatagaaggaatttttgttcatgattactctcactttcgtgcatctagcaaccttagtgacagctccatgttttaaattcacaaaggacatgtaaagaagttcaaactaaaacataggggcttattttatctaagatgcctcaaacacttgtttccacttttcttatcctctaaccagggatctgcaaactgtagcccacaggccagctgtttgtttatgtaaataaagttttattggcacacagtcacattcatgcattacttgttgcctctggctgcagcggcagagttgagtagttgcaaccaaaaaagaaaataaaaactttgaagggtatattggagttggacatgaggaagaaatactacaggacagttaaatattttcctcacatgtcatcttaagtagtaagggaagaaactccggactaagaaggaataatcagcagaacttatctttccctttaaaatggcaccattctttcatcacaataaaacgagcattaggaactgaatcaggaaaacagatgcattctcttcaaagatgtgcagctggaagaggcaggagcttggcatttgcattatcaggagatctttcttccttttttgtttctaaagtgtggggggagagagaggcatggattataattgtctatttattgctttctttgttttgttcttccaacaaggagcagacaaccatgttttcttacgtggtttaatctcattacacagtttctctctgactaaagccttaagcgaacagttcataacgggattacatagattggtttattttccacaattttctaaacaaggttattcaaggataataccttgtgtagcattttcccccttatgttctattttctttttctatctctgcatctccccctttcaacttttgcctcaccttcctttccttttcctctaaccttcattttaagataccttctataagaaaaggcaaatctctgtccctccctttccctcaggattgctttaaagcttatcataatgtcagcaaggatttgggcattaatcagcaatgcacatgtgtgtattgaatacacagggaaagaggtttatgacaagaaagccaaacaaggtttcttttgaatccgcttctttccctagaaattgtaggttacaaaagagcattggtttcatctccccaacccatgcaatggattcaacttcaagggcacataacaattttttctgtaatgaaaggaacttaacatatatccagacagtaaatcacacagataagatccctcaataaagcattttttcaaagtcactccattaaccaagtgcatcctcataaattgaaacaaaattaaattaattacaggcttgcatcctataattaaaatttcatatataaattaattcaaatataaatatccaaatatcaattaatccttctcgtctgcttttgcacccaccttcaaagagattgtgagtaaaatagtacctttttgttacatagttttactcagaatggaaagactcattaccttctaagcttcaacagttttaagataaaggctgtggaaatttagttatgggaaaatgtcttagtatcagctgggagtttatttttcgcacttaaacttctgtggggtttgttctccagagtccttttttctgttggaacaagcttgtgagtagttttcaagaatcacaagctagtgatttcagtggtattacaatcacatttgttggtttagtgatcaaaatatatgtttactaatcagttgcctgagtatcacagaatattagagctagaagtaatattggtattattaatggtattgtaggacaggaccttggaaaactgactcaattaatcaaacatatatctgttgcacttctgctatgcaatgatgactgtgctgagaggcacaggggcataggcaggcttttccatctcattaaggaggcaagacactcgtggtttaaaagcgcaactaggcagacaaagagattcacgtgcagttgcatttggcttacgcagatcgtaagccattcatagagttgcctatgaatggggatacattatgagaaatgtggcattaggtgatttggttgttgtgtaaacatcatagagtgtcctttcacaaacctggatggtacagcctactacacacctaggctgtatggtgtagcctattgttcctaggctacaaacctgtacagcttgttactgtactgaatactgtaggcaattgtaacagtggtttttgcgtatctaaacatatctaaacatagaaaaggtactgtaaaaatacatgataataatcttatgcagactccatcatttatgcagtctgtcattgacgaaaatgtcattatgtagcatataactacattatgtaaatttagagaagagagaaatgtgagatagggaatctttttgaatggtgtaaaacttaagagattctctaaattgttaggctgtgggaaagaagcataatgtaaccgccgtattgattcattcatttattcatttattcactcaacaactatgaattatcctgtccttgtattctttgttttccttctgttacaaggagacatgtgctttgctactattggggtcaatctttcatttgggaactatagtcctagaccatcttcattgactttactcctgtagttctcactccctctttcctacttcattaatgtttctctctctacttcatcattacattaacatgctttggtgttgtccaccaaagaacagacaagcaggcaaacaacctctcggctctacctgccaccacagacatctccttaatacctgctcctattcacagcaaagcatcttgaaagagctgagctgtgttcacagtctctatttcttcatttcccattcactctgagcccctctgatcagattttcacctccatcacttcatcgccaatgacttctgcatgctaaatgccaatgtcagttctcaggtcctgcctcatgtccaaacatgttttaatgcaggggattacattcttgtgggaaatctttctttggtgcttccctcctgtctctcaactcatcagcggctcctgttctattttctttgctggttcttttccttacacctaactcactcttcaatgtttgctgtaaacagagctggctctgggtcctcttcttttctcaatgtacatactctctctaaatgatattcatgacattacatgtcatttagaagctctaatgacaaccagcatgtttctctccagtcctgccctcatcccacatgtttgaagttatccaactacctacttgatatctctgcatggatgcctagtaaacatctcaagctctatccagagcacaattctttatttctcctcacaattttttcttcctccaggtgccatatagatggaaaaccataaaaaacttttgcttcctccttgacttgtgtcttccacacattcaattcacaagcatatcctcccagccctacttccaaaatagatctccagtctaactttctctattttatgcctagcctgacccaagctcttaattgttctcctggaatattataatagccttgccaattagtctctctgcttttttttttctgccctactgtagtcattcctaatatacaaaaaccagagtgatctttctaaaacctcaattaggttgtccctttcttaaaacttttcagtctctctccactgcacatgatagctaaagtcctagccaaagtctccaagtccctataggatctggcactcaccttgtaccttcccagaaaaatacagttagccctccgtatcatgggtttcacatccgtagatttaaccaacagtaaatttgaaacaaaaaaattccaaaaaacaaatctgaatttctcacatgctgcgtactatgttgagtctgtgtgaatgaagtaatgtgtaggtcttgtattaggtattatataatctagagaggatttaaagtatatgggagaaagtatgtagttagatgcatatatgatactattttttgtaaggacaaaaaatgtgagcatctgtggattttggaatccatggagggttccttggtatcatggaatctccagggatactaagggacagttgtactagccatttatttctcagtccatccctctcacactaccctcttctctgttcctctgacatatcaggctgttctttatttcagggttatgatcttgttgggacctcttttcatatgcctccctataagtaagttcctattttacatcttacttctgcagagagatgtcctcaagtagagccccagttattctttattgcacaaccctatacatccttcatagcacttttcctcctttgcagttacttcatatttttatttgactattgatcatctcctcccttcagaattaaggtctacaaaggtaaagacttggtctgttttggtcactgctgtattctgagcccctataacagtgcctgggtgagttgggtggtcagttaatactagggatgagtaaggttcctgtgcactgttagggatgtggagattcacaagacatcaacactgccttcaagttgcagacaatcacaaagggctaaaccattctccttaggccttgtttcttaaatgcaaaatgagaatagtgtgattttatgatgcgttgtatataaagagaggaagcaactaaaattattttgttttataagattaggttgttcagttgagcttccccatgttatctctgcagagaacaacttctttctgtagagaaaacaaaacaaacaaacaacagcaacaacaaaacattccacttgttgcttcttgaaggacagggaggtaaagcaaatgagacaactctcgctttggagtgaacagaggtggtcttcacaggcaagtgtggtcttcaaacagatttctacttttcttgcttgtgagccagagtttggaagtgtacctggtcatttgcttggtgttaccattccacataatgctctttctctctctctctagtttcattttgactggagagtgtctgcaatgtcacttcctgcttttccccacattttggtggccttcctggtgtcctgtatgttcatgattctttctagccctctctttttctttcagaaaactctgaggttctgtaaaatttgatgactctgccttgtaaagtatttgatgtgcttttatgactttctgggaaaaagtattttcctttaccctttccaattctcattctctatttccacatttgagatggcatcaactgtgaaaatggttcacatcttcccttttgctgtgaatttttcctaaattagagcatttcatgaccttgaaagacttttttttcatcaaagagcagaatcttcaaaactgtttgcctttttctcatagaaaatttatcatacttggaaacattctgttatgattaaattttcaaacataattatgaccattgtcaagaaaagattctgcaaaccactcacatccaagagacttagcatccaatgtgtctttcactgtatgcaaagtgttattttaaacatgtcattgctttcctgggtatattctgatatatagtatttgtttttcaataaacttggcagctggctgcaaatatgtgcctgttacaaacttgccttcatctgtgtgtacagccattcatccagtcatttaattccacagatttctgttaataactctgggcttgtaggtcaattataggcagtgaatgtggctttcttccaagttataaccactccctacccacacccctacctccaattcataaatggaagctccagagccctgggagaacagaggcctgcaaggaaaggaagtgtcctggcagttttgcaggtagcagcatgagtagggaggcaaccctagtgtataatggactcctgctggtgttattctttggaagagctggcctgagctagaacttctgtctcagattcagagtcacttcaccacatcacgtccctgaagctgcaagtgttattaacattaacctaagttgggcatctgtgcaaacttgttgccaggtgcttgttgtgtaccaatgatgacacaccggcaatctttgaccacccaaatgctgggaaaggatttgttacactctctgaagccattttcttagcggtgcatggctgaaatagtagatttaaattggtgcagccgtgaggatattactatgagacagaggagatctaggggaatgtctactcactttcaaaattattctgtcttttcaagaactggaagaaatttgaattaatcaggcttttcaagaatctcacggaagagcaataaataatctaccatttgcccatccgtatgttaggttcagtgtttttattttcttctggctcttttcttataatgatgaactttatatctgttgcataattctttattacaaaagacaaaaacttctacccacccacctccacctcttttggtttggccaaacaagtttctgacactgctgctggtattttttcattttttaagctgagaaaacaatgactagatccctatggaaatgtgggcattactaagtcttagttagttagaaccttactcagatactggagggtggattagggggagcaactagcaagtgttgtgagaggagaccacatgtaaaatatttctaatttaacaagtaagagagggccgagcatggtggctcatgcttataagcctagaactttgggaggctgaagcgggtagatcacctgaggtcaggagtttgagaccagcctgcccaatatggtgaaaccctgtctctaataaaaatacaaaaattagtccgggcgcggtggctcacgcctgtaatcccagcactttgggaggccgaggcgggcagatcacgaggtcaggcgatcgagaccatcctgactaacacagtgaaaccccgtctctactaaaaacacaaaaaattagctgggcgtgctggcgggtacctgtagtcccagctgctcgggaggctgaggcaggagaatggcgtgaaaccgggaggcggagcttgcagtgagcggagatggcgccactgcactccagcctgggcgacagagcaagactccgtctcaaaaaaaaaaaaaaaaaaaaaaaaaaattagccagacatggtggcaggcacctataatcccagctactcaggaggttgaggcaggagaacccaggaagtagaggttgagctgagatcatgccactgcactccagcctgggcaacagagcaagactccatctaaaagaaaaaaagtaagaaaggatactttaataaaacctttgcaagaataaaaacaacattcctatccaaatatacctttagaaatctgttagaaatgtgtcagtcgtgattgaaagaagatatatagtgagtgtttgggaactccaggggttcatcctataaaatgcttacacagtgagacagagaagggctatgaattctggggatcgaattccttacagcctgaatgatctaaatgtgaggtattatgaagaaaaagctcagtctttttaattagattctgagctatgctatcttaagcatctgacttcattttactgagtgtctgtttccttattcgtaagtaggaataacaatagtattgataggaattttagttaagataatgcttataaatttaagaagcatagtgcctggcacatagtaagatacatggtaaatgccagaaatccaagaaatgaagtcccatgcaaagctgcttagcccaaacaaaggtgatgtttactagcttctggacagacctttatgacggtgagatttttttttttttacaaatcttgcagaacacttgcactttcacctgcttagttaattcttatcatatctctagaaagaagcaatgagaagctaagacttggatcagaagatgatgatattgcaagaggttacacttaaacattactcctttgattcatgtgggcctactaccttgtacacagcaagtcatccacacatgactttaaaaagctgttgtttatgtagtgttccaggtgccctttgagaggaatcctcttaccaatattctagaaatacacacctcgagtactatgcccttagtatgccatggctagctgtccattttcaatcaatcccagtgctgcaccctggggaatagactctcacagcaaaacttttctcctggcacctctagcatcttaggtcatcagccatcagcacctattcggaggcctacttttctacacaagttttggccggaggggagcaagtgagcattatactttttctaataaaatcctttaaaaataaatccattcatgtttgggacacttttttctacctgtcatttatggttgctaatgtgtagttgttatttaattgcatgtttatgttaaacattccccatgccaacatgatagccgcaggcttgactaataaaaagagagagaaagaaaaaaaaataaaaaacagaaaaagcttagaggaaagatgcatgagtaaatggaaataaaatgggatatttcaataggaggtctccaaaattgatagtttctaggaaaacgcatcaccttgcactgccagtggttctttcttagcttccaactaatttatactctagtaaggtactgtccttttcttcacccagccttgctaatttaaagaatcttaactggggggaaaatgctaatcttattttgggcctacccattttcccaatctcagtttgatgtcttcctcggaatcggaaggcttccctggagcttggtgtgctgggcttgtctgtgctgtggctttcagtctcaggccaggttttacaaattttgtcgcattggtctggaaaagaggtagggtggttgacttgttttttaactcaatgcaaattaatttatgctttgaaatttgctgatcttctcacctcaattgggaaaatgtctgactatattgattggccaaatgaaggactcaaggactcaaggaggtcgagttcattttagaggcttcttaaattgtcctaaattatcccactttggaaagcgcagtcttgtgacagtggcattaaggtaaagaaaaacagcctctgctccagctctgattaggccctgtctccttccagagtctttctctccaatccaaagccttcgcatgtacaatttcccctggaaaaatctccttcacaacctcttccaagtgactcccattcatctttctgatgtcaacttcagcatcattccttcagagaacttccccaaattcctagtttctgctagcaattatcaatccttgttctagagctctgttcctttgagaataaattactcaattggtaagtaaatattcataaatattatgaatgaatgagttaggaatgaagtataataatgaataattcattcctatttcttcaactacagcgtaagttccaaggaaatagggactatgtcaatttttgctcattgttctatcctcagttgttaacacaatacttggcacatagtaagcaattaaaaaatctgttgaataaatgatcccaatgttcaacatgtacatagcccactggataatttagtgaaatttgacttgcatgcgtaataaagcaccagagagaatctggtccccactgggataccagcaaaatttctgttttgccatttgggaaacaccttgacatccaacaattcaaagtcaaaattcctgttccacgcaggtagctgagtaaatttaaggtcaactaaaactggactcactagtcatttcattcttggttgctcttttctcctgttatccttcttaatggatatatcctgccttctcatgacttcaaatttctgcattctgatcatgagcattcctgtggtttcacgctcctatttgttcttctgctaatgatccttataactgttttctgcttatttttatagattgcttgatcttctttactaggttgtttatatttctaaaagcatctgattgattgcacttctccttgcatccctgctaaacttaatgctttctattgcccttttcatttctaaagtttaactgagatgaatttcaatttcactttcaggaacggtttgcaaactgtggagttttctttatttctgaccaggctgttccccagggataattttaatttttcaaataattagaaattagtaacctttctgtcagtaaaaataaataaataaatcaatgaaaagcattctggacataaagacctaaaatttcatgtcatcctcagtttgttcattctttctctttcttcctttcctttcctgtcctgtcctgtcctgtcctgtcctgtcctgtcctgtccttcaattgaaggtctgtctatctaaacacattttgagagcttatcttatttggggctcatcagcaggatccattcattctgtttatcctcaaaatctagatgattttctcttctggtcctttgcaggaataaccagcaacaattggcaagagggctggttgtggcagtaggaggtacgctggcactgaagatgcccaagttcttctttttatttctttctggaggaaagccagtgccattgttggcagatcctgggctgaaaataaggagttgtcaccttacctctgccctaattagttgtgtagcctcagtcaaatcaattcccctttatgcactttaattctgcccatctatacaatgatggaggctaaattaaattaattcaaagaccccacaatgccaaagattccaagaaaattgatgaacttttgatttttaaaaaatcaaatgaacctcaatttgcaacaatattcagtggtttcactgtcaaattgtagtttctaaagaagaagtctaggtttagcccaacctagagtttggctgttttcccacatgactcctgagaatggaatagcctctgactctcctccaaacactgtaacagagacaggagtgccagatatgttagaaggtataagcataaaacaataagtcaatgacactgaaaacatataaggcactaggtaacaccaaactgagaacaggagagagataagagagtgctgtaacgctagcacagcccctgattctcaggaggaattgtctgtgaaaggacagactgagctatggagggacacacagcaaccctgctcatggcaggtggatggcgtagcactcctttgccagacatgacattcagggagatgcaataggagtatatggaggatatctttgttgggaggagtcactctcttcagcattaaacatctcattaagtgacttcctcaatttcagtgatgtccagaagctttcagagataatctgagcagtcagtgaactgatgtgtctgccaaggcatgaatagcatagattgttcagtgtttgccctgggtctatcagcagtaataaattttaatcggttaggcactttttaagcatgctactgtttgccaaacattatttttggcaggcatctgtaacaaaacctaatgcattatgcatattatttctatggtatttcattgtattagcacatgtagtatttgtatggaatttttgtaaattcattaccaaagtagtatcacattaattattctggtttaaaaagtattaggaaaaaaataatcctggggagcatacatcatatcatggggaagtgggaatgatctattgtcatttaaattgtggaaaaatattagcatgtatacgagaaaaataacttataaaagtacacagcaagtgtggaaaaagtgaattattaaatacattggtgtttccttaaatactgaatgcctaatttcagaattctaatgacaatcattattacagattttactgattggttttatttaacagtataacttagtggtagagacccataagacttatttcatttctctgtgtcgtatttctttggtatcttgatctgctaaatcatactttctcactctttttcccccttctgtttctgtccatctctgaggtgcagaggtcctgggcctttgaactttgtataactctttcttcttaaatccctagtatagggaaactataccatagtaaaattatctatcttggctggaaactactccaataattcagttctccactgaagtgtaagatttagctctattaagtgtctcttagtatcactcttctattcttataagatagggtcatgaaaattagtagtaaattattttctctaccctactggagattatattatttccagtggtttctagaaccttgatttgtcttgttcttccaaatttgacaaataatgtctagggcactcttccctttagaaactattttacaacacagtagtttatcattgtcaggaaatgttatagctattcttcttttcacaggttttgattcagataacacctctctccaagaaactcaaaaatctctgcaaatattgctttccatagcttcacaacagtcctttgatgcagggcaattctttctcactgctactaaaaaaatgaacaacctttgccctacgcaacactgtgctaggcaacaagtgactgaaataaatgctcaatttaccttttagaaatataaacccaaaggcatcatatttgaatagtcaggaaaataaaatacacctactgtattacatagtattaaaaaactgattatatattatttgaattacatgaaattatattatttaaattagaaggaaaaacgtatttttttaaagcagagacttaatacatttatcaggataatgacaatttataaggctaatggctattacacttataaattcagttatccatattccatagaacataagaatcgagtctttatttcattccattcagagctgcacagctagtgcaaacttttcttcaatatttctacataaatcctccttcctgactcacgttccattctgactatgaaaaatcaataagaccttgaccttgttgctttcatgtttcatgcactaattcataactagaattaaactccccccaaaaaagtcaatcaccgtgaacgggagccaggactagaatgcacctctagacagagcagccggcagcggctcgcattgtgaattttagctccagattgactacaagagcaaactaacaatcccaagaggacacacagaccctctgacggaagtggactgctcctgcaggacctgggagacaccgcaaatactgtgagcgccccaactgcggaagcgggaaaaggagaccctcctctcctgaacacacccccctaactggagaagctgaagttctgtttgcctgagaaatttctgactttacctggagctgagtcaattaggagagccaagggaaatacagaggtagaggaagcagcagcaaggccctgggagcccgctgggttctggagcaggccattcctgcttggcaccacagggatccaacgagagaggaccaggggctaaaactacacggggagaagcaaatctctagatgaactttgtaaaaatttgaacggggtgagaagcctcctggacagaacttgggggagggcacgaattggggatacagactccacaggcaggggaaaaccaagccctttactttagcagctgggaggcggatagcctggggcaggttttcaagcccatattgctctctgcctgggaaaggtctgggggctgttggggcagacacagtggaagtgagaccagccctttggtttgcgtccagagctgggtgaggcctatgactgccagctttcccccacttccctgacaacctgcatgactcagcaaaagcagctgcataatcctcctaggtatacaactccagtatacaactcccatctcccacagcagcaagacccaccccagagagtctgaactcagacacgcctagactcacccccacctgatgatccttccctatccaccctgatagcggaagacaaagggcatataatcttgggagttctagggccccgcccaaccactggtccctctccatgctacttacagctgattctttctggaaagcgccacctcctggcaggaggccaaccaacacaaaaatagagcattaaaccaccaaagctaagaactctcactgagtcctgcacccccgccacctccaccggaacaggcactggttccatggctgagagacccatagacggttcacatcacaggactctgtgcagacaacccccagtaccagcctggagccaggtagatttgttgggtggctagacccagaagagagagagcaatcactacattttggctcacaggaagccacatccataggaaaagggggaaagtaatacatcaaaggaacaccccatgggacaaaagaatctgaacaacagacttcagccctagaccttccctctgacagagcatacccaaatcaaaaggaaccagaaacccaaccctggtaatatgacaaaacaaggctcttctacaccaccaaaaaatcacactagttcaccagcaatggatccaaaccaagaagaaattcctgattgacagagaattcaagaggttagttattaagctaatcagggagggactagagaaagacaaagccaaatgcaaggaaatccaaaatatgataccagaagtgaagggagaaatattcaaggaaatagatagcctaaagaaaaaaaaataaagaatttaggaaactttggaggcgcttttggaaatgtgaaatgctctggaaagtctcagcaatagaattgtacaagtagaacaaagaaattcagagctcaaagacacgatcttcgaattagcccaatccaacaaaggcaaagaaaaaagagtaagaaaatatgaacaaagcctccaagacgtctgggattacgtgaaacaacccaaactaagaataatctgtgttcctgaggaagaagagaattctaaaagcttggaaaacatatttgggggaataatagaggaaaacttccccagccttgctagaaacctagacatttaaatacaagaagcacaaagaacacccgagaaattcatagcaaaaagatctttgcctaggcacattgtcattgggttatccaaagttaagatgaaggaaagaatcttaagagctgtgagacagaagcaccaggtaacctataaaggaaaacctatcatattaacagcagatttctcagcagaaaccctacaagctggaagggattggggccctatcttcagcctcctcaaacaaaacaattatcaggcaaacattttgtatacaatgaaactaagcatcatatatgaaggaaagatacagtctttttcagacaaacaaatgctgggagaatttgccattaccaagccaccactacaagaactgctaaaaggagctctaaatcttgaaacaaatcctggaaacacatccaaacagaacctctttaaagcataaatcacacaggacctataaaacaaaaataccagttaaaaagcaaaaacaaaaaacaaaaaaaaacaaagcacacaggcaacaaagagcatgatgaatgcaatggtacctcacatttcaatagtaacattgaatgtaaatggcttaaatgctccacttaaaagatacagaaccacagaatggataagaactcacaaactaaccatttgctgccttcaggaaactcacctagcacataaggactcacataaacttaaagggatggaaaaggcattttgtgcaaatgaacaccaaaagcgagctatttttatatcagacaaaacaaactttaaagcaacagcagttaaaagagacaacgagggacattatataatggtaaaaggccttgtccaacaggaaaatttcacaattctaaacatatatgcacctaacacactggagctcccacatttataaaacaattactaattgttttagtaatgagatagacagaaatgagatagaaatgagatagacagcaacacagtaatagtcagggacttcaatactccaccaactgcactagacaggtcatcaagacaaaaagtgaacaaagaaacaatggatttaaactataccttggaacaaatgaacttaacagatgtatacagaacattcatccaagaaccacagaatacacgttctatttaacaatgcatggaactttctccaagatagaccatatgacaggccattctctctcagaccacagtggaataaaactgaaaatcaactccaaaaggaaccttcaaaaccatgcatatacatggaaattaaataatctgctcctgaatgagcattgggtcaaaaacaaaatcaagatggaaatttaaaaattctttgaactgaatgacagtaatgacacaacctaccaaaatctctgtgatacagcaaaggcgatgctaagaggaaattccatagccctaaatacctacatcagaaagactgaaagagcacaaacagacaatctaaggtcacacctcaaggagctagaagaacaagaacaaatccaacccaaatcaagcagaagagaggaaataaccaagatcagagcagatttaaatgaaattgaaacaaacaaacaaacaaaaaataaatgaaacaaaaagctggttccttgaaaagtaagtaaaactgatagaccgttggcaagactaaccaagaaaaaaagagacaaaatccaaataacctcactgagaaataaaacaggagatattacaactgacagcactgaaatacaagagatcattcaaggctactatgaacacctttatgcacataaactagaaaacctaaaagagatggataaattcctggaaaaatataaccctcctagcttaaaccaggaagaattagataccctgaacagagcaataacaagcagtgagactgaacagaccaataacaacagcaagactgaacagatcaataacgagcagcaagactgaaattataatttaaaaattaccatgaaaaaaaagttcaggaccagatggattcacaccagaatcctacgagacgttcaaagaagaattggtacctattcttgtgacactattccacaagatagagaaagaagaaaccctccctaattcattctatgaagccagcatcaccctaataccaaaaccaggaaagggcgtaaccaaaaaagaaaactacagactgatatccttgatgcacatagatgctaaaatccttgacaaaatacttgctaactgaatccaacaacatatcaagaagatattccaccatgataaagtgggtttcataccagggatgcagggatggtttaacatacacaagtccatgtgatacacctcataaacagaattaaaaacaaaaatcacatgatcatttcaatagatgcagaaaaagcatttgacaaaatccagcattgccttatgattaaactctcagcaaaattggcatacaagggacatatcttaatgtaataaaagccatcaatgacaaactcccagccaacataatactgaattgggaaaagttgaaagcattccctctgagaactggaacaagacaaggatacccactctcatgacccctcttcaacatagtattggaattcctagccagaacaatcagacaagagaaagaaatgaagggcatccaaattggtaaagaggaagttgaactgtcactgtttgctgatgatacgattgtttaaattgaaaaccctaagacctcctccagaaagctcttagaactgataaaagaattcagcaaagtttccagatgtaagattaatgtacacaaattagtagctcttctatataccaacagcaaccaagtggagaatcaaatcaagaactcaaccctttttacaatagctgcaaaaaaaagaaaaaaaaaacttaggaatatacctaaccaaggagttgaaagacctctacaaggaaaactacaaaatactgctgaaataaatcatagatcacacaaacaaatggaaacacatcaaatgttcatggatgggtagaatcaatattatgaaaaatgaccatactgccaaaaggaatctacaaattcaatataatccccatcaaaataccaccatcattcttcatagaattagaaaaaacaattctaaaattcatatggaaccaaaaaagagcccacatagccaaagcaacactaaacaaaaagaacaaaactggagacatcacactacctgatttcaaactatacaataaggccatagtcaccaaaacagcatggtactggcataaaaataggcacatagaccaatggaacagaatagaaaagccagaaattgaaccaaatacttacagccaactgatctttgacaaagcaaacaaaaacatgaagtggggaagggacgcccttttcaacaaatggtgctgggataattggctagccacatgtaggagaataaaactggatcctcatctctcaccttacataaaaatcaactcaagatggattaagaacttaaacctaagacctgaaactaaaaattctataagacaacattggaaaaccccttctagacattagcttaggcaaggatttcataaccaagaacccaaaagcaattcaataaaaacaaagataaatagctgggacctaattaaactaaagagtttttgcacggcaaaaggaacaatcagcagagtaaacagacaatccacagagtgggagaaaatcttcactatctatacatctgacaaaggactaacatccagaatctacaatgaactcaaacaaatctgtaagaaaaaaacaaacaatctcatcaaaaagtgggttaaagacatgaatagataattctcaaaagaagatatataaatggctaacaaacatatgaaaaaaaggctcactgtcactaatgatcagggaaatgcaaatcaaaaccacaatgcaataccaccttattcctgcaagaatggccataatcaaaaaataaaaaaaacagtagatggtggtgtggatgtggtgaacgggaatacttctacactgctggtgggaatgtaaactagcacagccgccatggaaaacagtgtggaggttccttaaagaactaaaagtagaactaccatttgatccagcaatcccactactgggtatctacctagaggaaaagaagtcatgattcgaaaaagatacttaaacatgcatgtttatagcagcatacttcacaattgcaaaatcatggaaccaacccaaatgcccatccatcaacaagtggataaagaaactgtggtgtgtgtgtgtatatatatatatatatatatatatatatatactgtggtgtgtgtgtgtatatatatatatatatacacacacacacacacactcacacacacatacacacatatacgatggaatactatgcagccataaaaaggaatgaattaacagcgtttgcggtgacctggatgagattggagactattattttaagtgaagtaactcagaaatggaaaaccaaacatcatacgttctcactcatatgtgcgagctaggctgtgaggatgcaaaggcataagaatgatgcaatgggctttggggaattcgggggaagagtgggaggggggcaagggatagaagactaaaaatatggtgcagtgtatactgctcgggtgatgggtgtaccaaaatctcacaaatcaccagtaaagaacttactcatgtaaccaaacaccacctgttccccaataacctatggaaataaaaatgttgtttttaaaaattaaacttgctctgggcaaagacaattgctgtcttaagattttttccccaaaactaaaaacaatatgctgtgtacaaatatggcactcaggaaatattttttgctcatgatgttcttaatatttttttttacttgaaaatgaaaaaaaaatcttcaattttaatttaatttttttatttttatttttagagataaagtctcactctgttgctcaggctggagtgcaatggcacaatcatagctcactgcaaccttaatctcctgggttgaggcaatcatcccacctcagcctcccacctagttgcgactatgggtttgggccatcacacccagctagtttttcaatattttgtagagatgaggtcttgctatgttacccagtctggtcttgaactcctggtctcaagccttggtctcccaaagtgctgggattacaggcatgagacgttgcacctagccctaataagatttttgaggaagagctttccttaaactattttcctttgaggaaagttagattgttcagtcagaaattgaaaatggccacctatccaaacctctcaaattagtgtgttttataaatatctgaaggaaactttaatgccaagagaaaagaagaatgttctatagttaaaaagcttcaaaaaagggagaaaaatcaatgtctccagaccatttgacatagtctcagtgtttggttgtaatttaagaaagattgaatgcttaagttcagaaggttcagacaagaagattttctacctgccacattttcaagctgttgacctagtttccacaggtgtactgggatgcttcatcactgaccatcagaaggaaattttcatggttaagtcagaaaataccatgcttacattctccctggttctttgagaaaagatgggttgaagaaattagggaatatttgggaaatatgaagttgatggtaattggccatccttcgcaatgctcattaaaaccagcccacatgatttttgctcttctaaaatttttcctttcctcctgaaactatattttctaaaatcctactcatcagctaattatggtcccaagctcccaatccccctacagaaagaatgtccactgcttaggaactgattggttatttggagatagaagaaaataggattgaaaggaccagtctgtgccatggcccacattccacactattttctccttgtgaagttgaaactggatctaaccatttggaaattatttacctaccctctctcccatcaagagggaggcagaaaaacaaatggggtcatgagtgccaagaacttgtaggcaaagaggagaagaagaagccctccttgccaggataaaatgaccaacatttccatcttgtttgtcctgacaagtatagagtaccttacaacttttggcccttgctgtgccaaaacagagaaaataatgcagaagaaattaatagtcaagaacagtattttggttttttttttcttcctcttcaaaagtctatgcttttttgatcatatcagaggaaaggagtgaagatggaaggagtccatatgaaatccatataaggaattaagtcataatgacatagtgtattgtgtgtttcccaggaagccatttgctcaaggatttattaggatttactgtgtctgtttgggctgtggtatggggaaaatgtgttatacagccaaaacagatgagcatcaccagacccccttgggctgcatcaatatcaattcctggaacttgaatgtacagttagaggcagtgaactagttaagtggtcaagcccattaaaagttagtgtgtagaggctgggtgtgatggctcacgcctgtaatcccagcattctgggaggccaaggcgggtggatcatgaggtcaggagatcgagaccatcctggctaacacggtgaaaccccgtctctactaaaaaatacaaaacattagctgggcctggtggcaggagcctgtagtcccagctactagggaggctgaggcaggagaatggcatgaacctgggaggcggagcttgcggtgaaccgagattgcgccaccgtactccagcctgggcgacagagtcagactccgtctcaaaaaaaaaaaaaaaaaattagtgtgtagagtcagatgtggtggctccagcctataattccagttagttgggagactgaggtgggaggatcacttgagcccaagagtttgaggctgcagtgagctatcattgtaccactgtgtgacagagtgagatcccatttaagaaagaaagagagaaagagagaaggaagaaaggaaagaaggaaagaaggaaagaaggaaggaaggaagggagggagggagggagggagggagggaaggagggagggaaggaaggagaaaaaatagaaaaacaatttgcttgaggaagttgcttgatagactactctaaaaagtatattcattagcattgaccccatatatagcagatttgagtaggaggcagctttttctttgaatactggtttatctcttctatttagggaagaaaagggggaagtgtgtttttgttgctgttgtttgttcatttgtttttgtaagaagcggatttccccattgattttgcatttacattgagttttcttgagacattgtatttgagttttgctttccattgtatgtagatgagatctgccttgatcagcttttgagtaagattcaagtgggcactggtgtgatgaaaaacagagtattataaccttgagtagttcatcgcagctagtaagactggaaaatgcaaatggcttagattacaccgagaaaattcacaatagctctcagccttaaagagaaatggaaggttctaaggcagttaaattttatactttcattgacataaaccacctaactagctgttctgctttcatgccaaattttggctctctaatatttgtattatgtagaagggtactgtaaaatcttttagttatctctcaaaaatggcatgagataactggatattattactagatctgaaaattttaaaaaacagcaaagatacaaacaaaagaaatagaaagtcttggagtaaaagcttgtcctcaagagataacatttttacctggcatcatttcaaaggaagtgaaaggaatatcccaggtgcattgtggacatcataaagaataaaaacaaaagctcgttggtgtgaatttaaaaataaaaaaaaattattgacttctatcttaagtatacatctaccatgcagcccgttcagatgtagcagagagtttggtgagttctagacatggaatgagctctaacaaggaaaacttacctaaatttattaatcttagctgaaatagcaacacttttaaaatatgaaagacttggctgtatcagacttttctgtatcttaattagtttaagagcttcagctttcacaggggtgttattctcaaagcatttgcatttggaggttaggtgcttacaattttggaattactttcagatttttgcaagctacaaaggaaaaaaggaaagcattactttagagccatgattttgctttagtttgcatgatgacatactggagaggaggaaggggttagattcagacagctgttgggttgatctgccagggactaacttgtctggcctttggtgagttgctgatctctctgagtctcagtttcctgactgggcacggagtaaccctgcatgcattgttttatcccaagactgcaataataaatgcgctttctaatcatcctgaagtcccctttgaagttttcaagaaattataagcttaatttctacattttacatgtatgcattttgtaaaaacatgcttacaagagaacatgcttctctactcccaacacaatgtgtggtgtttttttccccacaccaagtaattctccaattctctgtggacaccagttgggcatcccacaattcaattcaattctgacactaatacctggatttagcacagatcccacagggtaagggtttggtcccacaagactgcctgttacttcagatgctaagtccaggccccctgtacttctgatcacccagctatcgattgggggttcccacaacccctatcctaggttcaataatttgccagcactgctcacaaaacttagggaaagatttacttatgtttgctggtgtatgataaagaacattataaaagataaagatgaatattcagataaagaggtacataggacagggtctggaaggatcccaagcacaggaacttctgtttctgtggagaaggggtgcaccagcctccagtacatggagacattcactaaccaggatgctcatcaaacctagttattcaaaagtaactaaagagcttaatctcgagctccctctcttttcctggaatcactgggtggagctgaaagttctaaccttgtaatcacttggtctttttgacgaccatcctaagtctatttaggaggcccactccaagacacttcgatagcatgaaatcaggtgtgatggaaaggggcttataatgaataacaaaagacagtcctttcactcaggaaattccatgggttttatgagttctgtgccaagaaccagggacaaagcccaaatacatgttctttaacaccacagtgttattctacatgtagtcaatagtagaaactctcagtattgaccttctcatctgaacatgccagacagtaaaggggttgtcatccacggtaaggccagacactgttttcttctttacatttctgtctcttgggaatgttgactttggtcctcactcctttaggcttatagctctcagctgcacctttccagccctttgcactggactaacacttctgtgtattgggttttccttcctcctacccaacttgaagcctgattacttctattcaaaaactacagtatggaggacaggtagtcctgtcttgccatctggtgataatggaggctcactggtgttactgatctgacctactgcagcaagttcaggttttgcaggcaggctcaatggaggagaggtagactgcactgaaatcctttgagtaagtctggaatcccatgctaggtgggccccttccactcccattccatcatcaacacttgcaacagccacttggaaacaccgtaggtctggttcaattcgcttagtactaaactttcttctgacccatacaaaaatgctaaaaatataaacatcaattaaagactctcctgtttttcaggtgttgtcagttcagggggaaaggtacttcttgatgataagactttgtaatgttttctaaagtagttttagtcactaacttattcagtgaagactgatcaaactactgctacgttcaagggatcttgctatgtattagcagggaatctggggagtagagtgtgtgctgggaaaagggggaacacggcaaacatggcttgtaagagctaataaatacaagaaaaactggaataaatgttagaaatctgataaagagagaattgattttgatgcaaaagattctaaaaaaatgtttatggatgtgctggcccttagggctgaatcttgaattatgagtaggaacgagatgttcaaagggaagagaaaagcattccagcttaagtgaaatatgtgagaagtttaaaagcaagaacatctggggtgttacttagatattgaggaagctagtggtgtactggaaccagctcctatcagttcacaagacttaacagtgcacctctcttctggcttggcattcagtgacagcactttggtagcttgaaaacagacttggtggagtatttacaccacagaaattgccaaatactgcaaatcagggcttcccctcaacgtgagaaccagttgttaaacacaagcacaggcttggctagagtgcccttttcctcaaagaatctcttagataagactgttctttctgccatttatgaaatgggcacactttggtttggttagtatagatgatttgcaaagtatcgcgtaactatgtgtggaagcagaccgaaagcacatgtaaatatcattctgtaggacttcaatgccaaagagctttgtgattctgtgtatgtagcacaattacaggagccagagaaaaaggacatcagtcctaagactgttagtggctgtgccaaaatcttttcatcacaagcgtcttttcacacacatgcacttgagactagattgtgtgcccaatccgaggtctattattacttttactagagttgagggaaaggggatgagaaataagaaaaaataaacttgaaaattacagccttaagggcaaaaataaggaaattttaagagaaaaaaatgtgtgaagattaacttcaagaccacaataaaagaaacaccttgggctctgagggccctttatcatgcaattttgccagcgtttctaggttcaatattctgaaaagggtggacgtttcagtggttgctctggaagcattattttctgattctgtatctttgctaagggtttcatatgcaatcccccttcccccatgcagaaaaatgcacatttctatttctacaacaaatatccatgtacttctagtgcattagaaatctccttaaaatacgcagaagaactgtaactaaagattaactttatggccgggcgcggtggctcacgcctgtaatcccagcattttgggaggctgaggcgggtggatcatgaggtcaggagatcgagaccatactggctaacacggtaaaaccccgtctctactaaaaatacaaaaaattagccaggcgtggtggcaggcacctgcagtttcagctacttgggaggctgaggcaggagaatggcgtgaacccgggaggcggagcttgcagtgagccgagattgtgccactgcactccagcttgggtgacagagtgagattccgtatcaaaaaaaaaaaaaaaaagattaactttattccaggtactagattaatgagattatatctttttttttatatgtgtaaatttaaggggtataaatgcagttttgttacatggctatcttgtatagtggtggcttttagtgtatccatcacccaaataatgtacattgtacccattaggtaatttcttatacccaccccctctcaccctcctgagtctctgatgtctattattactcacattatccatgtgtacacattatttagcttccacctctaaatgagaaaatgtagtattgactttctgagttgtttcaattacaataatgtcctccaattctatccatgttgccacaaaaagacatgatttcatttttttatgaccaaattgtattccagtgagtgacttgaggaagaaaatgtggtacacatatattaatttatgcagtcattcactgatgggcacttaggtttattccatgtctttgctactgtgaagagtactgctttaaacatatgagtgcagggatcttctttatataattctttcttttcctttaggtagacacccagcagtgggatttctgaatcagatgatagttctattttttttttttttttttttttgagatggagtatcgctcttgttgcccaggctggagtgcaatggcacgatctcggctcaccgcaacctctgcctcctgggttcaagcaattctcctgcctcagtctccgaagtagctagaattacaggaatgtaccaccacgcctcgctaatttttgtgttttgagtagagatggggtttctccatgttggtcaggcaggtctcgaactcccgacctcaggtgatctgcctgcctcagcctcctacggtactgggattacaggtgtgagccaccacacccggcctctatttttatttctttaagaatttctgtatacatagagtatggaataggcactggagactcagaaagatgagaggatgagatgagagtaaggtatgagaaattacttaatgggtacaatgtacattatttgggtgatggttacactaaaagcccagactttccatatatggaaaacagtatggagattccatttccaccaacagtgtattagcatgccgttttttctgcatccttgccaacctctgttttttttgtctgtttgtttgttttggttttgtttgtttgtttgtttgttttgtctttttagtaatagccattctgagtggtataagatgatatctcattgaaggttgataaataaacaggttgtctggtatatagtttttatttattcaacaaaaatatatttgagagcctagtgtgtggcagatgttgatttaaaaactgaaaatacaatagcaaacagagtttttcatgtagctgacattcctagcagagacaaacaataaacacatgtgacagtgccagggagaaagtaccattgaacagcaaagtgacaaaatacttgttgtctgtttcatgtttatgaaatagaagatatctcttattcattcaaacaagaaatctacttttttattttgactttaaaaatacaagaagtacaaagaacaatgtaacagataccaaaagtcttcctaccctaaattattaaaagcatattgctttcattctttttttatgaaaagaaaaagctaaaatccccatggaagatcatcacctcctacctttccctccctgacttcaggcaaccactgtcaataattttctatacttttacatgtatgtatttattagaaagctgtgcatttttaaaaatttgtatttatatatttattttttgagagtaggtgtcgctctgttggccaagctggagtgcagtggtacaaacatggctcactgcagccttgagctcttgggcttaagtgatgctcctccctcagtctcctgagtagaccacagacctcagtcttctggtgccacagatgtgggccaccacacttggatttctaaaaaacaatttttgtagagatagggtctcaccatgttgcccaggctagtctcaaacccctgggctcaagcgatcctcctgccttgtcctcccaaagtgctggaattatagatctgagccaccacacttagcctatgcatttttaaaatctttttttttttttttgcagatgagtaaatattgcattattttattctacttcttaaatgtatgtgtttgaagtctactcctttttatctattgtgtaatattgcatcatattatatagtatgttattaatctacatcctaaataataaagcaagtttaaacaaagtgagtatatttttaaaatatttaagatgaatatattcatttcaacagcattccacaagtgcttatgggaatatcttgtcacagccccagcccttaggtggcatgaactacagagaggagttagcctcagtaatggactttaaggagcaatatatataaacaccagctaccatgttacacagggcagaaggactgataagaggggaagaaattaactggtttagaatttgcagaacataagtgggaggatatgtaaagcctttcaaagaaaggagtataaaaaacagtgcagtaggaaattggaagagaaagccacagtatcagcaaaccaggttggaaagtgcaacgcaacttgaggaaagagaaagttcccattgactcaaggaaagagacttaggctacttacaatttgaaactgcagatgagacaagaactaggcggtcttgacacaccaggcttaggcttctacctaatccatcagtcaatggagagtttttatccctgtagtaatatgctcgttgcccaaggaagaaaagccatcaaagtaagggaggagggagctgacagcatccacactgaggcacagtggaacatgcccatgggcacttggagactaggttgctgtgtgctgagtgagaacagatttctgacctcgtcaaagatatacctctcgtctccctccaagtgcaaagaacaaaaatttcagccactccctgatccttttcttgcaagaacccagcaagagtattttatttctatggattttttttcaatacagtcattggaattccttcaataacttcaaggaatcaaacgagtcatgctctttttaagacaaggtcacagaaagttgagcatgactctaataacatgggacagtagaacaaagaggtttccgtggctctgcctggatttcacacgggcccattggaatgttcagtctcagtgtgctttggcctcctggctatggctatcttgttcctcttttatgtgctcccattagtgagcgacagggaatcagagtacattacaacaggactgcaataaagtgtgtgtgtgtgtgtgtgtgtgtgtgtgggtggaggaggagtggtttgattagaggatggagtaaatatttgtggtgggaaaatcctcatcagtttctttcttgccttcatcaggggactggttatggggacataggcagaggagctttcgtgggtctggaatacacaagtatccagagctttcccccaccaggagcttgcttaggttctgaggacacagagaataacaaaacaggaaaagaatgatgcaggggaaagggtatatcaattactgtatttccttacttctaaagcacacttttttccccatattttactgtctttgaacatggtagtcactgttgggctgacagaagttgtgacataattatcattgcctgcacaaaagcacaaaaccttgctgatggatttcagagattaggaagaaaatcccagatacaataggaagtattcttttaaaggcatattgtatcacagacatttttgatggcatgaaaggtaaaattatatgggaaaaccacagatatttgtaactctgactcaaaaagtgactaaaaggagtaagagtctgagttttaaagattagaaataattcactcatatttttgcttatattatcctttttatgtatgaccaggtgatatgtgataggagatttatgttttaaaaagtctaagaggcttctttccatagcataaactaaaaattctatgtggcaagaaataattgcaccatgtttgaattattgatcttagtaatccatcttaaatcaatgctttaaatataattacatcgatgaataattgctacacaatctgataaatgctataattgaggtatgcacaaaggactgtggaagtgttgagcttctgagagttcaaactttgccagaggagaggacataaaatctaaggagttttagcatgagtaggagttttctaggtaggaaagaacattccaaacaaaggttgaaattttgactttctgatcatttagtttttaacttctttcccctccgccagttgttccaggtccttcacctcaactcttattagacaaagggtgctgattattaatttatgcctctcagcctaacactaaagattctaagtagctttgcttcacttttgttgcccagtggaccatatgcagtagtgagttttaatcttcttgcatcttaattcatctcctttaaggtttagagctccaagcctttgtatttattctttcttggtgatcaaatctaaactgcatttttaaagagatgcatttatgttaccatttttcctagcttatttatacaggactcctcctgctagatgaattattccttcattttatcaaaagctaagggaacacccttatttggaaaccttaaaagtagtaccaggttgcaccattaaggtaccaaattcctcacatattgccaatagaaaagcacttattaattcttgctaatgaagcccttgataggtattgtggcctggagaaacatacagtttggttatggagaaaatatctaattgcaagagcagtaatgaaacactacaggtgggagggtggggggctaatacaagtgcttagcttagtgatcgctggaaccactataagaccattaccattgaacaagataattgcagcacagaaatggggaggaaagcattcccttatacctgtattcattttctagggctgctataacaataccacagattgggtggcttaaacaacagacatttattgtcttacagttctggaggctgacatccaactcaaggtatcagcaggtttagtttcttctgaggcctctctttggcttatggatggctaccttcctcacagggcctttttgtgtgttcatatctgtgtgtccaaattttctcttcttctaaagacactggaaagattggattaaggctcacccaaaaaagttaagggctttgctttaacttaatcacaactttaaagaccttatatcctaggtactgggggttaggacttcagtatatggattttggtggggggatatacaactaaagctttaacataccccctcttccctgtagggttaaatttggaaactgagttgcaggagaccccaagcttgaaatccaggcatgatagttccttcaataacttgaaaatgctccatgtttcttcaaaattaaggacctctctcttctacctgcttcactcaactgcttttattgtttatctactgttgctataagcataaaccacccagctttaaatcctctgtgcattactacaaaaataaatttgcccatgctgaattgtggaactgaagtgtttccaaaggtgaatgtaccaaagtggatggttgaaactgcacctttttacattaacccattaatcaccttcacctttaaacagtcattctgcctttatttatgtatttttttttaagagagaagaggggaacaacatagacccagcacagtaaattaaagttcattcaagcacagttgttgttgatgaacaacgcagttctgcttggttgaaacaagacacaaggggcttgttaagcctactaagtcacaggtgaacattgagggtcaggcagtcttaagagaaggtgaaacctttcttatttaatactttgacaaattaataatcgagccatagagtttcttactttcattgaaaatggcggtctctaagtgtaatctttgaaacaaaaagagattaagtctttttgtgcctggcacttgtgaccttggacaaatggacaaatagcttctgcagctaattaattcaagaatttaattcagtgtcttctctgagccatggaaggaatgatatggatattgttttactttgcctattactgaaaaccttcaagatagaaaaatgcccatttttatttaatgtggtgttgaaaatggcctataaaatccactttttatatgcagattaaataagtaatgatattttaaaggacataggcagttgtattacaaataaaagccataaaatttttctccaatagaagcataataaaattatctagattctaccttggaggaaaatttaaaaaatagttaatccattaaaaacaaacaaacaagacacaaatttcttcaagaggttaccataatgtgcttttacttggttagttagatgccaatacagttagactgtattcctgagatcccttggatagctaatgaattgccaatgctcagcagacatccccccgcctgccctctccattaaatatatatgtgtgtgtgtgtgtgtgtgtgtgtgtgtgtatatatatatgtgcgtatatatatatgtgtgtatatatatgtatatatgtgtgtatatatatgtatatatgtgtatatatatgtgtatatatatgtgtgtgtgtgtatatatatatacatatatataacatatatatgtatatatatagtgtgtattgatgctatggtctaaatgtttgtgttccaccaaaattcatatgtcgaaatcctaacccccaaagtgatggtgttaggagatgggacctttgagatatgattagttcactgtgggcacagtcttcatgaatatgattcgtgcccttatagcagagacctcagagacctccctcacttctccagccatgtgacatcacaatgaatacatgactatctatgaactggaaaatgggccctcaccagacattcaatccgccaccaccttgaacttggacttcccagcttccaaactgtaggaaataaatttttgttgtttataagccactcagtctatggtatcttgttataacccaaatggactaagacaattgataaatatatgtgaatagattgcattctacttacatgttgcccatcacatattatgtgacatgtgaagaaaaagagaagtgggaagtggtatcccatgctacgctctaacttggccaacagtgagacttgccacagtgctaggctcaagggacatgcttggtgaaatcttttgggtaagatcatagtgtagagcactccagggccttgactttaatggtctgttgttttctttttttgtttgtttgtttttaattcttgttttcaattataagcactaccattaactccatgggtttcccaggaagactgtatctgagagtggcattctaaatacaaatatatccttactgctagaaaaaaaagtcaaaacatatgtccccacccagatgggtcagaaatgtcgccttcagatctcttggacagcatgctgtcctattgtgactcttttctggggagcttcattgagaaactctttattctatgtccatcatgtttagagaaggggaaatgtgataacattagagtttattattttcccttatgtagtgatagagacactgcaatatacaagattaaagtgagtgacccagtattgtgcggcaagattgagtctgtgctgagacaaaaaccaagctgttctctaagctccgcacttgattcactgagccacactatctctgtgatgttccccatagtgtgtgtgaagcaagtgccaaatgcagtttctcagtctgcacgaatgctccaattggctgcatctcttcccctcctggctgcttttggtagaggattgctgatggaaattgtgctgctgagcttcgccacatggctgtggctacatttcgccagtgttagctggaagaatttcccgggattctaaactagaaagaatttgctgaggggccccttaggagagggtcaaggtttcctaagtgcaggtgatcactgtattatattaatagtcgagattttattttaaccagcagggctccagccattcttgtggatccctgcaatgtggttgaagtgatgttaagttttctctcactgcagtctgcctgtctgcttcaaacagatctgattcacttagggccaagtttcagggtgttaaagacagctgggttggtgtacatggcactgagaagccaagagatgcacgtcctaatcccatgttgtctggagagagactgcaccataattatatgtctatacacctatttctgcatgggactgtgaaaacctcatggatggggagagtattttctccctctttttccttagtgctagcattttactaggctcataaatattatgtttgataaattagattatattggctataatcctctacatatcacttaacctctctggatctcaactttcatggtaaaagtgatacagatgaaccgcgttaatcaccacacttccagtgttatcatctcataattctacacttttgattctctttgcctggaggagtttctggttttgttcttagctaattaagagccagacctagatattcctcccacttagttgttttataaggaggagtgcaaactcgctcaccattgacttcctatgtttatgacacgattagtttgattttggattatctatcacaaatgaagggaaagctgagtaatttttaatgtcacaaaacatatttatgggtgaggtggggagtgttaatccagttgagacaccagttatatgttcagccaactgcaagacctctctgataggtagaaaacatgacaaatttcattcctagcattttgatttgatttctgattaattctcaaaacatccaaatcataaaagtcattggtttattttttaaaataaatgatcaaatagccaaatttttatatacaggtcttttttatttttacataaaacttttaatctaaataaccctgggcacattatgggccccatttaccttctttgattcagagacagaaatgatcacacttagaggcaaaatattttcaatttgggtcagtgacccaaaacttggcaataatcttttactattcttctagttctacactattccaatatgttatttctaatgaatctgagaaatatgatgagattaaaaggtcatccctcatcactttattctatacatctccaagtaagcacccttcattccaagacaaaaaactgtagcagagattttgtgtgtgtacaaatgttacagctttttctgtatagtagttgggaatggaaaatatttaaaaaaaaatagtcacctggatcattcattctagggaagacaaataactgcatcagattatatttctgttgatatttaaattttcatgtgaagtttacagtcttggaaatgactttcctacaaaatgtttttacctttgatcccaatggaagttaaatcagaatttgtcattcaatataattcattacttgcccttcaatagtagctgagtagctgctggtaaattgaaaagttaccttgataataatttaaaaactaaaagaaagttatctataatgttgttctagcctgtggcaaccatccacttttgataaatgttccatcattttaccttttgcccagaccagatttatctacctttctctaccactagaacaagaaggtaaagcagaaacagatggaactcagtacaatgttcagacaacagtcagatactagatttatccatgatgtaattataaattaatgaattgatagtcaaggctcagaaataaacctctcatttggggagtaaatgataatccaaaataccatgacactatcctccaggatcctacacaaagcaaagaaaggggaccaagtaacctaaatatattattgcctggagggagttgctgattaccttccctaaaccaggccttccatccagggactttaagctgaatctcttaacccaacgataatgaagatcacttggattctctaatgccctgctttttatttgtgtttaggcaatgcttcactgacttaagctatttaaatgtttaatctaaaaagtcatcctgataagaactcatatagtcaggaaccaaatgaaccaggccaaaacaagagcaactgttgaacatgtgcagatgccctgagctttggaatgaattaaataatttagcttcccaattatgtttcacttatgcttttactacaactcaacaaatgctttcgaaccactgaacccaatacattttttgttgttttagagtaaatttttaaatcttaagttgtagttaaaaaattaaagtgggatgggaggtgatggcccaagccttgcaacaatgcacgttcattgcaaccaccgtgaccatggataacaggagcagacgagggaatgctgatgtgaggattataacattcatatagaaaattaattgggtattttgtggcttatttttcccatcttattgattagaccactgaaacccaatgattaagtgatttacctgaatctaaccatttcagattttatgagagcttgaaaatgatgcagaattttttgccttcgaattcctcgcccgccaattaatggtagagaaaaataagaaatcggttctctagattctcacttcaatgttctttctactacatcatgccacccctttatttggtgtgtaaacatattagcaggtttgtgattaaaaggagaggtgaaggaaagtctcaccaattattttgctccatctcttcccactgttgctaagttaataattatttgcctgacagcaaaaggacattccacaggaagactgcttttgtgtgcaaagttcctccatactccctcttttcctttttctgcaactagatgttgtgaaagggagaatccatgaagggaccaagcaatagtcaatttaaatccaaaccaccacacaagaacatcaagcagaaacaccttttaattgcctggactggtattgactatcaagtcacttgtatgactgccttgctctggttcaagtttactgtgccttgaaaagtcaatctaaaagagaagaatgaatctgagggagtagagtcccctggggtcaaggtgacaaaactgagactgcagtcacaaactaaaggagaaaaatttcattgtcgcctataagtctttcttaactttcgaattacagatttgtgtttctgtagcttgtcattcaattcatagcttgtcacttaagttgaagggtaaaagttctctccttttaccatgagacaaatacaattttacagacttgttggcatatgtaagaatcaaattgttctgggcttccctttcttatcaaaataaacgtggttccaactgaaagctgaggtccttcttccccagcctattcctatcatgccagcacttctagaatagcaattcatctcaaccgtatgttcaggatcatgcaccactgatgttccccagtatggccagggcttctggggaatgtcatgacctcaatatataagtttacttctataccctcgatgccaacaagacaggaggaaatatggataggttaacccccaaggacagcaagaaggagagtgataaggatggcaggtagcaaaaagcaaaattttggaattctgaaaggtggatggataaatagtaactgaattaataccctggtggggaacaaataactacaactcgctgctgaacaagtaagtgtgggctgtagtactccaggacaacacaagaattgaggcaatgggtcactttgatggtagcagtgcagaataagacagaaaacaggtgaaaagggcaaagggacattagacattagacctacagactctccctggtcccacagagctgagcaattggatatccttacttcagcagaagagggaatgctctttctagagagattaaatcagagaggaagatttggggagtccagaaacagttgagagtggggcgaaaaattgtactgaaaatagggactaagtgaaaggcaggcaaactggttggtgagatcccacagccgtcgctatcctctgggctcttctcatgctggaaagtagtctgtttccctgatgcctccacaggagatgggagaattcctctctggaaaactggcccaataggtgctgacctttgggaagtgcccagtaaacagctagagggaaacccagccccacttgtgcacacagactttttagtagttttatttttcttcactttcaaatagatatggatgtttaaatattgccaaatatttataagatcttctaaaatagagaaagtaaaaccagcaaataggaatccaagagaaatggagaagtctgctgaaagcagaaaacaatctcaaataaaacataactttaatattttgacagagataagaaaatattaagcaatcatatagtaagaacaggtagctataaaataagggagaaactttcaaataataagaaaaagtgttcagaaattaaaaattgggtttcctgatagaaggaataaaaaacacagtagaatgattggaagataacattgaggaaatatctcacaatagataagaagacaaatatagaatgtaggagaaaagaaaaattagaaggtcagtctaggacagtgattctctaaatttccttgcatcagaatcagctggcgggcttgttaacattcagattgcaaggccccacacctagagtttctaattcagaaggtctagaattcaacctaggaatatacatttctaacaagttaccggatagatccgatgctactggtctgtgaacaggactttgaaaactactgttctaggagattcaacatgtgcatcacagcatttcttgatagacaaaaccagaaagcagagaggaggaaatgataatagaaacaatccaataaggatatgaatttctggaatgaaaggacccaggtcatctagttcccagcacaataaatgcgaaaagattcatcctaagggacatgatgacatttcagaactttagggaaaaatacatcagggacacacatgccaaggaaggaagggaggaagggagggagggtgggagggaggaagggagaaaggaaggaaagggagggagggagggagggaaggaaggaaggaaggaaagaaagggagggaaagagagagagaaagaaagaaagagaaagaagcgaaaagaagaaaacaagggatggaaggaaggagggagggagggaagtaaggagaaagaaaagaaagaaagaaaattaacacattcacatttgctgtcttagtccattttggctgctataacaaaatagcataaactgagtggcttacaccaaaatttgtttctagaggctgggaagttcaagattaaggtgcctgctttctggttcatagacagcaccttcttgtgtcctcatgtggtggaagtgacaatgcaactcactgggtttattttataagagcactggtcccattcatgagggctccacaatgatgacccaatcgctccctaaacaccctggggactaggatttcaaaatatgaatgttaggggaaaacaaacattcagaccataccattcccatacaaaaaataaaagaatcagagtagactcacacttcttaatagcaacactgataaaacaaagacagttaaagaatgtatttcatgtcttaggagaaacaattttcaaagttagaattctgtgtgcagccaagtttcaaacaaatgtaaggtctttttcccaacattaagttttcaataattttgcatcctaagtaacgtttctcaggaagccacttaagaatgagcttctattaaaatgggaaagaaccaataaagaggaagactcagaacccaagaaaagcagatcctcttcaggaaagaggcaaagggaagttctcaggtggtgctagaagggatgcttccagatgacagctgagtggcagtttgctgagtttcgagtggactagtagtggctccaggaggagtgttgtactgctaagtggacctagatgtgttcaccttcactgggcaaaaggttgtagttctgtagggacagttggggtaataattattgataaataattaggcacataaaaatattcaccctagctaaaacaaaaatttttataagaaaggatatgtcatccttctatgctgtgactctacaatgcagaaaactcatagtaatgaatatatattatatataaatgctacatctatattgacagaaagtaaaagaagaagtatgttttgaatagagacagaaaactacattctcgctttccatagtagaaagtcatttaacaatgttaaagtggaaacatcacaaaataagaacactatttagaaataagagaagaattgatatgagttgagagtggtcactcctaaaagcaataattttatctaagtagagctgtgtcaggagatacttgctttatcattatggactggagacagaaaactacattctcactttccatagtagaaagtcatttaacaatgttaaagtggaaacatcacaaaataagaacattatttagaaataagagaagaattcatatgagttgagagtggtcacttctaaaagcaataattttatctaagtagagctgtgtcagcagatagttgctttatcattatggcctggaggtttaatttgacatttactatggacatgtaatactttgctgctaacaaaacttcttaaagaaaagaaagagaacttaatcttaggcatgaacaaatcagagaaaactgaattattttgagaggaaggaatgggtggaagataaatctggattccttccagaggtgttgtgggcctgagaagattaagtttagggagctagtccagatagctgtacctatgttccctcatctaaggaaggaaacttttgctacatttttttaaaactcaagcaaatctgggaaacggcatattttaaattatgtccagaaatgctccataaatcagttcagtggccccaaatatcttttttcttttctttttctttttcttttttttttttttttgagaccgaggctctgtcacccaggctagagtgcagtggcgcgatctcggctcactgcaaactccgcctcctgggttcacgccattctcctgcctcagcctcccgagtagctgggactacaggcgcccgccaccatgcccggctgattttttgtattttttagtagagacggggtttcaccgtgttagccaggatggtctcgatctcctgacctcgtgatccgcccgcctcggcctcccaaagtgctgggattacaggtgtgagccaccgcgcccggcccagtggccccaaaaatcttaatgcaaaaatcctactgataccatcttcctgttatatgatgcggccattaatttaattgaaccaaggtcatgaaatgagtctatgcagatgcagcccccatttgggtgctgtataaatgccctccctccaacactgaatgcaggacagcctctcagatgctgccctctgcaatctcctcaccaaatttctgattcaaacaagcaaggcaggtcaatagacagttttattggcccttttgggacatgactgcagaatattagaacttctctttataggtcccttggtaattgactgtgtttacaaaattatgagaaaagccatctagtagttagaccttcttatcccttttccaattttcagtaggctgaaggtgaagccaggacattgagtttgatgtgtggttttggcatggcaggatctcttgtttctaacacaatcaaagagctgagggctgatgggttagaatatttgggtttgctccaccattaatttactctaacagggacacttctgggtatgacttgctactataggaagagctgtgctatgctttggaaatgctatttgttgatgaaacactaattgtaaaatagttacctcggagaactcaaatgtaattacattaagtttaattacatatcattaattatataaaatatttaaattgttatgttgaattgtgctgcactagttgccttacattttgctggtgtgtggagcagatgtgcttgaagagtttggatgtcatccagaagttagtgaattgtaactgtttagataatcggagcctgatttataccatctattgaaaaacaatagctacatattttcagtgatgcgacattattgagtatagggaggaagtagcttatgcctacctgatgttttggtaattatagtttactaccgactttaagtttaatcaaccacatataaggaagtcaatgcctaatttctcatgtgcatcaatagctgtgaacagtaatttttatttatattggggagaacaatttttttctctgcctatgaaactgacaatttttttaggatgcctgaattatcaaaggaatctagagttcaatcatttgccttgtttctcagaggttcacttgctcaaattaattcaccatcaattttaaaatgtctctagacttcacttatatcaaattctctaatatgattgaaagcatggtgaagtatccatataaggaaagtaagaaattcggccgggtgccgtgactcatgcctgtactttgagagacctaggcaggcagatcaccaggtcaggagttcaagaccagcctggccaacacggtgaaaccctgtctctaataaaagaaaaaaatacaaaattagccgggtgtggtggtgtgcacctgtaatcgcagctactcggtggagctgagacaggcgagttgcttgaacccaggaggcggaggttgcggtgagccaagatgttgccactacactccagcttgggcgacagagtgagactccgttacaaaaaaagaaaaaaaagaaagtaagaaattcatacagactaacaatagatttttcttttccaatatgtgaatataaaacctactatgtacttaagggatctgacactagaaaatgtaatgattgatcttaagttttggtaaacaaatagcagtactagaatttcctctcttaaataatttgctttcatatttatatccatttggagtggagcaaagcagagaaacagtcatttaaatataaatgctacagagagaaaaatatttatgattcgtgtttctgccaatcaaataaatggtaccatttaaaattttagtttatttttgtctgtgcagatattatctactattaacagtactttggctcaattcagattattgtgactaaatttctcaaaaattggaaagcacagaatcaatttgtctaaagaaaataacttgttagtatgtcaccagccataaatcatgacatgtcacttctactacctttgaagaggatctattctacagaagttcatttttagaattacctctgcttataatttgaagaaaatacttttttccccagaaaatacttttttttcctcagaaatactcccaggtattttgatgaaaaataattaaaattatctcatataattgtatatacatctgtatatgtgtttgttggtatcagggatcatctaataagaacgaaattgaattctgtaaaagttatgttgactatgccagaaggtacaatctgtgagtcaaaatttgaggggcaaagggagggattacagttacaagggaggatatggaatagagccagtatctgttgagactgaagataggcccaaatgaggagagggactttgagcaggcttgtgtgcaggaagatttgagaaagctcagtttgtcgcttcagcctagcagccttcccagggctgaaggtaactttggtggaattaggagttggtttgccccaacccccaaatggtagtagatgatatatgccagtgacaatgtcatccaagcatcctaagcataaatactgcaggtgattcatgaaacaagtattattattgatatatgtcttatctattttgatttgaaacttgccttccaaccatgacacgagttctattttatttcctaaatcttcattttgactttggcctgttgtaagcctgttccaggctcagaccttgcaggagacattagggcttctttgtcttcaaggagcaacaggggtgtcaaagctatcttagaatcccactcctttcctatgacagtttcaggaaataagaacaatttatccatgacagctttagaaacacgatctactaatttatgcactgcttcttcttgaataattgggatccagtcacgctctgcataacagcccctggctttgggagggtccaggcttaccaactgcttcccctggagggggaagagctggagggtgagcagattgtgccttccctaagcaaagaaagaaagaaagaaagtaaaagaaattaggggtggtaaggaggttagaagacaaaggaggaagcatttgataggtcatctgtcagtaggccttgataaaggctggtaagagaacaatggaaaaccacttcaaagtgaacaatgccacactgagtatgtgccagtttaaacaaaaaagaaagaagacatgtcagctattaaacacattcattgaggggcgtctttttaaccccttacttttcccactatttttctttccttaacgagtagagaaggaaaaaaaaacaacaacaaaaaaaaacagtgagtctgtcaaagcaggagggaagcatgaggttgccagctttccggaaagtcaggcagagatatttgcattaattgaatattaatttcaggatggaggttgtgtagacaatggaaaagaggtgactttttgatggtttcaggtaatctcatgtgtttgagaatttcagagagtggggctccccgacttgttttttattttcaatatattcaaaataaagcaggattaaaaacttaatttgaagtttgggagaataagctaataagattttagattttaaagctctaattcatggacaggaggtacagaacaaaaagggcattttcacatctactcagactacatttttgtgataaccagaaaagagaaaaatcggcaaaagaaaaatttaattaagtgctgttagttcacaagatgatctctcatcttgaaagtgtctgatgtgctagtctatgctatgaatttagagatgaaagaataaatatcaaaatgtaataagaacataatactctgggaaattctatgtgggtttagaacagtgtgctacccagcccccaaagccatctttgatggaagagcagagtaatggctttttctttgtgaacttctcaaataatggaagccttggttaaaacaaatatttccaatatctgatcaatttgacagaggttcctactgaaagttgatgtttctgtaagtgaagaacagttcatctttctaccatggttggttggcttggttcaaatgaaatatagagcttcaacaaattattttggtgctcaactcttgtctcttcagttagacatgcatgccttgtggtcatggtgtaaccacccagtgggttcaccctgtccgctgcctagcagagctgatttatcaagacaggggaattgtaatagagaaagagtaattcacgcagagctggccgcactggagacctggagttttgttattactcaaatcagtctcccggagaatttggaggatcagagtttttaaggatgacttggtgggcaggggaaaaccagtgagccaggagtgttgattggttaggtaggaaatgaaatcatgagaagttgaagctgtcctcttgtgctgagtctgttcctgggtgggggccgcaagattagatgagccagtttatccatcttagtggtgccagcagatccatcaagtgcagagtctgcaaaatatctcaagcactgattttgggagcagtttagggagggtcagaatcttgtagcctccagctgcaggactcctaaaccataatttctaatcttgtggctaatttgttattcctacaaaggcagtctagtcctcaggcaagaaggagatttgttttgggaaaggactgttatcatctttgttttaaactataagttccttgcaaagttagttcagcctatgcccaagaaggaacaaggacagcttaaaggttagaaccaagatggaattggttagattagatctctttcactgtataagtcataattttgcaaaggcggtttcaatggtccatgtctcatctgtcttttgctgccctccacattggcaaatacacggtgcatatattggtttgtttattcatttattcaaagtatctagaaatagttattgagttcctactgtatcaggcatgcttcttgatgctgtacattcagcagaaaacatcataaaaccccacctccatgggggttactgttctagtccaggacaacagataagaaatagcaatgacattcagatattgtaggtaaggagaagcgtttgaaaaaacaaaacaaaacaaaacaaaacaaaaaacacaaagtgtggtagggaaagagaaagtaacaagtgtgttttttaggtctggtggtcacagactgtctctgtgaggaaataacaattagagaggcaactaaatgagatgtaggactgcctacccaaatgcctatgggaagagggtttcctcagaggaaagagccaacactaaggctctgagggaattgcacttgatgtgttcttcaaacatcaaagagtcagcattcttggacaaaatgaccaagatgacgcaacctctgttacccactgttgtcttttaaattttagaaacttgttcggggctgactttcagtaaggtgtattttcatataaaagattgcactcagcctttcattcttactttctagtatcaattttacctcttcaaagtcaaactattccagagctagagaatacaggaaggatgtggatggaagaccaggatgtgaccagtgttacccctggaaatgaagatggacttaagtgactcagtcctaaatgaaatcaggatatgtctaagtaaaatgctatcacttctattgtgttcaaattctttaactataaagtttgggtgaaatcatggttgagaaaattattaaatgtccattgttaggtctctttcctatatagattcataatatgcaaataggacaagtttatctgtacataattctgaaagctggccaggcgtggtggctcacgcctgtaatcccagcactttgggaggccaaggcaggtggatcacctgaggtcaggagttcaagaccagcctagccaacatggcgaaaccccatctctactaaaaatataaaaattagccaggcatggtgaagggtgcctgtaattccatctatttgggagactgaggcaggagaatcatttgaaccctggaagcggaggttgcagtgagccgagattgcgccactgcactccagcctgggcaaaaggagcaaaactccatctcaaaaagaaaaaaaaaaatcctaaaagctaacaggctgtagactatttttctctctgtaaacattatgctaaagggcaactattctattttgactctctatgtaaaatactgtccttatcattgagaaataattttgtgttttcttccaaagcttccccagcagggtctttgacatcggagttttttcccctcatgttgtcattggaagcagctgttacaagtcataaccgagcttatatttatcattaacttagtgacccctgctggggaggcttaacataatcatccttaaattcaaagttggggtttcaacaaaataggtgcttggacctcaaacatgagttcttcataatccaagacaatggattttgcaagttactcaaccagtcccaccactggaggcttcaaggaactcacggtcaccaattgagagagaataacccttgtcacatgactgagtgtgtgactgattctaaaagtgacacatttggcattagcacacttctcctggttgtctgcctctgctccctcaccttgctggctctttttaatgttatctgccaagtgacactttttgatctctttccaatatgcctttaaaaaaatcaaaaggctcagatgatgtagttttctatcagaatcttttcttttttccccgtcacaatagcattgctcagtatcatatgccaacctttttttttttttttttttttgagatacagtctcattctgtcacccaccccggctggagcacagtggtgtgatcttggctgactgcagcctccgcctcccaggttcaaaccattctcgtgcctcagcctcccgagtagctgggaacacaggtgtgtgtcactacgcctggctaatttttgtatttttagtagagagagggtctctgttggccaggctggtctcgaactcctgacctcaagtgatctgcctatctcagtcacccaaatttccaggattacaggcatgagtcaccacacccggcctcatatgctgaactttttcccatcacatttgcagaacgaaactcttgaaaaggaagtaaataccccataaagcagaggacttatatttttattttcatgaataattaaaaagccagatacacttctgttgaagtgtaagcttttatcgtgtcgacccttgcaaattgttagattctccctatctccatcccagaccactttggcataaccaatcagtttaggtaaaccaatattagtgtccaccgcctaatattaacctctatgtacaaaaacaaaaaacaaaaacaaaacaacaatacttcagttttgtttatgcctcagaataacaaatgttagtatacaacgtgggtattaaaaggtctgtgatttgttagaattgacctaagcatatttaacaataaaatttttaaacgaatatttgttttaaatagttctattaaaagcaatatgtgtgtatacgcttcataattagtttacaagctattcactataagatgtcaatagataaacctaaattacctaaaatccaactatctgaatctttccactagttctacagtaagagattttctaagtgtatccaatttttatggaaatgggtagagagagagagagagagattgaacaagatgatataagcacaaaacagttcattttctcccgtttctttccttacttcctcattccttctcccttcctttctttcttccttctaaccctctcttccttccaaatatccctccctccctttcttcttcctaattcgtcctcccttcctcccttccttccctccttccctctttcctctttttccccttcccccttgcccccttccccccttccctccttccttcttcccttgcaaagaaaggagcttccttctttcctttccctctttaccttttttgtccacctttgatgaagacctcacattgaatagaattctacttggctgggtaccaaggcttgtgcctataatcccaacactttgggaggcaaaggcaagaggatcactttggcaaagagtttaagaccagcctgggcaacatagcaagatcccatctctaaaaaaaattaaattagctgaatatggtgatggtcaccttagtcccagctacttgggaggttaaagtgggaagattgcttgagcccaggagtttgaggctgcagtgagccatgattgctccactgcactctagcctgggctacagagcgagaccctgtctcttaaaaaatataataataatttgacttaatttagtgtattttgtatctagagacataataaactcttgctgtttaggaaagaaattcagtgggttagaagaaggtagagacactcgttatatgataaaagtccctcccatttttaaattaaactccagactttatatttagatttcaccagtcttttcatttatgtccactttctgcttcaaattgaatctagaatgtcacatttcatttagttgtcatgtttccttagtctcatttggttagtaatactttctccctcttttcttgttttcctgaccttttgaggaatactggtcagggactttggagaatgtcccataatttaagattgtctgatgtttgtctcatgtttagactgaggttgtgttttttgagaaagaataccatagaaaagtgtctttcttgtaacctcataacaggaaatacatgatagtcgcatggtttgtcactagtttactcggataagacagtgtttgccaagtttcttcactataaattttttccctccttttttcttggaaatgagccactaggtatagctcaccctcaaagaggggagtaaataaggccttttttgaaacatggaccttgatggtgtaaagaagaaaggatagataaaagccattgccaggtttagatcacatcgctaatgttctttcactgaagactcaagtcacagaagagagaatattgtcctcttgaaagtaaatagaccatgatggggtaaactcttctaccttagggttactcatttttaatattcatagttggtagtgcctccactaggtgcttagaagtagtgggttctggactacatggctaaggactgagcttggctacaatagcaatgggtaggccagctgagcatatctcacctatggtcttttatactcaaagaggctagactgggctttttcacatggctaccccagctgtccccagtgtgcaagccttgcttgtttcacacttggtgatatattataccattgaccaaaggaagtcatgaataagtccagattcaatgcaggagacattgtgttaatcaggttctccaaggaaagagaaacttatagtgaagatatttattataaggttattggcttgcacaattggcttgagaagttccacaattttccatttgcaagctggagaccaagcttgcaaatcttggtatagctgatggtatagattgcagtccaggtctgaaggtctgagaaccaggaatactaagggcaggagaacaatgatgttccagctcaagcaggcaggcagaaagaaaattgaaccttctccttccatttgcttctgttgaagcccacaacagattggatggtgtctacccatttttgggagggccatctgatttacttagtccaccaattccaatgttaatctcttccagaaacaccttcacagacacacacagaaataatgctcaactagatatctgaaaatcccatggcccaggcaagttgacacataaaatttcccatcacaagcacaacatatggagtgaataccaaaaaatgtgattctctaagaagccttcatgtaacaatctatacattggcacagcgaataactagttaagttgggagtagaacccaaataaatcctactttagtaccatctccactgtagcatgttgaagcaaagtgtaaaccaaaaataaaattctaaggctcccccgccatctgaacggactttctcctcagccagggctgttttaaaatttaacctgaaagactggttcaggccaggaaagtggaagtcagacatgcctcattttacctctctggcattaacatcaacacagacttttaagtctgataagaaacattttacagcctattctctacgaagcctactacctggaggctgcttctgcatgataaaactttggtctccacaagctcttatcacaacccagacattcctttctgttgatcccagatctttgtttgtttgtctgtctgtttgttttgagatggagtctccctgtgtctcccaggctggagtgcagtggtgcaatctctgctcactgcaacttccacctcccaggttcaagcgattctcctgcctcagcctccctagtagctgggattacaggtgagtgccaccacacctggctaatttttgtatttttagtagagactaaaatttcaccatgttggccaggcttgaactcctgacctcaagtgatccaactgcctcggcctcccaaaatgctgggattataaatgtgagccaccatgcccggcctaatcccaggtctttggataaactcaaccaattgtcaactagaaaattttaaaatctgctctttaagctggaagccccccacaccaacttcaagttgttccaccttcctggaccaaatcaacgtatttcctaaatatatttaattgaagtctcatgcctccctaaaatgtgtataaccaagctgcaccctgaccaccttgggtacataatctcaggaccttctgaggaccgtgtcatggtccatggtccctcatatttggctcaggataaatctcttcaaatatttgacagagtttgactcttcataaacaaaagaaagattgtttttgtactgtgtttactaaagcaggagatcctacttttggattatatactcacaacttgcatattttaggaagattttcggcaacaagcgttgacatagaaaaagatttctgtttagacttttacacaattagcaaattctgtgaaccatattctttcttgagcattttactttttaacatattgaataagtaaaagaggactagaataggattcattggcctgcctcccatttccagctctttgactatgtgggtagataaccttcagcaaatgattgatcttttcttggtgttagtttaattatctgtaaaatgagaatagtcaatagttttttgtgattattcaactctagaaagtcctgtgatatattctattcttcacatcttctccttcatcaactcttgctgtttagcaaaacaagctagatgtttaagtctagctagattcaacaatggaacaggaaacaggaagactccacagaggcggaaatggattcaaatcccagttctctcagctaagaactttggagtctcaggtttaaccattctgagtatatttatttgtttgtaagtggaaatagtggtagtacctcatagggttttgagagaattaacttgaattgaatgaagtactcgggaaggcatgcatcattatagtaagttcctaataatggtgtctaccactatttttaggataagtactattgacagtaatagcaaatcagacagattaattatttatatcataatctgttaaattgtatcctcacatgtaaatgatgtaaatgacttgtacccaaaatatctgacttatatctcagaaatttttacaaacaagtcctagctcctaagatatgaggttattttacttttcaagtgattaaattgaggccacgacttgggaaacatgatatataattatttccttaacttagaaatcagtcttcctatgagaggtcatagttcccagtgggtgcacaagaaaagggtcaagttggaaccagacatcaccctgtcccaagtgcaacgtgagatcagcaggagcttgattattgatttttgtttccttcttctcttgggtttgctttcttttaggagccagtggaccttaattcacacagcttaggaggtaaagccagctctgctttacttacccaatgatcttttcctggagatcatgttccttttgtccttttgtcttgaattgaaatcacttgggggttataaattttatctttttaaccagatagcaaatgccttaaggatagagcagcatttttgatatctttgttttttttcccccaaactacttcctgtagaaacttgaacataataaatcctctaatagttttttaatgtagctcaaagagctctgagaaatagtgaaattcaacagcaaatacattcagccaacattttgtaatagatgtggcataatgcatttaaattatgaaacgggccttaattcttgtctcttaatgccaaggttttaaatttctatctttgaatgaattctttaatcataaatattgtccattctttcatccaggtggtatcatcagagctaatacagagtgaattcattaatgttaaaactaactttactccctaattatgagaaagtaagtgtgcatacattacaaaaaaagagaagtggttaaatattaaaatgcttgttcttgaggctgttgtgaggcttaaaaaacttgaaaaaattttcagggatcacacagtagtaaaaattactatagcagattctatgtttcattgttctgccatccctggttctgtgatgcttctttttttatatatattttttattattattgtttctattgttattattttggttcaacccataaatacattcatcctgctcagttttcacaaactgaactcatctcttactggtaaagaaggaagaaatgcctttctttggggaagaaactactggcaacttctcctaagacttgagggcagaatgagatatctatgacagattttcctttttttcctgtttcttgcatttgctttctgacaaaatagagaagaaaaaaaatttctttctgaagaaactgccacactctgttgtttttgattttccacatgaacgcattccatttaagcacaggagtgtctcaaaaggctggcttctcgttgagcaagtatattaatactttttcttctacaacttgtagcctgatcaacagcaattatttcagtagccataatacgccaccattctgaaaacaaataaatcaaatgctttttaaagtcaagggtaaggctaaatacagaacaaacaaaaggaagtacttattgcgtgtattaccttccagtggaagtgggtataaactacaaagatgggcataaaagggtaacaataatggagacaccatgtcaagccttgaatggactgtattcttgactatactgatcagcctttgccctttagactgacatcaaaaactctgccctccctctcagagccctcaaactgccccaggctgctggaatctgtgtgacagcctggcaaggttaacgttaagaaacacacaaaaggcagaaaacaaatagtgctgctgccgtcttattggttggcatactcctgggatgatctataatcatttcttcagcttagaaatcagcctcatggtctttggggtagtattaaagctcctgagccctgtgggttttgtcccttctattgtttatatgcgttcattcattttgccattaatcttaataaggatataagatttactttctttgttgttgcctttaaattttgaagaaaataaagcagaacaatgaaaagagaactctagctcgtaagatttatttgcaggtcagctgtgttaaaattctttccgctcgacatgtaagaagcttaaaaaagtaaattactgtcctttttaaaaaatgctctaaagcattagtgtaaaaaggacgttaggagagaatcattatcatctctgtgtgtttacaaagaacacacatgaatatatgcacacacagtcagaaaagtagttctttaagaattccatgccacgaaagatttaattaaccttttcactaggaaaccggttctgggcactgccttcattatcccctttctgtttccaccctaagaatctcacactctgttcctttcctctgtttttctcgccccatcctttttgcccattctttcatcggtgactctattgttaaatttaccagctggtgatagattcacatactcctcttcatttccgatagtaacctcctcacttccacacttcaacttttgctgttacctgcttgattgcattctctttaccttcaaaaattttaattgaaaaaagctatattgacctaggagtgtaagtaaagtcagttgaaatggttggtagtctacgagctttgaaatattatttttccacagggtataacaatttctcttatataaatgttatttatggtaatagaagcaaaggaacttcactataaataataacatttagtaagtggtgatatgaaggaatgcattattataattaccatcataattttcctgttattatttttaaaattttagatattaaaaaagacttaggaacacaggaagtatgctccccaccaagcactaggaggccattgaaatcacatacagatcagctttacattttttgatagtgtgttcattctaaagctaacttttagaaattattttgttgttgatgatgatgatttatagctgttttccccgtttcattttatcctatctattgttaacagaaaataagggtgtatattcatatagcccccatctttgtaatgcctggacatgttggttgctaggtaacaggacactatgaggtaagcaggcccatactgtttatctctgattgagcagaaatgcagaaccctccgcaggagaaaagtcctctgaatttccttgcatttttgctgaaccaaacagaattattattgcatgacaaagtaccacttagccttatgaaacttcctggcagtttcagtttaatcattgctgtaaagaatctataagtctttcttggttattaccacaaaattgtgtagcaggtttacttccctaaatcaaaactttgttgtccaggattctgttcccttttaatctttctaggttattaaaatttatcacagcagttacctaaacagaggtgttagtgtctgatgtcctgtattctaatagactttttaaaaaatcatatattttgtataaacaatgctgtaactagaataaaaggtcaaataatcagataaaattgtacggaattccaccactggaaagaaaaaaaactactcttcaaatttcttgacttttaattaaaatacatgtattatgtggaagtattaggcatcacatcaggcttagagaggcgtagattcattcataaaacattttctgggtgcccattgggttcttgggactgagcagtgatgttacagaaagcaagacagcatcctggccttacctgtgaggaaaaagctataaacagacaattacattatggcaaacttttaagcagagcatagcgagagtgtttgggagcacagaggaggaagcaaccaactagacctgggggaatcaagaggctttgagatgctatatcttgaactccccaggagttcaactttccaggagaagaaggccagtgatgtttgctggctctgccagctaaccttccttgtccatcatgcaaagcactgttctgcagggaagccctcctggatgtcttatcccaaatggaattcctttgtcgtatgttctctcggttccttgctctcttccatcagaggtcttatctcagtgtttaattatatattaaacagtgttatttaataccttaattgagattaatatcttctccaccattatacccagctccatcaaggaagagaggtagcaggtgttactcacattatccccatggaacaacacagtgaattgcacatagtgcaaacccagtaaatgttgaatgaatgagtgagtagacttgcaaatcatgtcatttaggtggctgccttccctgccttcataataggatggccaagtttatattccctgtcttagatgttgttaaaggaaaaaatctcttcttacactgcccttccccatctaaatttaccatataaattatatagctgttgccttttgcctaacatagataacatgatacagaacacttttagatgaatgattttgttggttaaaacgcagaagaaaaatactggttagtttttacatgggtccaactataatgcctgaaaactatagtgcctgaaattccttctgaaactgttagtaaattactattggtggtggggtcggcatttattaagtgcttactctatatcagactttatgttatcccttcaatttatactatcacattttaattctaccacaacatgactttgatatgctgttagtcccattttacagagaagaatgcagaagtctagacaagtcaaatggtatttcctgagttctcagttagtgggcggcagaactggatgtctattccaggtcagtctctcctccaaagccatttttttctcactgtacccactcccttatcctccgtccattgctctgaatccttaggacacatttatctacatatcaactatttttggaatccaaatttgccagttaatttccatgctatcagggagatgatgtgtcagttgcaaacacacaccaaaaatttaagaatactcattaatttgattgacaagagtgaaatttcttattctaaatagggataacattaggcaaaattgttcaaaagtagtggaaatattgtttttattgattaattggttggtttggggagaaattatcctttgtttactctgaagtagggagcatttctgattagttccttttgtcaacgtatattaaatatcaaaggagctgctgctaattctgacttggttttggaactgccacagatggacccactggtaggagaggggcttactgctagttcactagtagagaatgtagtactggattgaattagaatcaagtcttcttttcagtctgcttgttcactaacacgagcgcagacaatgtgaggagaccctctgtgccattcgtaacagaaagcagggagaagtgccacttttgtgtagcttccaacatgaagattgacttttacagtttctaaatagagttcttcccttctaaaaaaaatgctgcaattataataacttaaatattacaagcccaattttatctcacctaaatctagagggttaataaatgttttcaatgtggtttattctagaagctttgagaatctggtcacataatttgcactaaaagcatttagctttgtgaaagccacaccaaacttgccattattaactacataaatagagagggcaatttgctaatggggttccatttatggcagtttatggattgcctaactttgcccaattaactcaggcacttccaaatatgaaccggtcaatgtaaaacactgaatggttttaattcaatagaaaaacacattacctatttggatgtaaagaaacaggaaccttacatcccagtgcctttactctacagaccaggtactactgatacaaagtgggcagagcaacaacgagaaaaatatcctgctgggataaaacatgcactctagtgggagaaacaagcaatacttagagaaggatttggaggaaaatgcattccaggcttaggaacaatgggaaggaaggaaacctgtcacattccaggaacgtgaagaagaatagtgggcctggagaaccaagagccaccaaatgcttgtgagatgaggctggagaggcgggcaggaactagatcatgcagagcattacagggaagtcatacattccttatttcactaaacgccaagcatctgctatgaggtgctattctgggataaagaagtgaacaaagccagtgatgtcctaggaaggcagataattaacacgaagcagacaaatataaaatatgtcaggtagtgataaatgtagtgaagaaaacaaaacagacagagtgaggtggataatgactgggggaagggttactagtttatagagagtagttggtaggataaggtggtgtgtacatcaaaatctaagggaagtgggcctcgtttaagggttttagcctttcttcctaagagcaagtgctaagtcattgaaggattttaagtgttgaggtgacattatcagaataccatctgactggatcattcaggctataggatacaaaagagactaagaaagagtagaaacaggaaaccattgagggtattactgcagttttctagagggagatgtggtggctcagaccacataggatacgtggctcagtgtgaatggatttcatcactgaaactggttcttatttccatgtggttctaagtgccatttttgaaaaaaattctgaactaggagtaatgaggaatgattgcaagtctttgtctgtttgacctcaagccacttttctgctttatgccttctctatgaaagtaggtagtggttccaggtttttctacttcttaaggcttttgaaaaaacagatatgtaggaaagacttgaaatatgtaaaactgctacatcatataaggagtgggcagttggtattctataataggtaggatgaacactactaatcctgtttaccaggctagagaacatggagctctttattcttctaaatttctagagcaaacacagggacaatacgaaggaacccacaattcagattatttatttttcactttagatagtatgtgaatgtgatttaatattaattgacatattgattgaactcaactgacaaaaagtctatattttaacaatatctaaaccatggcctattaccaaatgctaagtttaggtacagaactaagtgtccagatccattcccaggtctcaggttctgaatctcttcataacccctccaagagctcccttttgaactctcagagaagcttcactgatggaaaggggagaaaagtgaatctccaggctccttccaatttgcaatcccagtaccttcctttgcataacccatagtttggaacatctccctatgctcagtcaagaaagaaaaaaagtcttatgtcttatgtacatgtacagtgggtaaaaaccacgtatgtactgttggtaaaagcacacagctccaggtgaagaaacaaccaatggaatcctcgtatgcaaatcatatggatgcatttgaataaaattgaaccattatcttaggaacctctagtttccaagttgatatgaaacatatataatccttgtctgtaccatattattttgcttctaacaggagttataccatccatgtgtttatttccatgacgcttaaaaacgataagccaaaacagttcatttttctttgttttgtccataggtgttcttccaattacctctgcccatttattaaaatatacattttggacatgtgggtttattcactttgtggtgaggttatattctgtggatatctgacctttgttaatcattgtgtggccaaatgaaatcaaacacatgcattgaagcagtgaataagtcgtggggttagcgagtttgatggaatcacaaccagcaatttaaaaatgtgactgaatttttcccacaattaaaatctttcattatgctacttcaaagctaatttctttcttgtttttttttttctgaatagttgcttccattaatctcactctaggtaatgatggtaatgatacaattatatgtaatcattgcctgaattcaatatgcaacacatcagtccctttgtgtggtgatcgtacactctctgcagtcctgggatttggaaagtttccatcatgttatgccaagatcagattcaaaagtctctgacattttgcataacatcagtcagtcgtgtgttccaactgtcccttttagtgattgggcaaactcatccatctgactgctgctggtggaagctagggatgaaggcatgaagcaagataagctggactggccttttacatagtttccaaaacacttaaaatattcagaaaaaaaaattaggagcaagaatttgtaaaggatcttcaagtgtacaggtggctaatccgcttaaactactaatgacacaaatcatagtctaagtgaacttatgtttttatgcaaagttaatatttattttaaaagtttaaatctgtttttctaatatttatagctaatcttaccagtggttatcattcaggatgaatctgtttctcaaaatcctgataggtagatgtgtgcttccaattcctattttttttaccactatgcagatgccattttgattcttatgttccaaagacagattttgttccacacacttacttattcaaattagttcaattaaggaataatattgtctgtatgttccaacacaatagaattgaacatgttcatgtcttctaagaattaaataataaactatgcaggtagcattaagatagtagcttatcttatgcttaaatttttttctttgcctttcccattttgtttccttcttagaatacattggagggctttcttggtctctggtaaatatttacaattcataattttactctggcctgttaatttgatttattgatcatttctctttaaaggacaatgtcaacacaagagtgaggcatgggttgcagtgggtggaatgacagtcatattgagccctgctatgttttggatatggtttgtccccatcaaaactcatgttgaaattttgattcccagttatgacaatgttggaaggtggggcctagtgggaggtgtttgggggtggtacctcatggaatgagtaatgccctctctcaggagtgagtaacttctcgttgtggcaggaatggatgaggtcctgagacagcaggttgttaaaaagagtctgactttgtcagtttctctctcttgcttcctctctggccatgggaaatagcataatagtgtttgttttctccactctcccatctccctctcttcctttctctgttgtccacttcttaaatatatactgttcaagtactattatattttcaaatcacgatctgataaggtggaagggattcaaggtaaattagaaaagctccctgtattcacattcacagagccccttctactcctgggaagagataagatatgcacttggtcactactaaaaagtaggaagcactgtattatattagaaagattcttatatgggagtaaacaaaatccaagccttctcctcaagggctaactggatgttcctgtatcaacatcaatattgaagacaattctgcttcaatgtaaaggggtacaggacagtctactgtgacctacactcagagggtctttgatgtccacactgtcaatgttatacaaccgagctattcctcaaatcttaggaattctacttctgaggcttcctctggcactctctttcacttccttcagaatatgatggcagtgcatgctgatctcctcatttccatccttcttgatggtcagggcacacttaacacttactcctgttaggttattcagccaactggccacatatcattgtggctacacgtaatagggcattttcacatagctcaccagaatcccttttaggccagcctacctctgttccaacagaactctacatgactggctaagcccttatagcatatcaagtctgagcttcgaaaggattttcctagtttgggggcactgctcaatttccctttgtttaccaaagaaacacaacagtatctggcagtatttgattagtccacctgtggtttttggaattgaggtaatgttacccctactttgtcagcccacacttcccaaaacagtgtccaaaacccagaaacaccaaattaagatcccatcaccatccataagattcagaaccccattagatccacaaattattatggacaatttctatttcttgtgaactgtgcaaaagtttcttgaggagcacaaatcaattgagcatgatccatgagctcctttgcatatcaccctaagaatgccatgagcttacatggggtggatttaagagggttggagataaatcaactagtatccagggctgaggtcttaacaggaatcctcctcactgagagcttgccttgatcatatttctgccaatccctcagtccttctctacaatttccccttgacagcatgaaaacatgggctgatctgtgtattctgacttgatgtcattcttgtcacacccagaacacagatcatcttttcccactcccatattcttccaggatccttttccatggtagttctactccttaggttgatcatcatcttctttcactcttcccaactacagagtgtaattaatctagccacttactgggacccacatctcctgaccctcccccataacctttactctttaaatgaatatactgctcaaacctattccaaaaattgagtgtagcaaagacttcaatttagtctgatttgcccaaacaatatggatacatcttgaatcactcttttggaacattagctaaatattttttaaaggctaggctagtcgttagctaactttttctttttccttttttttttttttttttgagagtaagtcttgctcttgtcccccaggctggagtgtgatggtgtggtctcagctcactgcaacctccacttcccaggttcaagcaattctcctgcctcagcctcctgagtagctggtattacaggcacctgccaccatgcccagctaatttttgtatttttagtaaagacaaggtttcaccatgttggccaggccggtctcaatctcctgacctcaggtgatccgcccaccttggcctcccaaagtgctcccaaagtgtagctaactatttttaaagtgtgtagatacttttgcaaataaatgtagttaacgtatatacatacaatttaaaaatgtatactcagactatttctcaatattgtgggctgttagcaagcagaattattttaaaaagcaagttttaaaactcaaagccaaatattgttactaaaatgtttcatgggaattggcagtggtacctagagttttaatgcctttacaaaccaagagtgtataggtattgtggatggaacatgtgactgttcaagggaaacctgacaaaccatactaacaatggattattgcactcaaagaaagatgggaaacaaaagaatccagagaacagtgcttttgttttcacgacccttcagttgtctttgactgttctttcttttggcttttctgctttgtaagagtctttgattcaaggctgtttcatgatccactgaactataaggaaaccatgggtctaaattgcccactatttcctttagtgcactgttagatgtagtcagtcctgggaacttgtttaataaaggagttttgaaaatgttcagggatcttcttttttttttttttggtatattgtataattaacaatgacttttgccttgaggtcaacatacttccaatttttcctaaataaatatttactgaaaagtgtagatgtgctgtaggcacagctagtgtgaactaagctctgagctaaatgacttaggcacatcattgtaattttcccagtaactctgaaaagccaatagcaatattttaattttatagacaagaatatggaagcttggagtgattgcagtttgtcatatgtttatgttagaatttgacttacccaggtatgtgtgactctaaatccaaattatttttaagaccttaggctctttcaggtcttttatctaaaaatgctacaaaaagaaggaaatggggagatgtagataaagatttaaagtagcagatatgtaggataagcaagtctaggcatctgatgcacaacatgaggactataggtaataacagtgccctatatatgagattaatgctaaatgagtaggttttagctgcccttgtcactaaaataaacaaaaaaagggtaactgtatgaaatgatggagatcttcatttgcttcactatagtaatatttttactatttttatgtattttataccatcacatgttataccttaagtatatacaattaaaagttatttaaaatataaaaataaaacataaagaatgctgcaaataacagtagctcttttttgtagttataaaaagatatggatatttaacattcccattgctaagcttccacactaagcaacagtaacttattaatattacccagtaaatcctaagtacagaaaagattaaggcattgtgcatttatttttattaaaataatttatgtaagttttaattcaaattaggctcagctttaggcacctagaatattaattcagaaagtagccttattagattagcttcaaatgcacagaattttggtcaaggacattgaagtaaacattttatctttattagccatcaattggcaagcatttattgagtaccttctaagcactggggaggagcttggacctgaaagaaatttccatctgttggagccatatgactaaatcacacgaaacaacttgagaaagaagcaagaaagttcataattaagtgctaatttgctgtagaaattcagggaagcagtaggttattgaaagcatcaggattcaagaaaaatgtcatggaagacatttcattttaggtagccttcaaaagatatggggcagctttgggtaattggagaagcatgaaaaattcataagaaataatgagtagaaagacttgtgttgggaagtaatgaatgaggttggataaattgacgcatcaggttccagagaatacttataataagttgtctgttttcctgcatagactgtcagctgagtaaggctagggaccctatgcttcttcctcatctgtgtcttcaagcgcagtgcctagcatggtataggagcttaataaatacagggtagctcctcagtatataaaggcagatgaatctggatttgatgtagtaggaaatagaaaatgcaaattagaaaatatagaaataaatagctatctgatttcagtgagcatagttgttaatattactggtctcatgttgctgaaaagactcttaatttggggtaaaatttccttcaatcacttatgtatgcataataatggaggtgaggagataatgggccatgattggatagtagaaaagttactttctcttagctgcagactcacataaatgctagtgatttgtttgcatttgcactcctgagcacacttcaacagaagtgaagtcgaatctattttgactagaagaagaacaaaagccctgagtggaaagtgtattaaagataaatgtgacatattcattcagtcagtcagctgaagttgagaagaagatccacaagctcagtcaagccttcaaatgactgtagcccagactgacagcttgacagcagcctcaggagagaccatgagggagaagtactgggctaagctgtatttagatccctggccttcatagactgtgagctaacacacgtttgccgctttaagtcagtcaacacatctgactggaaggcactgagtgctcaacactgtggggatatagagaaaagccttggcttctgcccttaaggaactcagctgggtgcagaaaaagacacatatgtacaaacacatactgtaagaggcaaccggaagaggattgagggcagtagaggcttcacagcagaggtgacatttgagttaggttttgaaagatgagcatgctttgcacaggtaaagaggtttgggtatcctgcattaactgttctactttgttgaggatattgacaaaattacagaaatgaaatagttgaaaaataaggctaatagtaattacaacaacaataataaaatacatttacttcatggttttaacagtatttccatatacattaattcatttgatccacacaagaaccaaaggagattggctgagcagttattgttgtacccattttgtcagtagggaatctaaggttcagagagaccaagtggcgtgtccaaaataatgattctgctttatggaaacaaatacaaagtataaatcaatgtataaaatgaaatgaccttaataaaaaccatgctagaagaggtcagaaggaagtgaaatcaattctgtagaaattttgaataaaaactgcatatggtgtgagtgatgcatttgtcacaaaggctgggtgttttgtctcaaggggcttctcgggtaggtgaatttactggtgtcagaagtcaggtgctcagctttgtaagctctcaaacctgacttagtcagcatatacgaaggtctgcctctccagggaatagtcatattattaatagcaaagtgcatagacggatttattaatttgcaatgagaaatgtcactgccatgtaccccagaatattctgttggcacagctagtacactcattccctgtaggcagatatttgagggaagctctattgtagtgaaagagaaagctgttgttgcccatagactcatacctgagagttggctagatacatttaagaggtgtttcttggcttagaggtgggatggggagattcaagcactttttcctgtgtttagagatcaccctgcaggaacatcagtgccctggccaaggctcacttgtcccccaacataagtttgcttctatgaccctctgtattagtttcctagggtagcaaaataccaaaaactaggtgacttgaaacagcaggaatttattctctcacagttctggaaggtagaaatttgagatcaaggtgtcagtagggccacactccttctggaggctttagagaagaatcctgttttgtctcctccagattctggtgattttggcagtctttgtcattccttggcttgtagctacatcactccaatctctggcttaatctcaggggggcttcttccctctgtgtgtgtcctctcttctttcaaggacaccagtcattgggttcagtgcccactgtaatccaggatgacctagttttaacttaattacatttgcaaagactctgtctccaaataagtttatattcacaggtactgaagattagaatgtagaaacaccattgtacggggcacagtttaactcaccacatgctttcttcccatgcttccattattgatcaacctcactcccaccctatcctgggtagacccattctgcactcaaatgttaatttgacctgaaaacctctttgcttataactgacctggctttttatatcaatgacttcagggaaaaagagagtaacagaagttagaacagtattcccctaaataacttggtttttatttatttttgtttccaaatgccaaatctttcctctatttctaaacctacagatggaaaatctctgcaatcactactctattaagaatccactgttagtgatgtgagcttgtggggattgataatagtttgagaagcaacctcagggttgggaggagggaaacttaggaggtgggctttggccctccctcaacccacccaaactaaaaacagtaatgatattctttgacagggtaatgctgttttatttttcaatcttctgtcaaatggaaacaaaaggatctttgccaagtattttactttttatgtacaatacaaattgctacaaatcaaactttaagggaagcttcccagcactcccttctcaccagattagtacctcctaaacctctgccctatagacattctgccaccttctgttgtttaatcactgcattctgaactgatttgtagtctctctctgtattttattttattttattttgatacagtctcactctgttgctcaggttggagtgcagtgatgcagtctctgctcactgcaatctctgtctcctgggttcaagtgattcttagcttcccaagtagctgggattacaggtgtgcaccaccatgcccagttaattttttgtattttagtagagagagggtttcactatattgaccacgctggtcttgaactcctggcctcaagtgatcctcctgccttggtctcccaaagaattgggattagcagcgtgagccaccacacctggccagcttctcttttagaggctgtttttatttacaacatttctaaattcatggtgggagggtacctatagttataccatttattaaagtgagaaaatattcatgtgaggaaatcagatattaccaagtataaaacaatacaattataaaaaatgagaggcaagacataataagcatggctgaagaaaaagtacagtcattagaaagaaatgtaccctttaagaacagtcctctgatatagaagccaggagagtttgccactcctataggctgtgaccttgttcacgtgactttccctctctcctcaacctgcttttctctaaaaggaggtattgataagttaatggctggtgtgtggggagtcagatttcttaacgttagggaagttacagataactacaaggcaaatcaaaagaaccctggggtattggatttgagtcagagacattagtgtgagcttttatcagtttaatatatattcagaaataattgtgcatgtgtgtacacatgggcagttatacatatatagatttgtatgtgtatatatatttaatacatacacattatatattaagtgtatatattacaatatctaaatattatatgctataaaaatataaaaatataggtagaatatataactatatattgtatataaatatatatcatatataatatatattttatataatatttacatataaaatatatgggatatatatctttatatctatgtgtctgtatatataatataatataatataacataatacaatacaatataacatatatcccagcttttccattgagagagactagaagcagtgatgttccagtagcaacaagtatatccaatgcctcaattttggtttttaaataccattctctagtaaaagggatattggctccttggagaaataactgactctaaaactgggttagagaaagtatgagatgagccaagagcatcctgtagtcccagagagccagggactgctcaaaacaaaaaaatgccaaaggtaccctggagacaatatgaaagagctcccaattgtcagagctgaaacaaatctgagcaacaaaataggatgggattggattacaattcacaatataaaataaatatacatgagtacgtgctgatataaacaattgaataaatgaacaaatggggaagaagtcataaatctttcttatagatatattccaaataatataagtgtgggcaggacttagtgactcatatgcaaacaatagagcatggaaaggggataaaacagtaacagaacaccccagaagccactggcttgatcagtgatcaaggttaacatcactagtaacaagtcatgttaatagcatgtcccccagtatgatatgatgaggagaacacttcacttctatggagttcttcccaaaaacctgtatctcctgcctgatatgagaaaaaggtgaacaaatccacactaagggacattttgcaaaacgcctggccagtactccccaaactgtcaaggtggtgaaaaagcaagactgagaaaccatcacagtccagtggagactaaaaagatatgatgatgggatgcaatgtgtgattcctgattagatcctgaggaaacaataggacattagtgtaaaaaactggtgtaaaaaaatgttgaaatccaataaaaatctgaatttcagttagtagtaaaaaaataataataaaggaaggtgttggtccaaatggctcagtcccttccggtataggattccacactgttctataacccagcagggtctcaaaggaagtgttgtacgcaaggacccagtgttattctttctaatttattttatatttttaaaatgcttctttttacatatacttctttttacattcttaaaaatatagggagttgcagcaggctttgctgcagataaagggaccatggacaccctgccaccagttacagcaagaagaagagagggtagagctgagtaagagatgggactggactgtggctctcaggagaatcacattctagtcctgcctgcctaatggcatatgaccttgggcaagtcacatttctatgcccaaatttatctgtaaagtaaagaattaggttagtaattatctaagtttctaattgtaacactgtataattctactggttctctgtatgtacaagtggtagaagtcttaagaatagaagatacaatttctagagcagataaaggatgctcttttgtacaccacagtgacaccttctgggggaatcaagggttgcctccctgggttgggtagcctggaaaatcagattttatgtgggaggaaaccatttagactcaattttgacatcagctgtaaagttgggtaaagcaggttgaaaggaatgaatttcgtaggtctcttttcttgcctctcattctctcctgcattatctagcatcattctgacactgacaaaaattaactgtggcatcctaagcaacttacttaacctccatgggcctcaatttcttcagttataaaatggagattaaaaataattactttgtattactttatgagaataattgaacacatacaattccaagactgcaatctgttatgtaatcctttatttgagtgttaggacttttccagcctcctgaaactcttcaattattaatgacagtagtcccttcatgttggatgatagagagggttgaagagcagaatcttggctgctcatgtctttgaaaaaccctgaattgtgtcaacaggatagatttactttttcctaatatgagaacttaaaggaattttggacatagttatagttgtttgctgaacatgatttatgtttatgttcataaatcagcaacattcaagtcactgggagtttttttccagctgccactgggggtaccaaagtgggagcaggaaaacacagttgtggctatggctggcattcaatggtagccctagtggaagatggataactggggagtattttgaacgtgggtagatttgtgttaaatggattttcaagaaaggttcttctccagccagggcttctaccttagcacatggtcttagtttattgtaaactatattttcaattataaactgcccagcctttccctctgtacatctgccctcctttttgtggccatgagaaaggaggaatctgttgcaaggcaccactgggacccaggtgtctggcagaacaactggtcccaggaaggctgtggctcctttacacatttaaaatctataaggtacttttaaaccccatactcaaagtttttattctgagcattgaatgaatgtattgttagcagcttaaagttaattttggaagaaaacttcaaacaaacaagaaatgaaaaaagctatttcataagtgcatacactaaagcatattgacacatataacttaaaacaattttcagaatttaatgaatatggtctttaagatgtgaaacatccttaaagttatatacatatgtctaataaaggaccagaaagtggaatcatatgtgaccttgaagcctttctgttccctgttatctgaacaaagcaagtgcctggagagttccttaataaatatgaactttccctcttccttcatttctccatttcaaccaaaaactgtgctatcagagctcaagctcaacaggacatctggagaagagtgatagagccaaatggagtctatgatcaccccaaattcttagagaaaggagaaacagaaagaccgatcagtcttgtgccatcttcataaaaaacaactgcagtttttgtgttctgaagttgttcacatgattagattcagccttctacaaacacttactgagcaccaggtgcctggtatgccattaggaaatgagtctatatctctcttgagaggagatgcagataagcaactagggctaaactggagctcacaaatgttctaagagggtgaagtaggaagaattaattgcagtggaaataattagcccaaaattcatgaatgacgggatatttgacctggatcttgaaacaaaagtagtattttgggagataagatcaggtacaatgacaacatcaagttatgagagcctggaatcgaaggctacaatatagtcaggtgaatgtcttgggactggatggatccacagttgtcaacacatgggctccttgcatcagaaataaaagttaataaaagttagattccataatttttaattctgtaaatgtgggatgggaccaagtatctgctgcacagtcagatttgggaggtaccccacagggataggagatatttaccgaaagtaacattaaaaaggcactttgtacttttacaagctgagggatcttggtagtccaaggagtatggattgtatcctgtagataaaacagagatttttctttacttgattgcatagtattttttggtaaagttggaatatttccacttagaaatatttaaagtattcttttaagatcctcctcatcaagaacatttaaaaatgccagtttgtgaacttaaggatgaaaacttctgactaaaaggcaacaaatacaaagacacacacacatacacacacatgcaatgtggaagtttactgttatccacaatagttataagactcttccagtactaatggatttccatctgacgatgatgtgttcatggcagcgatatgggatgggttatctaccttaggattgaaggaccctagaggtctcttatctctgtcactgatatggagatcaattcttcctgtgcctcagttttctcctatgtgagaacatcataataatgcctagtgagtatcaaatgacccagaaaatagtcattaaaaagtataaaaagaacttaaaaatctaaaaatggaatatgtaaaacccaatagtacatacagaggcatatccagacaagtgtttcagggaatgctttctgactttatagttttaggaaaataatcacatttttaattcgtttgcaaatatgtatagacatagatataagtgcattgttaagtagagaaattgtaaatgccatacttctaaacataaaagtgaatatgtaatgtaatcattgatccaagagattccattgtagaacagctgtttaagccttctggaagacgtttttggaaatatgattgagaatctattttggatttaacagacatcttcttatatttttctatatttttcttcattatcattaaagggtatcatctgctcttggttttgtgttttaatttgaattcacactcttacaataaggtcacctatcttactcagctctgtgaaactgaatctaattttagaataaatgaagaaatcaaggtgtaggtaacactcataaagtttaagaaggcctgtgttgaattgggtatcttcttgggctacttggataaatgattccttttatttaatgaaatcttttaagaagtaataaaaaattcaaaattaatggctaggatcagctgagaggtaggaagtattcctccacaacatcaagccatggatgacttttgaataatctgaaatactctcagtgtttgaaaagacctgccatttttacttgaacttcttgaaaatgttgagcttcttagaaattgtttggtatgattctctttgcttctttaactttggaaagaatattaatttatttctgccttgttgaagaatgtatctgcttcagagctgacctgattacccagttgctttcagggaaggagaagagaggagatttctctctcttctattttccttttctcatttattgagatgattgtctacagagttggtcctttttctaccccactggcaattcttgctccccattgttctaccatgttccccactgttcctgaaaatacagaatatcaactctgttaaagatgagagtcttttttttttgagatggagtctcactctgtcactcaggctggagtgcaatggcacaatcacaacctctgctcactgcaacctccacctcccgggttcaagcaattctcctgcctcagcctcccgagtagctgggattacaggctcccgccaccacgcctggctattttttttttttttttttgtagttttagttgagatgcggtttcactatgttggccaggctagtctcaaactcctgacctcgtgatccacccaccttggcctcccaaagtgctgggattacaggtgtgggccaccatgcctggccaagatgagagtcttaaaaaggaaccttttcatggcataggaaaggtagtggcctaactatctatagcatgggaccaagtcatgtggtgtttgttatatgtgcttagataagtgaataaacaaatgtgcttgggtaaataagtgaataactgaatgaacatgtgtgctctttcccaaggtttggctttaaagggaaaataaattcacagaattacaacaaggtatgagcaaaatcttccacaaatatataggatcagaaagtaacagttccaaagcttggaagggatgacagggtgcaagatttacaggctaactttatgaccgggagcctcagagctgttagagcacaggtgggctgggaccatccccctgagaccctgctcctcaaccaacttgtgtggccctctggctaggggtggtctcatgctaggagctcatgtgggtttgtcctgtaattttctctgaaacagcagaggaatactatatctgaattatcccctatcccccccaaggtttgactgtgatggcagcaataaaagtcagatggtgtcatcataattacataaatgacattagcaggaagaatgttaaaatcattactcatcttcaagtatttttgaccattcatgaatatgttaatcagaatatgaccagttcaagggaaatgacaaatcaaagccttcttgttgataaattccccaaaccctttgatcagacccaatgtccatggcatggataattgcatttggtggtaagaaaggtaggctttctgaggtttaaggcagcagaaaagttcatacctttttaacttttgttactttgtatcatagttctattaaggcagttaggatattactttttttttctctgaattggatgtcagcagacatgaactctagtcccatatccccaattcttttgttttccttggcaacaattttattaaaatataattcacttactgtagaattcacccatttaacatgtacaatggtctttagtatattcacagagttgtgttcattctgaccattaaagtgtaggtatcgctgcagataaatctgtgaatgagtttcctcatgtgtaaattaagagtagagcaatgtattcttcactcttcctttcagtgatctgtttatgcaaaaaaaaaaaaacactcattaaatacagtgaatgtttataagttaccattttggaaaatctctgctctctcgtttgcgctctctcgctctcttgccccacacacacacacatgcacacgcacacacacatgcacacgcacacacacgcacatacacacatgcacatgtgcacacacatgcacactcacatgcacactcacacacgcacatccacactcttgtgcacacatgcacacacatgcacatccacacacacatgcacacatgcacactcacggaatgcacacccatgcacactcactcacatgcacacacacacatgcacacacatgcacactcatgcacatgcacacacacacgcacatgcacacacacacagaatattcttccctccatgatgtccaacttaatttttccctgtcatgctacatccaggtagtctcaccttcactttctacctaaaattgccccccacaggctccttttcatgaatgcctgctatattctttctatcatgaacaaagattatcttatgaatatgggctaatatagttttatagacatattttgtccctgagcaagaatataagcttgcttctttcaattgccacttgtactcaataggtatttgttgaatctcttacatgagattactgagaaatatatttgctgtcttaaaatgaagacaagttcttactttgccaactgacagagtcggcttataaatgatcaatattttcacaatgaaagcactttaggaatcaccaggacagagagtaattgttaagatagtagctgtgtaccttaaagtaaaggtattattgcccagtagcacgtgatattggttgactagcattgcaagtacaaaatttcctattgctctccaatgggagttaataattaaacctgtacaaagctctttataacaaacatattgtcatggtaaattccattggccatggtggattatatctgtgatagcctccgatcagtgactaacattgtttgggaaattttctggttaagcaacatatggtgacttctgataaggacttatctaatatcatagatggcagaaatccatttttcaatacaatcaggtacatgtatattgtattaaaaaatctttccaagtgtttttaccttgactttgctaatatagttagaaatttcttttttcttttttattgaacaaggaatagtgcttcttattgatatcctagctacagtagcctaacctgaacgatagcaataacttcttggaacatgtttgtgttatcattaactgatctaaaaggccatagcttggggcttcttttcctgtaagctcaatgggacaactatcagtacacagaaatacagacaagctgtgggagtttccttccttcctacccatagacagtataataaaaatgtaaatactgtagtaaactatgataagacgaaatgcaataacaaacatatttttcctcttcacaccaggtttcatgttttctctaagaaaggatgagatgaggctgatcctcataaatatttctgaggcttatgtctttttagacctatcgatttgtatacgtgaaacagtgcccatatgaatggttgctgttcatgcttctattccttatctaccatgaggcacagaattcttgtttaatctttattatgttggactttgtcacctcttcctatcctctaccttctcagcccaatgcatcgttcttctttgatgttctcactgtgctattgtacaccctctccaagactaaagcaattccatcttgaatgttaatccaccatgttggcttctgataaaccccagttacaggaaggcctctaagatttctagttattattgctccttgtgtaacagcacacacttagcataaatcctgtccttaggtaaaaaacaaccttgatgttaccatactttaattgtcctatgcatctcttgtgaatcacatacacccattctgtatggtatataagccctggggggtaatggcacagggatccaccatcttgtcttgctgcctttcaagacacagacatggcttgttttcatgatatacaactatgaaatgtttcatacaaatatgaaatgtttctttctgcgaaactggattcttcagcctcttttctttggcctccctgcttcctcagactttgaaggtaggtttgcataaacctatccacagcataacaccctccaaccctacttgttatagttgtccaccaacctccttgtccctctctcaaatccactgagcatttataatacagcccatgctcatcatatcactttgcctcttacctcctttgaaagccaccccaaaactagaatcatgaccaggttccttgaagtttacaagtccaataacatctttaatacacccctgagtatggttcttatacaacccagttttctcttggtcagtcctatttatgcctttttcttgacatgatcagtaacagcacgctttttcatttgcaaatgtgtaatgttatcatatttctgcttgttgaccttatcgctccaagaaagtactggactcccttcattatttcaaaacttaagtataattttctttccatctagtacagaactgttaggacccccttaggtctccgtcttactcccatcttaaaaattctagctcccttggccttgtggggaattcacattgcaaattgtcatccttcattcaaaccaattacctactttctaaggtctatatctggccttccagagatattcaaatgtttatctggatttttgctactgtaaatttattctcttcatcttccctgggcctccatattagaatatgcatttacaagaccttggtcattttcggctcctatttcccataacaactcttataagatttcgtttcaacttaactttctgcctattttgtagtgaaaatcaaggttctgagtgtaaatactttacctacctaactccaaacatagacacttctctacatcatcacctatctttacttcctttgcttcaggatcatagagtttttctttctctgattcaaggctaaccactcttactataatcttttctgaaatgttccatcaattattctaatttttaaaatcttctgaattttgaatatctctttccttcccagtggattttacatatgacactcccacttaaaaacaaaatgaaaacctctcttggacccaacttctattttgtctactgtatcctcttcaatctttcttctttccttcttggacggaaaaggctccttcttcatcccctatatttggatgccttcattgtccttctgagtctattctagcaaatatcattaatgaccttccagttgtcaaatctgatgttctcttctcagacctcatcttatgggctacctttacgacatttgacaccattgtttactaatatttatttccagtataaaaatggccctattatttttttagcctcttaattcttcttgagactctatacaaatcaaggcaaggccagatttgaacagcgaggaaaagtaaatgatacaggctggagggtggttgacggaaatgggtctgtaagcatgggttggatttcatgggtttgagcaccttaatttcacactgcttcctctattatctttttatattgtcaggtcaatatgttaccttaaaataattgcaaagaatttttttttttgaaaatgtgctcaggtaacatgactgttgacttaaaactaaaggaaacaaagttaaatggaaaaaaaaaaacctaacagataaaagaatgagcagagatatcactcactatttcctatgcttagattgtggatagagatggaacaacatagggtccagggatctgtgactgaatccaggggatctgattttgtctccatttcccacttcctaatgcaaacttgaaattgagacactgtatgggaaatagatttatattcttatgctgggtctcaggttaagtagttgtatatcattagctaactttcttattatttaagggccctgttatgctaactttctatgattctataaaagtagatctaaagtagtttgtaggtatgaaagagctttataaatgtaatatattattaatctctgtcaacatacacataaaacttccaacctttgtatgtgatgaaattcaaatgtaataattatttgtcatctaacactgaaggaaaatattttacttttacacggaacagcttattatctgctctgtgcccttacaacatggatagtccatttgttttttaaaaaaagagagagagatggtgacagctggtaattcatttatttacaaattggggtcctgacttaacaaataaatatttgaggctttcaaaagcaatcactgtaatttttgcacacatggtaattttttaaagaaaattatatacagactgttttcaattatattcaaaatttatgaaagatgtcctcctcctatcctgaaagtttatattttattaaagatggtgattgaaggcttccactgaagagcattagctttgtttgaagcactgtatttctgaagcccaaattgcaaatgaaataaatgatgtgccctcttgttatacaaacaaccaccagctatcagccatcaagtcaggattgcagttgtgttaaacaggctggcctctgtctctcctttgtcacgcacttaaggttccctcttattctctggattcagatggctccagtgggcgtgccttcttggtttaactgatgccttttcaacttttgtatctttgtatgggtggaggagacttttgaggatttgctttcaatccttttcatttagcctcccttatgtcatttctttgagctggaggctatgttgcagcctggccatttacgttctggccctaaggtatggctaatcatgcctctggtacccttcatgcatcttaatatgaagctttggggcacttggttcccagttggtgagatcatcctgggattgtgtctacagctgcgtctctggcattatctcttaggattcccttaaggaagtatgttatgcaaagcatgactataaagtaacaaatttggttttcatacaccatacataaatgcttgtctcgctgttttctaagcacattttatatatgcctttctattagggatagtggcgaacaattgttgtcgattgctcagatgaagatgagtctcctaatatgattcctaaaaattcctggttttcagatgggttaattaaaggtggcagcaaccccaaaatagatttatgggaaaatggagaaaggaggctggatggctacaggagtcttagaaatgtgggcactttcagaatatggtgttcggaagtctatgtttgaaaggaagccaacatgcgtaaaaggaaatgttgctgcttgtgcaaaacctctggctattagatttctctgtcagcagacacagcggaccatttgatacacatgctggtagtcttcacccagaaagagtggggtttctgtcaaatgtttgcaagtaagtaattggtctgaaaaagaaaaatggggcctggaggaagcacaggggttctttggactgtgtccagtagaaaaaacagtagactagagatctaaaaacacagatcttgatctagcttttatcattctgtgctgtgtgtttttaaccacatcattgagctgagtggtctgcataagccacggcctggcacaaatataggtaaagcgtcaaaaataggtacagtagctcatagaagatactttaaaagcgtttgttgaatgataagtgaatttataattcattcattgaatttataattcattcattatagatctgtcatacgatttgatgcctagattttgaagtttaatgttcatctccataccagacattttatgtctgtatgttcaaattcattatgttaacaaagaatgtaggtcacctgggcaatctgtggatagagaggatgccccattagctgactgctaaattttaggatgctgacagcattgtagaaacatgttgattaggccacaatggaaatcacgtctgatcccagcagcagatgagactctgtgttattcagaaatgtatagaggtcataaagtgaggttgatttctaaacaatgataataagaatacaaagtggataattctattaaaaaaaagaactcattgaacctttgaactctagaaacaaagattaggctcaagtagttaagcacagccagatatttctgggtcagtccctatagcacttagataacagctgtgggttgacaattgtcctctagcttttctcaaaagaggaatctcacagaccaaggcttgaaaatggtatttattatgaaaacctagggcatgatggaaatattttggaattttgtacctattttgcaagtgtaactaggtttctcttattgctttgtagctatttgtgaacattgtttcctttgacattttaagtttctgggaggctatttctgaatcctgttcatttatcttctcccatttccaagttccattctaatcttcacctcaaagcagagcatttgttaccaagaacaattcaggaggctaccagctcagttcaagcattgcccgaaaatgctttttacttttgtacacggattcgtttgtttactcatctattctgcacccaccacgaccaagcatggtaccaggtgctatgctatgtactggaaagggagagatgaaacatgataggcactgcctcgaaggtgctcacactctactacttcacccactgtaaacaaactctaaaacatggtgagagttgtgctatgataagagcaaggtgtcctgagcccaaggtgtctcctttctgagtatagggcaagggagatgatcagagagggtcccagggagaggcaatatctaagctgaaatataaaagagagggagagttaaccaggagagaaatgatgcagagggatggaggtagaagctggggttggagggattagggtcccatgaaccacatgtgcaaaggcacaaaacagagaaagtaatacccttcagtaaactggatatgggagaagtgggcatttattttactgtgattcaggaaaggaatgacaaaaataaggtgagaaatacagtaattactaacttcacccatttctactcctttgaatgttaaacttgtatgatttattattattattgcttatttgcttgactagggagacaagagccctgtattttggtgctagatttgaccatttcaaggtgagttatactaaataaatttgtaatatctgggcttctttttcattatacctttctaagttattttagaattggcaaaacatatgtcattttgtgtggaaagtttttgtagcttcaggatatttggaaaactatatacagccattatagaaaacatagggagattcccccagaattaaaaacagaactatcatatgatccaacaatctcactactgtgtatgtatcttatatatctaaaagaaatgaagtcaatatgttgaagaggtatctgcagttccatgttcattcaagggctattcacaatagtcaagatatggcatcaacctaagtgtccatcaaaggatgaatgtgataaaaaatgtatctatacacaatggaaaatgattcaacctttaaaaataaaaagaaatcttgaaattcgtgacatggatgaacctgaaggacattatactaagggagataagccagggacaacaagacaagtactacatgatctatcttttatgtggaatcaaaaaagacaaactcatagaaccagagaataaaatagtggctaccagaccctgggataggtgggtggatttgggagacattggttaaagtatacaaaatttcagttagataggagaagtaagttcaagacatttattgtacatatggtgtctatagttaaagtgtattatatagttgaaaatagctaagagggtagattttaagtgttttcaccacaaaaaatcagtatgtgaagtagtgcatatattagtttgatgtagccattccattatgtatacatatgtccaaaacatcatgttgtatgccataaacatatacaacttttatttgtcaatttaaaaagtaggaaaaaaaattttggctgggcacagtggctcacgcctgtaatcccagcactttgggaggccgagatggatggatcacgaggtcaggagattgagaccatcctggctaacacagtgaaaccccgtctctactaacaatacaaaaaagttagctgggcgtggtggcgggcgcctgtagtcccagctacttgggaggctgaggcaggagaatggcgtgaacccaggaggcagagcttgcagtgagcccagattgcaccactgcactccagcctgggcaatagagcgagactctgtctcaaaaaaaaaaaaaaaaaattataatgataattggaaaaccctaacccagaaccagaactctagtagataggaccacatccaataacagaggccaaaggcaaaagatggtgaagttcatttgcagtgaagtcctgcagggcaactggggaatctatcaacaaagagatgctgtagcagtggtgcacctgtccctgcgaaaggctctgagtctcagccatgaatagtctctcaccacaaggccatgctcaccaaatctgaggctttgtgtagctcagtccttagatgagctacctaaaaactaacaggaaagaaaaatacaagagaaaaaacaaatttggtaaaatgctatgttgcaacaaaattataccaaacctacaacatagttaagttcttgtttaagctaaagaaaaaggatcctgggttaagtaggccaagaaccctggcctgggagctctttctggtagaataaaaatctgcatagcttagtaccaaagatgatccccttgtccactggtatttatactgttaggaagtcaagtacagaacaataattaatatgcatttagggttcagtttatttctggcaatcttttctcttctttttcgctacctccatccctatctttcacaacaacccctgcaaggtactttgctgttgtgaaacacggaggggcacctggattgcaagatacctgtaattatctccattttattggagagaaaactcatcctcagagagtataaataatgagttcaaggtgatatatgctgggactattaaaatgtaggtagattgtataatccgtatttgatatctgttcaattccaagctcatgttctaacacatcatgctacttatagtctagaaagactgactgtctaattccaaaataaccatttggctttaaacattttgaaaacgttatattaaaaattagaacacattaggataatagagtagtatcaagaagaggtcaatggtagaaaacaagggcctatcacaggggcatggctctaaatctatagggtacagaagggccaagaggctcatgtcagtcagcagtgacatctcccagtgaccgctggaaggaacttgacctgtgtgtgctggcctgtgtgctcttcttcgatttaattccagtggtggggatctttcaatctcccaacaccagatgctttcacagaatgtatgctattttattttgaaatctcctatcagttctagtcaaatatatgttaaagattaatacaactactaagttactggaggaatcattatgcagcaaaattactataaaatgaatttaaaaatggacttcgaaaccattagaaaaatggggaaattatatgaatttgactattcacaggaaagaaactgtataaatggataatgtatagtaagaaatattttcaatgcagtgaataagcaaattaataagatttttaatagcagtgagatagatttttttaaactgttgggattacagaattaaaaagaaacaatgcatttgttgtcctgagaatgtggaggaataggcattctcagaccctggtggtgggattgcccatcagccagatttttggaaatcaatttggcaattttttaaaggtcttaaaagtgtttgctatcctccaccttgatccagtgtttctctaaggacatcattagagatatgtgtaaggatatatttacaaagatgcttattgcagctgcatttttaactgaaaaaatgggaaatatcctatattgccatccatatggaaatggctgattaaagtgcagtataatcgtaagacagaatatcatgcagctattaaattatcaccaaataattttattgtacatgaaaatatactcatgatgagctgcagtgagctatgctcatgtcactgctctccagcttgggtgacagagtgagatcttgtctctaaaaacaaattaaaataagataaaaatatatgaatgatgtaatgtgatagaaaatttaggataaaaaaacagaatgtgcagtgtgaacttgtatgtgtgcttgcaagcgtgtgcacacttgcatgtgcctgttgatgtgtgtgtgtatatatgtgcacatgtgcatgtgacatccaccaaaacatgaggggaagacaccaaaatgttcattatagtccttctggttgatgggattgtgattttaatttttaaacatttcttcatattttactgtatttttcaaactttctgtaataagcaagtatttatctcagcaaacaaaaaaagtggttaaaaggtatttaataacataaatcccaaagggaatttttgtaagagatttaaaattaggatggctcaggttaatagagtagtataaagaaccggccaaaagtagaaaactagggcccatcacaggggctgctttaagtgatcttagaaataactttattgtatttccagaagcactttccctattttgcctctgacatacacatcaatggtggaaggagaggagacaggatgctgactgggaattaaggcttacagaggagagagttggtctctaggagattttatgtgataggtttggagataatctttggtttccaaaacaataactttatccggctgatgagcacatgaaagccaaagagttgattgtatgactatctatatgccagtcattttacactgcgactttatattccttttccatgatggttactattatcctacagacctatttatttatttatttgtttattctgtctccttattggacgataaagatataaggatgagaccttgtttatttatttgtttttttattttgagatggaatttcactcttgttgcccaggctggagtgcaatggcgcaatcttggctcaccgcaacctctgcctcccgggttcaagtgattctcctgcctcagcctcccatgtagctggtattacaggcatccaccaccaaccccggctaatgaggccttgtctatttcactgctatatgctcaatgctgagcacatggcttgacacacagaaggacctcaataaactgtttttgcatgataaatgaattaataatgaattcattacaaatctatcatagagtctgacctctagtttttgaagtttgttcttgacttgccaaggctgttggtgtgctctcagactttaagttgccaacagacttagatgttggggaaggaaatgaacagctcttaaaaccatagcccctttgattttgctgccattatttaggagaggatggaagtgccactaccccactacattctcactttgttcttctgacccagtaaaaataggcatggggaaagatgtcatctttgtgttcccttgtggtaatagcatggcatgtgtcccacctgctgacttttttttgatacctgctttgctaacaatgcctgacttttctgtataatccctgacttttctgtatctccaactagaacaaaccactttctatgtgtacatttgactgctctgctcagtggactataaaagcatcaaggtaaaatagtttcccacttaatttttttttttttgagacggagtctcactctgtcaccaggctggagtgcagtggtgtgaccttggctcgctgcaacctctgcctcctggttcaagcaattttcctgcctcagcctcctgagtagctgggactacaggcacacaccaccacacccagctaattattgtatttttagtagagacggggtttcaccatgttggccaggatggccttgatctcttgaccttgtgatccacctgcctaggcctcccaaagttctaggattacaggtgtgaggcattgcgcccagcctccacttacttaatttttaaaatgagcctgttaggtaacaatattaagcacaccactatatgtgtgtaatataatatttttatattgtaatatattatttgacttttacttgtaatcgttagcaaccatttgtaaaatacctaatttgatgctagcactatagtaagcaatttacatgcattagctactcaatctttaccataaccctatgagatatatgttataccattttacagatgagaaaagtgagtctattgcaacccaggtgtgactgatctcaaagcaggtagaattctctccatattccatgcaagaatcttgaaatactaagtatcctgagtatttcacagtatttagagctgggactagcatcaacagtacatagcaaatagtcaagtcacattgagaagcttgattttctgaaacactcatgttggcattcttaattttcattatccaacattacatagttaccagtgttgcctttcattcatacaccaatcgatatcctaattggtctgcctcaaacctggaagcaaattgcctggcaaaggcagagggagagctgcagatggatatgtttaaaagggctgagtgtgtagagttgctgagcaaaggagagctctgcccctgtgtcccctccttgtgtctcacctgaagcttcatatttctgttgctgttcttcattcagcctctcattatttacagttgtcctctaagggaatcagagctcactctattccatcttttttacttttgaattaattttcctaattggtagagagaggccatttgggatacaaaaccactttagtgcctagccgggaaatttctgaaagctctgtcagtggaaggagtgtcgagggacttgtccaagttgatgttcaattctttcagcttctctaggtcagttcttttctctcgcatagcatgtctttcatttattatattctgatgccattataaactagccaagggaaaaaggacaatgtttaacctctgcttacatggactcacaatgcagactgtgcaaaacaagactgcagggctaatatcacagtcagagagttcaagaagctctgaaaaccatgggaaccagtgacctgttcaaaactgaactttaattctacaaggaagagagagcagaggagagagaacaagaaaacagaaagcagaaaaggacaaagcttcaagagaccaccctggccacctggtgccacttggggtctggggtgcttgatggcctcttaatgttttgaagcacagccggcagcatgaggaaggcgtgagatacagggcagcccccatgcacttggatcctttagtttcagcttccagcagggaagtgcttaattgcatccgtgattgagatgatcatttttattgtgttcagcccagagttaaggagagggggcccctccttaggcaagttttgaatttcaggttatttgtcatctcttagccattatcaatggtgctgttactgtcatcatcattatcatcagaagggaagtgttaagcctataattacatgtggcactgtgctaagtgtgatacagggaagcacttggttcttgccggccaggtgtgcataatcaaaacacactctgtgtcagggcagaccaaaagtacaagttttgcacagaaaggaagatgaaaacactgagtaaataagcaggtcttatgaagatataattgcctgggttctgttttaggactacaaactatcatctggggacttatagtctatttaaatactacctctaaactactgctatgctcctggcacagccctaagtactttatatgaatcttatttaatccttgcaacagccctatatgacaaatgctatgactatcgctaacctacttaccaggtggcaatgttaaggacacactactagtaagaagcagaacaaagatgctgagccagtctatctgaccacagggtccatggcaatgataattgcattaaaagcctctcagagccactgcaaactttcatagcaaatacattttcatagcaaatacactttggggccagactttgagtgcatttcattatttgaaaatttcgatgaacattgtgttaatgatcatataaaactcagccaaacagacaaagcaacaagagagcaagaaagaatgaagcaatttatttagggtagtagaacttttgaagttagctctgtaatactttttaaatgctgtaatgttataaaaagaaagaaacacagaacataggtagaagggcatactgaactgggaaggaactgctatattgggaaaaagaacaacattatctgaaggatgagtgagtgagttgagaggctgaaataatttggataagcatctcatccatttgaattctgattatttataggcacactcatccctaatcctaatgttggattactgactattaggttctgattattccattaaaaggattcaatgattgcatgttaattaaggattcttccaagttgatactaatataccgataattctatcctctctctctctctgacaatttactttgagattccatttatttaaaagagaaatgttacggatataaaagatgttgtctttgatagtcaaaatgaacttactaatttgtttgtttagttttctgttggtttgctgtagaagttggacagttccagcttctctccaaggagtatgtatcttatccacattgaattccttattccatctaagatatgatcgctacataggaggaaatgctggataatggaaggattattggactagcagttaggagtactggattctagcctctctttgctacatctacaaaagcaattacagaaagtccctcaatctccttaggtttattttgttatttctaaagaatctagttgggttataccaatgattctcaaaactcactgtggattagaattactcagaaaacgtttttatcatgtatatataaaatatatatatatatctgctatcagcaaacaatcctgcataaaaaataaaaaaaaacactacattttttcttttcttttttttttattgttgtttttgagaccaagtgtcactttattgcccaggctggagtgccgtggcatgatatcagctcactgcaacctccacctcctggggtcaagtgattcttgtgcctcagcctcttgagtagctgaaattacaggcacctgccaccacacccagctaattttttaaatatatttttagtagagacagggttttaccatgttggccaggctggtctcaagctccttacctcaagtcatctgcctgcctcagcctcccaatatgctgggattacaggaatgtgccaccacgcccggccagcactacattttttctgaggctgacttccgagggctgctgggaatccctgcagtcctttagccccaactaaaacggcactcctaaaagtgaattgggttaggccagtatgttggctgtgcttagggttcttggccattcatacagagccttaatgtgtcatcaatctaccatcctcttcccacccctgtcacccactgacattccatactgattccttcttgaaggagctgtcttttctggattagttcatacatgcaggagaaggagttctggcttagaattcaggctatctgagttctccttctatctgagttctgtgaactcaggttaggcctgagttcacaggccctaaccaggtctgtgatctcagcatacaacttacccttcagtgcctctgtttcctcatctgtaaaaagaaggaatcctttcttgctcttcaactctatgatccctgctcagaccttgggagccactgcagtgttcagctgctctcagtttactgttttctgactcattcctctgcaggggcccttgcaaggccctggcctgcctgccccatacccgcaggctatgtctgactgctgcagagcagcgagatcccagggggctcctcttttctttccttctttgcgtgtggaacaagtaatctggcacgttggcggttttctgggcaacagaaaatcgcaggattgttccctgatagcagggcttttctgggcaacacaattctgaaactgtcctcttgctcacttgtcaacccatgacggacagtaaagggaagaggagggcctttgacttcactggtgggcaggggaggaagctcttgaagacataaagggatgtgactgtggcagctgctctgcttgttgaaaccttggtattcttacatgtggcttgtgattgaggttctgactcttgtacttggcatggtcttttgtgtgatagatggtgaatataagtaagtctgatgcctaattaagaacaccatacaattacccatgtccatacagatgatgtggctgtcaagaaaaggcttcacctggaagagggatgaagataggattttatactggactgtcgtggaaaaatatcagcatcttccgtttaactccatgagcctcataaagactatgtcctagctccctgtagtcctccttatttatgcatatgatttgactttccttcagtttctctgagcattctactatttcagtgataggtaaccattttttcatcttgaaactgttctaaaatttgcactttttgattgttctttaaagatggccctgaggcattaaaaacagggaagaggatgggctcacagatgggaggctaaatggaattacaagtgaccaagatccaaaatattatactactcccctcgcccctcctgcctgccaagtatgttctgcctattcatctgtgtccagtaaagtgtagcaagtatcagaccacatgaatgaatcctctccctgctgagaactgaccgcaagagggctcctgggaacagaagtccactgagcttctgcagattgaccgagagttgtctagatttgtaaacaggatgaggaagagactattccacaacctttggtgcagaggggaatgtgatatttagtagaacaaggcccataaagctaaataaaagtgttttattttaggtcattaaactgtatgtcatataacctttaaaacagcatgcattataaatcagcagctcaggtttatagggtagcttatcattcatttaacaggcatagtgatagtacttgaggctcgggccactccttacctctttctaaattaagagaatttctaaatttcttttttttttttttttttccaaaaaaaggaagctcattctttatgggcttctgctacccccagcccagtgttcagccacaatgcttctcactgtggcagcagatactaacattcagatgctcagaaaacacaagcagtgaacagtcatccagagagtacaggtggtctctaagggagaactttgagagcctcaaaactacctttatatgtaatggacaaacatattacatgtctccagcggacttttaacccagaataccacccatcttagggtttcgctggtgctgttcttccacagataaaatacttaaaagacatatttatttaactgtctttgcagaaacatgagatgatgtaaatggttgccaaatcaaagaagcagtacccaaaagtacattctgcatgagtccacatacataaaattcaaaaacaggcagaacttttagtgccactgaaagatacatttaaaaatggttaaaattgtaaattttatagtatgtctattttacctcacacacaaaagaacaaaaaaccaaacgcctgaaaccaaaacctcagcacagttaatctaatgagtgacagctcaggagattagctgccattgggattatcaatgactgcaaggaggcatgagtgggacttctggatacacagaagtttctgtttgtcatctgaatgttggccgtacagctggctcactttggtaagatttattgagctgtatgctatggcaagcttacttttctaggtaagtgttttgcttcaggaagacatttatcagaaagtaagaaggtgctaaaaaaattagttgatttgatttaatttgactggggtattggtcacaagtatgaaaattcattctattcttcaggtgccacaggtatttgggcagagataattgaataaaattatgtcagtgaatagtatttctatttttttccttgcaaaaatcaaatttggtttaaggatgacagggcaaggttttgtctgcatttagaccacagcattgccaccctttgaagttgccttatttctttgaagctgccttatttctttgaagctctgaaagcacgtggtatctgcaacaatatagagagggctagtctaatggtctgctcttagttacatggcacgtaggttgttttccttaaaagccctgcctccgtgtggctctgtgggatagtgagcttcctgtcatctactggaggccagagaataatctagaagggatgctctgcagaggctgcttatatcgcagagacgttgaacaaaattatctacaatgtcccatgtaattccaagattctgtttctaccattctctaggcgtttatagacaatgtttattaaatatgggccctcatctctgtgtcagtttcttcttcggtaactttgtgaaggcaagtcctaaaggttaaagaaaaatagcaatccttttaggacacttgtattggtcttttaaggcatttcacaaattggatggcttaaaacaagagaaatgtattctctcacagctgtggagacctcaagtgtgaaatcaagatgtcagcaggtccattttccctctgaaaactcagggaagaatccctccttgtctcttacagctcctgatggccccagccacccttaggactccttggcttgtagctgcatcactccaacctctgcctctgtggccttcttccctgcatgtctgtgtgtctctgtgtcctttcttcctcctacaggtacactagtcattggatttagggcctaccctaaacacaggatgatttcatcctgagatccttaattatgtttgtgaagaccttatctctaaataacatcacagtctgaggttccaggaggatataatttgggggatgacagtgtattcaaactattgccaacaccttcttggaaagaaaaagaaaaaaaatcaacattaaaaacctgtaggatatccaataaatgcaaagtgagtgttgagagaataaagcgttgagtccactctcaggaagggtgagggctccgacggggaggttatccacacgtccattcgttcagtgaattattactgggccctgagctataccaggcactctgttaggtactgagtgtagagcagcaaaataaagaaacagagaccatcctcatggcacttatggtccagcgggggagatcaatattaatctaaggaacaaaaaaaaaaaagatcactgcaaattattgaaaaatacagtgcggcatatcattagagagaattatattgagaagaggcccagcttttgatgtggggtctgtcagaaaagttttctcagaggaaatcatatttaagctgaaaccagaggatgagtaggagttagccaggtaccgactggagaataacactccaggtaggcagagtggtgagttcaaggggcgggatggaggtcgctgtggctaggatacagtgagcaaggcccggcagggcatgggataaggagtgggtgcctggagcctcatgaacccctggcagttcacagtcaggatttgggggtcccttcaacaagaagacccagaaagttagaagaagaggaatggcaagctctgaattctattttaagatgactctcctgcttgatgtggagaaaggagggaccaaaaagtgaccccagcaggctaggtatgatacggtggcgcaggcagctggagcagagaccctggtgccaggaaccattagaaacatattcctgctactgcagccagtcagctgaccagtgtatttcctaggctgagaggcaagcatggctcaatagagatctgtagagctccatcatccatatggaattgactttcaaaatgatgaaatagaactaattttcaagtagctcttatctaaaactaacaaagggggttttacttgagttctatgagcgctctatgctcatttgttgttaaatttttgaaattattttctggtttggaatgtagatccagaatttgatatatgcagatgagcatgtgctaacatggccgtggtgttagctagttaagatccggaagtgctatcacacaggatgggaagggcctcctagagaagtgagagtctctcagacctagaaatactggcacatgatacctctgaacccacggagtacccagtatacaccaccaggaagctgtgtggcacactgtttttaaatctcaattgaagcagtcttggacaacaacctttgttttctatctagggaggatctagactttaggtgaatgaaggggagatgaaaggtgagaaatttaaggaaaggtgtgttctaattatgaaaataatttgtatgaccatttaacttgtgacacagagctcttcctgtgtggttaccaattctgtacttgcaggtacaagtctgtttgatgtactaggtgcacatgggaccccttcctcgggatttcttaacatgctgctgtttcctactccttgtgtcattggctgggagaatgttcacaacagactctggcaaatgagttcatcctccttgcagataatcaccttatagaagaatcacattgtcttcccagccgaagccctcttgtctgaaggatacctagtgttacgtgcgtgtgtaccattccaacctcagttcctccccatccccttaaaaagatgtgcagtgtatgatccctacagataatgtaggaaaaatctgggtttgagaggtgggctggggcagagaaggccttagcagagggcctcagtgcccatctgcttagtattatccacatgagtaagttgtttccattgaaatcaacaggaccgtatggcaatgttcgaatctgaaattatttccaatggattcctgtgtagttacaactctatacttgcaatctttgtgatttcaatttggaaagtcattcaagtgagtaatttaatgttgggctgttccttctgttttcccttcaagctcaaaaaattctcaaaataatgatattataaacaaactttgactgtgcctaacaggacagtgaggggttacagttctgtttgttccaaatataaactatcaggtcagatttgactttatcaactaggcactgggttttatgaagacaaatccgacttgtgtgaagccaacttttaactcctagataatatcttacctagaaagagataatctgatttatcttccaatgtacaatgggcctttttcctaaggcacagtgaggaggacttcactaaggcacatatcacaacatttctcctctttcatgccccttaagccccctaatttttctctaaagatgatggtctcttggttacagaggtaccccaaatcacttttttaaagtaagtaaatggccaggcacagtggctcatgcctgtaatctgaacactttgggatgccgaggcaggtggatcaccagaggttgggagttccagaccagcctggccaacatggtgaaaacctatctctatgaaaaatacaaagattagccgggcatggtggcaggcacctgaatcccagctacttgggaggctgaggcaggagcatcacttgaacctgggaggtggaggttgcagtgagccgagattgcatcactgcattccaggctgggccacagagtaagactctgcctcaaaaaaatttataaaataaataaataagtaaataaaataaagtaggtaaaatgcacattgcattcatgtctatgacaattgtgggtgcacatggattaaagagctctagaattctaaaaggcttgctacaaaacatcattcccttgctgttccacttccagtctactccccctcccaaaaggaaccactttgaatttcaatacaagtttattagggaattgtgctctatatctctaaggaacatgcttatattgttcctttttaaacttttttccagcttaggctttatctgctaacttccatctgtggcagagatagagatggcttcctttcctacctttcaccattcacctccaccctcaatattccttctcatcctcagactcccagtaaagttatatcttaatttgtttagatcaatattcagtgttctcactactgagttagaacatactatggttattatttatgtagtataatttccactctcccaacccccactccagaattcataattatcttgtgctttgttttcatagctttaacatacttaagtcttcatcatctgcctattcgactggtgcaaaagtaatggcggtttttgcaataataaatgtcctcccaattgttcagacgcatctgtccatttcttctttttgaggaactctcagagactcctgacctgccctcacctggatgggttggctgctacacactgagcagtgcagtcactaagggtctcctttcaccaccattttgaggatttcctgtacttccctttcttactgctttaccaacttcctgactctcctgtctgctgtattccctccttttggtgggttatatttttcagtagcttcttgagaaaggattcatgggagctaaaattaaaattttatgtgttagaaaatgttttggttccattttctcacctaatttgtagtttggttaggtatgcaactctaggtaaggaaatgttttcttccagaatttgagagcatagctctattgtcctctagcttccaaggctgcttttgacaaagtctgatgaattctggtagctaatcctattagattagctatcgctacccctccctccctttctctcactctccggaaattcataggatgttctcttttgtctgcagtgatctgaactctccttatattgtttgtttgtctttttgctctaattcttaggctgtgtctttatattcaagtgaaatatttctattggcagtaaataataataaaaatattccaaaatgcagccgtaataaattagacacagaattcaacacaaaaaccattcagacgctttactggtgatcctgccattaaggatgacacaaaccctgtctgttgttgcctactaggataattattgcagatcagtgaggagccagaacaccaaggcattgtagaacgccaacagtaggctagaatgtaaaggaggaaaacctagaaaagagcaggtttggcttcagccgtccctcagacctaattaccattcccaaagggacacgaacaccatatttaaagcattcatctaacttacagagggtgaggcttggctgtgggagggccctgcagccagcatacctgaggtcagatgaatcacttagcatggctttggaatgttctgtctgaggctggagtcaggctcataagggcttctttgcattttaggggcccagccaagtagactaatgcaaggaagtctttatatcccagagtaaggaattgtggcataaatcaagaaggcaatgctgaaaacccaaattacacagatgaaatgaaccagagaggtaagggcaaaggcgagcctaagctgaccctcaggcatcctaagtgcttgatcggagacgacatgattcatacctaaccccaccagctgtgagccactcataaacaaccagtctgtcaacactgtctcagaagtgggaagagttgattctgcaagctgaaactcttcaaaggtacagatgagtatcctgagaagaggcagaaaggggcaatagtgagtatttcagacctctagagaccatccatcactttcaccaccagatatcaactttattttacctttcatggatcctgttctcttgttttcatagatcttcctctcataccttttttaaaaaatacagtctcactctgttgcccaggctggagtgcagtggtgcaatcaggactcactgcaattttggcctcctgggcctaaacaatcctcctgcctcagcctccttagtagctgagactacagttatgtgccaccacatcctgttattttattattttttttaatagagataaggtcttactatgttgcccgggctggtctcaaattcctgggctcaagtgatcctcccaactcagattcccaaagtgctgagattacaggtgtgagtcattgtgcccagcctcataccttatttttaatcctttctcaatagccagttttatcttacctgtacctatatttccaaaaatttgcctaaatttcctgtggttgctcagaactctacagctctcctcaatttcaaattgtaacttgaaattgaacctgaaatcttcctaagatttaccaacagaccagcatgatcagtacatcctggttattttttgtcctttggcaaccatttgtatgcttattaaaacttgtctccctctttcatagcagcctaaaatttcttgaagcaaaggctgtctttcattcatcatgtcactcaaacaccctatacacacagcttcagcacaggtaaaccagcacagtgagtaaacctggctccatctgacccattctacacaattccttcccctagacggagtcttggtcttcactactaaggaagcctaaccttggaaatggacctgtgggcaaataaaactgttttctcttccagggatgtttccatttgaaacttcagcttgatggccacatgaaatgtctttctcaccaaataaagaaatagctaactatgagggttattttcttcaccagggaacctacccgatctctttcaaggcattccctgtaggcagcttcccactaggccacaaaaatcagagtctgtcatgattgattgatcaagaaatacctgcccacagagggccacacttcctctgaggctcaggcacctttttcaggagggaaggaatgctagactcagggaaagggctcctgaccatgaaatgctcagaaagttggtgtgtgccagggtcagagcactgctgagagcgccagtgatcagtacacattccatttccctctgtgcccagcactgccccttgaagtcactgttctgtcttttcagaatggaaaaaattagagaataacaagttgctcaaaagcttcaagttcttgcaagaatgtcaattaggttagacggtgacataatagaataatgttcatatggcaattccttacagcacaatgatcccaaataatatcacctattgctacagcctgtgccatgcgggctgccacacataaagaagctggcagtgtgtgataggcagtgggagaagctgaagttgttactacgtaatgagaaagatggtgtaaataccatgtcttggtttgtgggggaggtgttgcctgtggaggaggtatgcgactcatgggagagggtggttttatcttactaggagtaaagactcttaatgtgttcaacaaggtcgatgattttgactaagatggcatagccaatacatattacagaggaaaaaaagactggataaggcaattgagataggaaacataaactggaaatgaaatacatatcagtatagatcagttcacacttgagtcacgcatcaaatgttcatggtttagcctggcactagtgggtcttgatctaccaccacatctctatatgctcttatgaacactcttacacttttcaaaatcttcttacatacattatcttatttattaggggaaacagaatgaactgctaatatcattcccactttaaagataaataaatggaaggacagagagattaaactaactgctcaaggtcacactgatagcaagtgatcacattttgaccaatattgaccatgatgaatgaccaagtgttgaacactaactacaggtaatatgttaattcccaacagccctagcagatgactagtgacattgtttctgttttgtagaaaagaagtatacgtggcttgctaatgtcacacacagctggcaatggcagagatcaggttcaaatctagatatgcttgcctccggagtctgcaatcttaaccactatcctttctctctgtaatccagcaatttgcctcctcctggaagaatctagtgattcttgcgtagtaattgtgatttttctattaaacctcatctctttccaccatggtaccttcattttaattgatttcactatttgtagcatcatctcacactttttctgttagtcacttttaaaaagtattattccatacaccccacctgcctggtctcacaatgcacctgattctccagcattatttatatacttctcccttccttctctagttatttggaaatatttttaaggcagaaacaatgttttaattttatattacattttattgtttttgcattgaaacccaggtctcccaactccaaatgtaatactttgatcaaaagcacaggctctgaagtcaggaagactcaaccaagttcatgttctgactctgcctctgactggatgaatgactatggccaagctatgtggtctctctgacccaaaaattactcatctgtaaaatggagctagccaaatcatagatcagatgtgaggaatattctaggtcatgtataagctattctacatagtgagtagcagatttagaaatgactcaatagaaactgctattggtgttatcatcagtattaattatagttatgaaaagaaagctgccagctttggaaaactcctaatgcttaaaatttctctggcttaggaaatctctggatgttttctaagagtctaataagtagggatgtctcacatataactcagatggtttgataaaagccagttcttgaatatgatgctggagtcagtagatagattgtcacagcaataatagatatatcacagtcaatagaaagctataagaaatggaaatccaaagtgattggttatggaaatgaaaaattacttttccctaccttgaaaacaggtgatgtctttcagccatttactgtcatttgaaaatgaaaatagtactatttttgttaaaataactgtgactgaccaattcttttttgtaatatgttcaatgggaaatttcttagttttctgagaccattctgggctaataaattagaaagtttccaagagttaggataaggactttgaaatgtgatgacctgtttcaacatgaagctgacagtgtaatgaataacagagtttcaggatcctgaaactttgattgcttttccttttcttatttgctttgttcatctcagagaagaaaatgatccacatttgtaatatcaccttatcctgcagttggacattaaacatttattttaaacattaaaactgctgagcttgtgagtttataacccatagatacttctatttatttatttttaaattttaatttctttatgttgaaattgcaaaatccagtgaatcaaaggaaaatgatacctggaaattgtgacttttcatgaagtgtaaccaaatacagctggtcaggagagcatgaagcagggattttgttggtggtgccggctggaatggcagggctgaaatgtacacatttgttattggatgctttatggtttggttatgtttggattatggtttttaaaatatctttgggttttgaaaacccagaacaatgtattcataatccatggtccatcagctttattgtggctttcatttcatagagaaagagtggttttgcatttgcaatgaattagctgtttattttcccaactctcccatttcattatagtgatacaatttattcacctaacgataaacaaatttttttccaattcttggtcagtgattggattacactaaaggaattttgttttcagggtgttggtgtgtatccataaaacaatataaattttgtattgatgagggaattgcctttcctatttaattatgattgtgggccccgtctctctctctctctctctctcaatctctctcaatgaatgaaatacagaactattgtgaagagataataagctactaaaaagcattcagtagttgttactgttataaattattcattccctgtggctttagaaataaagttctttatcttttcagaggcagctcaagggtagaggcatttaggagatctctcaccgagtaggcagactgaagatttctccctgtactgttattgcttatgtgctccatctcttagggcaaagtagtttgcctttcttctcccaagattgttatacatgaaaatataaagatcattgtattttgatgcatcttccaggaatgctgagaggtaatgaaaagagacaagtacaacccatatgagagatcatttcctcaactctttgttaagatagatgcattgtaaatgggaacatactgtggtgtattggcaggcaggtcatctgagtctctggatgtagagaattacaatgtgcctctgttatgtcattttattttgtactcacatgagcaattgcaggaatgcacaagctaacatatcagttatgaaagagcccaaatgagggcctacggatgaatgagtctccatagccaatagttgacagtgcttagagtcctgaaggatgatttcattgacttgttgcatccttcatgcaaacaaggattcgacagctgtcaaaagggcagattggtctctacactctccagggatctatgtgaatagtgtctgtttggagaagtgattagaaatattaatgggctctgaaaacaaatcaaaaagcatgtacctctaagaccgggctccctacagggtcaaattcaggaaaatcggattttaacaattgaatttgttttggttcttttttaaaaatttaagcataatctctattttgaatgaaactgttataagagagaaaagtaagctttactgaaataggcagtaggtagggctgaatttagtattctgttttattgttgttgtttgttattcgcttgctttgtgattatgcctaaatctagaaagcccaaatgaagcatcattcccttaacatttgtcttctctttccttttatttttatttatttgagacagagagtcttgctctgtcacccaggctggagtgcagtggtgcaatctcggctcattgcaacctctgcctcctgggttcaagtgattctcctgcctcagcctcctgagtagctgggattacaggtgcccaccactgcacctgcctaatatttgtatttttggtagagatggggtttcaccatgttggccaggctggtctcgaactcctgacctcaaatgatctacctgccttggcctcccaaagtgctgggattacaggcctgagccaccatgcccagccatttgtcttctctttcaatgcacaaaaacaggaactatctctttgctgggttatatattcaaattttaacacaccaaattatttcttcttgtgggattaaagttttagataatgctaaagtcagtgaaagaaatatttactgttttcagagcaagagggattgaatggagagctgtggcccacagtagaatggatatttaagaagcatgtggatgttcctggttagaatgttaatccataagaggcaaatctaagggtagaaccacagaacactagacctggaaggatcttagaaatcaccttatccaagttatttactttcagaggaagacagagacatgaaaaagagagaattgcccaaggccacacaatcaggatgaaatcatcaggagtagaattcaggtttcctggctttcattgttttataaatgtcttgaagcactgacttaaaaactgagtaaaatccacttatttcaaagaatacttaatagcaaaacttctaaataacctggtaattacttgcagtttgtttcaatgatttttttaaaaaaatgaatattacctatgattatgtaagagtagagggcagtggttctcaactggggatgattttgcccctcccacaccagagaacactggcaatgtccagagacatttttggttgtcacaactggagagggagaagggaaaggtactgggatctagtgagtaaagaccagactgtgttagacatcctataatgcacaggtcagctccccacaacaaagaattatccagcccataatgtcaacagtgccaccattgagaaaccatggcctaggtgcatgaactttgaggaatgcaacagcttactttgttcttcccttttctttttttcttattgatctaccatggttctaagaagaaatacctatatatcaccatggttgatatttgcaaaaaactctttcaaagtatgtgaactattgcagatgtttgtaaatcctggattccaaacatggaacccttgtgtacttgttttctatagttaacgactggcactgttcagtgacactcaatcagagctgatgctggctatgagtacagcatgaccatgcaagctgacactggctgaattcaaaccttcttaagcagatgaacatttatatgtggggagagacctggaagacaaactggaatctggaagggttaggatatttggcctagtcctcacagaggggctatgtatgaggccttcgaagttcactggttctgataaacactacagtttcttgagggaaatcagataacgcaataatgcactgcaccccaagaattaggcattttcagacttcattggttttctagagaagtctgcttaatcattatatcctgttgcaaacaaaccgctagactgacaataccacccaataaaagaataaaatttgtccatctatcattaagataattgttattgattagtctccttataattttctgccttttgttttcagatattggctataaatcacagccacaacaggcactgagcctgtgtttgtgtctattatgtggtcctgataaggccaggcagcgtttttcaccttcctgatgcgagttattgagattgattgaagcgctttgcttgtcctatcctagacactgtgtaattaatgtttcattatgttaatacatgcaaatgtgagagtatgtgtttgattgggaggtgagagaacaaaaaggattaaagagttcactccaaagtacaaattaatttattgcattgctaactgtcctctgaggaatgagggagtaggcttcaaaatgaaaggaaaaaaatgcacaaagagaaaatgctgttgcaaggctgtctttcagaggtggtgtagttaatggttacaaaacagatattcagtcacatgacagagaccttgcctatgaagtggtttcagcatgtctccctctatagtgaaagggtttaggacagggaagccaaagagtattttctctttacatatacaagcatttctgcatagacatagtatattagaaccatactatattaatacagtagagtgatctttcatatgtaaacagcgattgacttcatgacattatttgaggtgcagcaggaaggaaattttaacccccaaaaaacccacccacagatctaccacaattatatgcatattactgcattttcttccttgtcttcacagtgataattttgattatttcctaatatattaatatataatgctctgtgatttacttatttccttaatgtcagacaatcaatatgtttctatttgtctggatttgctatgatagcaaatattttaatgagcactgtttttgtatatacagtaatttttgttctattgaattattttgctgagatagcttcttaggagtggaattactagagcctaaatctttttacggctttctatatgcattgctgttttagaaaaattcccactcccaatatctagcatagaaactcaataaatgggtgctgaatttaaggaagcctagacttctactagactatcctaactcttgaggttgccatattaagttgttttagctaatcattccttaatgtgggtaaaagctactgactcctcccatacatacccacgaagtgatggtattttgaatgggttttaaaaataagaagcagaagaaaaaggtggttagaatttaagactcagccaggaagggcaggcttggattggagagagagtactaatagcactctaaagtcactggataaccagggagaagggctttgaaaaagtaaagaattctaaaataatcatggattgtgtcttatccacgatttattcactggaggtattgtagagcaatcattataagatattcacaactattattacgttatgtgacttcatttattgtttatttactttcatttctgatgattaccttagagcagggggcagggtgggaatatgtggtcatgcctgtttcttttcccactgtctatggctgcttttctgctgcaataacgaagtggagtagttggtccataaagctaaaaatagttaaatggccctttgcagaagaaagtttgcagacctctgatatagagaaataaatctgtcagaaatggagattgaagtccaatacatttcaaattcatacttattctttgggcaaattataatttgtcacatcctcaggctcagttttctcctctctaaaaatcaacataacaataatcaggtagttggaaattaaatcatgtaataggttaaagtattggttcatttgttcttccctcttctgaaagaaaaagttcaaaaatgtaatcagtgtttatctagtagttacgttcatgctgtcctgatgtgttcatttgaagattcattagatgtaaatttttgagagtattttgtatgagttaataattaatgtaaccaaaaatgctaagtcaatcttctgtaaatgtcccctgtttgtagctacagccatgcttaactgtaggttgctgatgtcagcattggctgggaaggttgtctgaacacatttatccatgtcaaagcatcaaactcaccactattaagcaaaatggcatagagttgtgagttagttactgaatgtgatggagaagggttctctcctgtgatcctaactcccatgcctcattctgccattattcttcatggtcaagaccagtggagttagcagtgtctaagtgtctgcagtcctttctaacatgattcacgtatcatttttcatagtcacgttgcaaattgacaaggaagtcaatactttggtgatatttcttggttcacagtttccttcagttagacccatcacatttttgatcatttggtctcagttcgttttcagctgcatgttagtgtaactagtctgcagccatccctttcaagttagtgtcaggaggtacaccaataaacaccgcctttttttgttttttgtttgagacagggtctcactctgttgcccgagctggagtgcagtggcatgatcataacacattgcagcctcagactcctggaatccagtgatcctctcacctcagcctcccaagtagttaggactagagctgtgtaccaccacaactggctattttttaaatgtttttgtaaagacatgttctcgctatgttacctagggtggtctcaaactcctagcctcaagcagtcctcctgcctcagcctcccaaagtgctgggattacaggtaagagccactgaatctggcagacattggcattttatccacaccgaaagaagtttccattaatgggtaaacaacattaagatgagaatgaggcatgattctctgtaattcaaatttaactgaaaatccagaagcataagagtatattatacatttcagaaatagaaatgtatattctatatttcaatataattaattctgtttctagtgcttgacaatatttatcactaccagataaaaataaatatatttcaaactaaagtgtaattatgaacatctgtatcatctttaaaagagtaataagtaggtgaccatatatcttaggttgcctagaacaattccagtttatacactttaaaaatatatattatttttattttttaaacttccatgggtacatagtaggtgtatatatgtatggggtacatgagatgttttgcagtttatacctgttgtcctggcttaattataaatcaagtctcctttcagtatcagaagtgtctgaaatatatagtaaattatatgatgatcctagcgatcactctagtgattagcttgaaattagtcaaaagcaaaatgcacaatgtcataattagcctgtccccgtatcatacacgtttttttgttaaattatactttatttgacattgttggcaaaaaatgattggcatgctgatgttcaacagcaatctcatctaaaagctacttttaaaaccttggctgactatgttactgactctatatataggagatgttatcttgtatccaggtgggtatccatgaatgcctttaatctgcagagtctgagtttctctggccctgcatccccataagtaaggtttgaggcctgcagctagcaatccaagctttagacccagtggaaagtaattactcaaggaagtaaaaaatgttcactccttttcctttatcctctttagttcattaagtatgttaaagatggaaagatattctccttctctgagactaacaatgttcaatacttaaaaaaagttaccattatctattatgtattcagcactgctaaacccaaacaggcaaagggatttaagcagaattgtaggcatagttcttaactttgagagtagtaaataagatataaatatatgtggtagatcaataaatattttctgggtgacataaatgtttgaaagccctgatacttgtaaattcttataagaaaatgccttgtttcttcatagattccattatatgtaataaatccaggcttttgataattcagatatagccctgaggagaaaataaaggttttctaattttgtattactcttttaaagatgatacagatgttctaattttgtatccttctccaccatcagctccctccatgtcagacactcagggtcttctgatttgttgctggaagaacagagaaactgtcttcatggagaccttccccaggaattcccttgaccaccctgccaacactctgtgttaaccctaggctcatccctccagggctcactggttgccaacatcagtagtatgataagccattttacaccaagttatttgggatatcatagaatcacttactttgtccctcttcccagattatatatttacatgatgtattagggttctctaaagagacagaactaacgggatagatgaatatatgaaggggaatttacaaggagaattgactcacatgaccacgaggtgaagtcgcacaataggccatctgcagtctgagaagccaggaagccagtctgagtcccaaaacctccaaaagtagggaagctgagagtgcagccttcagtctatggctgaaggttcaagaggctgtggcaaatcactggtataagtccaaaagtccaaaagctgatgaacttggggtctgatgttcaggggcaggaagcatccagcatgggagaaggatggaggctggaagactccatctttttatgctggcagctgattagatggtgcccagccagattgagggtgggtctgcctctctcagtctactgactcaaatgttaatctccttgggcaacaaccttacagatgaaccaggaacaatactttgcatacttcaattcaatcaagttgacactcagtattaacaatcacacatgacaaagaggtttcaataccaaacactccatgaggattttccagaatcacagtagctaagaggcagtctatatcaaatatttcaattaatattgtgtgattctgtttattccatctctgagctggtttggccctacttctttgcttaaacagtgtgagaaaaagaaataacatatataagcagaaaggtgatctagaattaatcctacacaggaattcagacattgacattttgttactaggtcctcttctgagctgtgtcaccttggtcaggacagttaacctctctgggtctttgtccctacctgcaaaataaagttaacaacctttccctgaccaataggatcaaaagaggctgttatcaatcactcttaatttactgtaaacataaaaaaaaaaaaaaacagaaaaatcacccagtgtttgtaagctacaacacaaaccctcagcaaatctttgggtaaccctggcccatgatttaagatggtcagtaattcctatccctaccactagaccatctttgtgcaagagaatggatcttgctgtatataagtgactttgataattatcaggtttttttatgtctacattattcattcctctggctgtgcaagagcgagggcacatttttcatactgttttttgaactgcagagaaaaaaagttgaaagggaaaggaagaacatttcacttacttgattacattaaaagacagtaatagggttggctaatattatttaaaatgtacagtaattatagtttttaaaattacaatcctagtacatattatacaaataaaaatgttatatagcaaacagtgactttttttatgttctcatgataactaattagtccccagctcctatgacattgacgtaatatgaggttaaaagagctacaggtattaggagagaacccacaagtggggcagaacaagagtggaagcaggtggatatctggggtcacatgttgatgaaaagtctccagctgatgaattatgggggaacccacatttgagatagagactggtatattatactcaataaactcagcacactttctgaccttactttggctttctgtctcaaaattgtatataaatttagttctgagtatttcatgacaacacttgaacccctcaatggatttatagtctctatcattcaaggggacttgctgtttattatttagataaattttaggcttttactattcctaaatggtgctcaggagaccatgtctttgctttgagtcttactgattttttttatattagagacgacgtgaaaggaatttgttaaagatcaaataagataaattaatgaaaaacagctggatagaagcacaaccaggaatggtaaatagtggttaaacaactccaagaccccacaagacaccactggtgatactttgacagttccctagctctgcaggacttccagttacccagacatctttttaaagccaatgaaaaaaactctactgtgcaacagcagagtgggctagactgcactgcctttatttcaagaagaaaaccaaagaaatcttcatcttaaatatgtttttcatggaagattaaaacacacttagtaagaccattttctcatcctgtgggagctttttaggacaggatgatatgaaaatggcatgtgttttatgtttcataggtaattggaatacatttggtgaagcccctggaataggtacagcggggagtagtagccttggacacagtgggcatatccagaggtggtgaagacagggacaaggagggaggaatgaaataaaggatctgtggctctggactagaggactgttggagagaatgaggaagccagagagctaatagacatttagtaggtgtttgataataagtgtgaatgaatgaatacgatgaagaacttcacctggatgtacagccaacagaccaatcttttaaagcttataaatgctaaatctattaccaaaagaatggagtgttgaggagagcttaacataagatggcagctcggagctttgatgcccctcgctgtcaatcagcagtatcacctcagaacagggtcatcagactacagcccaaaggagggccaactttggccctctgcctgtttttgtaataacggtttatcatttttacattgttatcttttacatggcaacataagtatcgatataccatcctcggttttgcctcttggtccacagagcgcaaaaaaatttattatctggcccttgatggaaagtttgccttaccactgtctcagaatatgacagaaaatgttatcagtatagatactgataagcatggtttttattgacagtaacacaggcacatcttgcttaatgatgggaatcgttctgagaaatgtatagttaggtgattttgtcattgtgcaaacatcatagagtgtcctcacacaaactttacatggtagagctgactacacacctaagctgcatggtgtagcctattgctcataaactacaaacctgtacagcatgttattgtactaaatactataggcagttactgtaggtaacatgatggtatttgtgtatcaaaacatagaaaagccacgtaaatattttgtacaagagattaaaaatgatggacttatataaggcacttaccatgaatggagcttgcaggatgagaagtgagtcaatgagtgagtggtaatcgaatacaaagacttaggaagttaccgtacttactatagacttcataaacactgtacgcctaggctacaccaaatttattttaaaaattattttcttccataacaaattcaccttagcttactgtaacttttttttactttataaacctttaattttctttctttctttctttgttttttttttttgagactaagtctcaccctgtcacccaggctggagtgcagtggcacaaacatggctcaatgcagcctcaacctcctgggctcaagcagtcttcctgtcttaacctgctaggactacaggtgcacactaccacatctggctatttaaaaaaaaaaaaaaaaaagaatgtttttgtagagatggagtcttgccatgttgctcaggcttgtcttaaactcctgatctcaaatgatcctctcacctcggcctccctaattgtatgtgctagacttttatactactggcagcacagtagatttgtttatagtagcatcaccacagacacgtgagtaatatgttgcgctactacattacaatggctgtgatgtcactaggcaataggaatttttcagctccactacaagcttataagaccactgtcatacatgcagtccgtcattaaccaaaacattattatgcagctcatgactgtactgagtagtctcagtcattcaccaccaacctagcagaattaggtccattttttttaaacatatgttatgatttttctttcactgattgaagaaatttttccaaattattcgtttttgtctatctatgtttggttattcaacaggtatttgttaaatacctctgaaataggcaagggttcccaggggttgtatgaaataaacaatatgattcatgtttgctcccttggagtttgcaacataataaggtagaaattctcaaaaatatgatctgcaacaggaagatcagagccacaagagaggtacaataaagggctatcacttctgagagctgagtctgtcactgctattcagtgaagactttctgtctctgcacaggcctgtgtctaccgtttacattttgtaaaagaggaacctgatgagaatttatgtttactctttggcttaaaatgtatcactagctctaaggtactaccggaaatcacaccatgtcagaggccatgtgaatgccgtcggcactggcccctgcctgctagtatggtgggtccaaggtactaaccaagagctttcttttgcaattgagaataccttcttttttcatatacattataaaaactgctctattaatctacttggaatcatctggggctctttcttttttgaacaacccacatagagtccctcaaaaaccctattgatgctatctttaaaatgggtcctgaatatggattctaggaaaggctctaattagaatatttttagaatttggaacaaccaacgcctgcatgcagtaagcccttttaagtagaggcatgcatatttcttcatctttcagtttccttcaggtgaagacacatgaataggtccttcatccttgaggttcacattagaccatgaataagttgcacatatagacgccagaaattcccttacagttctgaccttctagagaggcttcattcttgctccccaagtcttcccccatggaacttaagtcaccatctataaaacaagttatttgagaagtcctttaataaatgctgacctcgtgagcagtttaaaactcattggtgcttagttccaaagctgatgtttctgttatcactgtgggttttccttcttgataccattcatggactaagcagaaaaatatcacctttctattgagacaagacacagtaaatatcatgacaaaatgaatgacagcattttaatgaaaatcgctatttggcctctatctttagaaaattggacttgttataatacaaatgttttatcactgatgagtccccacatcagacgttatgccacaatgtcaaccatgaggtttgctgaatttttaaggttttccctggacctgtcagacctttgtggaattaatccttcgtatttgtaataggagtttccacaagatgaatacttcatttctcatgaatcataataaagcagcccacgctttgtcagcaaagtgacctctgcagtcttttatcttcaagagaaaagattagactctctattttatggataatgaggtaggttcttggtctcttggcaccttcagtaactgtactctttgtggtcttgtttcagtctgtgataaactgatcagagggtgattatagcaaatctcttagtatgacaaatttcctcctaaatttgagggtaatttttttctgtaagtagcaaagttaataggtgtgaactcatagacttttataatattagagctgaagatgcctccttgttttattaatgagtgaattgattcccagtggtgtagcccacacttagaaggctaacgaggggcagatcagacaaagaactcaggtctcctgacccttgtgctgggagctttcttttgcaattgaaagtgccttcttttttcatataaactacataaattgctctgttaatctccttggagtcttctggggctcttttcttttttgagctacgctcatctcatccctcaaaaccctattgactctatctttaaaaatgggtcctgaatatgatcatttctcatgacctctactgcaataccttaggccaaatctcatcatttctcacctgaacaatggaaatagcctccaatctagtttctctgcttcttccaatgacctctgttctcaagacagcaaccagagtgatcctttaaaacaggggttctcatcctcatcactactgatgttttgggatgggtaattttttcttgtgagggtctgacctgtgcattgtaggatgtgctacgtccctctacatggtggatgccagtagcacccctctcagttgtgacaaccagaaatgcctccagacatcgccagaaatttcctaggggatgaaattgttcctccattgacaactactactttaaaacataaattggacctttttgctctccttattgaaactcttctgtaaatttgacagagttaaagcaaaattctttcacttgcctatgaggtcccattgaatctcactgtgagccctcagaccttgcttgctggaactctctcattcactccaacccagctattcctggggtgggctcgtcacacctgcctgggtgccttagcatcctctgcctgcggtgttcttcccctatatatctgctccacgtctgtgatgaactgagggtttgcatcccccagaattcatgtatcaaaatcctaacctccaatgttatagtattaagaggtgggactttggggagataattagggttagacaagatcataaaggtaagtcccccatgataggattacctttcctataagaagaagaagagacatctgagctctctgtctccccatgaacaaagaagaggtcatgtgagcacacagtgagatagtgggcacttactggccaagaaaagaggcctgagaatgggacctgccttgctaacaccttgatcctggacttcccagcttctaagtctgtgggaaacaaatctttttaagccacccaatctatggtattttgttatggcagctgaagcagactatgacaatatccttcttcacaatattcaggtctttgctcaagtcttgccctcctcaatgaaaccttctccaaatcccacaactccttcctttccctcttgattttcttctatagcacttagtctcttctgacattgtacatattttctcagttagttctttattgtctgttccttcctactagaatataaaacctagaaggatagggattattaggctgtttattattggattcttcaaggctgtttgttcccagccttgaataatgcctgatgcagtaggtgctcaataaatattaggtggatgaaggaatggcatgaagatgtttaaatatcttttacaccactgctaagcattacagtaaaaacaaaataatattacaaagtttatggtttcaattgcattttgtcaatgcaatatttttcctttggcctttaaagcaaaatttcaaacttactaggcttactgacaaagtgctaccataaatgtgccactaaaaagcaagcaattttccaagtagaagtgagaactatgacatgtagtatgaatgagttcccctttgagaaaacctaaccgaaaacaatccaattaagaatgggcgtagaaggatcctgaaaataacaagtatcaaatttgaatataaaatatgatcacaaccatgtggataataaagcaaatcattataaatgaagaaataattaatttcctggaaggaaatgcacagaaactttaacagtttctgttaaaatgatcattattggataagcaaggttatggacaattattatgatatatgattttatgtccatatttttgtattgtgtacactaaatatgggtaacttgataagagatttctaaaagttgattggtcacttcacaataaatggcatctccaaagcttgtctacttggctgccatcaaaatggagaaaatctcatgcactgggtactccttaaatcacactttttctaaatactcacaagagcacttcttagtgttttagttgacagttctgcatttataaaatgccatccctctctctacttagagaaagactgatgaaaaacacggaagctaaagctagcttatatttcatcaaactgagagggaagaaggctcaaacccagggcagattaagcaacacatcaaagtttctctttttagtgttaattttgtatgagacctggggcatgataacctacatgtccggaaatgttacttgttgggctggaaaaaaaatttcattacaattttcctggtatcacacagcaaaatcaaactgcagcttagagagttagctcttggggcaacaaaggaatgaggaagttactctcccgctccaacttagcccttattattgttctttaccattggatttagccagaggacactcaggcagttgcctggggcacacacttcttgccctttaaaaacctcagatctctgcaaagcttcttcagctttgtggaagatgccatgtgctcggaatgtcggatgtggagcctctgtgtgggctcactaagagatttcagctgggacagttgctttgtgaactccacatcttacctttatatttccaaatttagttccctgtaaagggaagagaaaaagaagaatcagggtatcaagagcaaatcggttcagcacccttttgctgagaatatttggtggtgttgcacttggtcagcaaatgtcctgacactaaaatcacttcctgattcagtcatgctagctttccaagaatttactcttctctagatatgtgacaactgaggagcacagtaggaatttatttgctagttgcttactttagctatggtcttaagaaggaatttcatggaggataggtttctcagataaaatacaggatgctctgttatatttgattttgagtaaataacaaataatattttagtataagtaggtcttatgcaatatttatttagtataagtatttaggacatgtttatactaaaatttatactaaatttgtttttcatatgaaattctaatataacttgtgtccttaatttttgttcactaaatctggcaactctaatgagggagaaactttgactgttccttttaaattttcacttaaattttcatccatagcttccctatattttaatgatccttaataaattcccatagtaaaatgtatatgttttctttcctgatcagcctttttttacattatttaagttcaggaattaattccacataacttaattcatttctgatttgcattttttagtaataaaaatttgtcttaaatggctttaaagtgttagtctctggcaactgtggaatgaatgtactcttttaaaaatatgaccatgtattctgacaatattttttaatgtcttatcaaagtgaataaaatggcaccagtgcttcacagaaaccccaatagtcataggtgctggtcctttggtgagtgcacactttctctctctggtctagcggaaattaaagtcttccattaatgggaaatacacaaagcacaccctcaggctacagcacagttaaatggctattgtggttttcccatctagagactaaactagactaaggggcagatcagcctggtaagtgtctacaattatattgtggaactaaaatggaataaaagaaaggcaatgtgataaagaatactggatgaacccaaacttcttttggaagaggcttgtagttattgtcactgtttagaagaaatcctctcatagccccttatgtgaagaatcaagaatattccaaggaatattctaaatgtccaaatgaccatggaagtttaattttgcttaatggggtaaggccatttggggcccaaacagtgtgctggttgtaacagaggaaagattaggtattgtaaacaatagtcctctttcttgatcctttctccacttcagcctttcaaagagaaatatataataaatattaataaaacgtgttgaaataagtgttcaattatttgcctttctagattatccttctaagttcacctacttacttagaaaaataatcaacccaaattacacaaattcctcaaatatgaaaagtcatggcaagatagtagaagggacacaagaacccccttgctccaatccaggccaccagatgttttggagcaaagttctagagttttagttaacgtgagaattacctggaagacttcttaaagtacagattgctgggctctactgccacagtttctgattgggtaggtatggggcagggcctagaattgtgcattttaatatgtatttttatttttaattggcacacaatagttgtacacatttataggatacaggctgatattttgttacatgtatacaatgtttggtgatcaaatcagactagttagcacatctatcacctcaaagagttatcatttgtttgggttgggaacattcaaaatcatttcttccagctatttgaaaatattcaccaaattattgttaactttagtcacagtacagtgctatagagcattagaacttactcctcctgtctaaggggtgtaattttgtattccttaagcaacctctgtctatcccctccctacccttcccagcctcttgtaaccattgttctacttaacattgtgcgttttcagcaggttcccaggaggtgttgctgttgctagtctagggactgtactttgagaaccactgtttcagaatttgtattctgatatactaaaccaagtgaagttaacatatgcttagggattctgttaattcatgtttgtttgtttttgttttttaaattcctgctccattgcatggcctcataagtattataatttttttccagggctaaagaccagagttaaagttgtacatgtaattgatatttgataaattgaaagtagattatattgcatcatccatagaattatttttatttccttcaatggaggtctctttatttgtcttaagccaaaagaagcaaatgtggtagcatctatttctaagaaaagatgatagtggcatggttttctgggttgatatgaagattcacggatcatcagaaactctaagcaccccaaaatgaaagtttgtgtaattttaagtgatacaattatgcatagcaagttctatggggatttgtatgacattttctaatctcaaaatcttgtaggagcttttttccccacttccaagctacttcttataaatttcattttgagcttctattgccttaaccagaagcttttacattttggacctggaaagagatttctgactccacagagaattattttttacacttaacaatgtttgatattgtagataaaatgtcataccttaaaaacctcattttaagttagtttgcctctgcgactgaatggtctttggaactgagaagaatatgataaagagagcaagcacaaagggaccaagcttagagaaatatttgtactatttgatcattttggtgagtttctaaaatatattaagaatattctctatgtatagataattaatataaacttgaaatgtctttggcaatattatttctgatgcttatttatgtctgagaaaactaaaacatagataataaaagttctcccttaggtcattcctcaagggtaggccttcttttatatcctcatcaggaagcatggaaggttttgctatcttggtatctgcttacaaactatcattttacagaaaaaaaaaaaaaggaggagaagaaagaggaggtggagaaggaggaagtgtaaggggaggaggaggaggaggaggagaaggcccaatgatgatctgacacctcattacttttcttcagacaattatagataagaaacgctagccaatagttaaatacatatatggctttatgcctatatttcaaccaaaatttagaaatcttcccaaaccaacatttggagggagagagagatggaaacactcatttttatggtgaactctgatgtcagactccgttgtgtaagtttcttaatggatgagatttgggaactttccagtctatttctccacaatatattatagttgtcttaagtaattttatggcagagttcaaaggatttctttctttatgaagcaaggcttggaaatgtaactatttgagggttcaaggggatggccattggacatcttaaaaataaaaccaaacaaaataaacttctccattaggttttcacctggatgaaatcctcaccattgtaattctaatatgaaattctctgcagcattgtaaaatcggaagtttagttttgattctcaaaatgagttcttctgttgccttcccatgacctccttccatgcattttccaggaggtctacactttgaatgaactctgagtacctaattccagactacaactttttgagccacaggctccgaagttatttctacttcttgtcttcttcagttttatcatctctgtcttcctctcttcatacattaaatcagcgtagttgatttaagattaatccttggatgaagtcattttataaaattattttatattaagaaattatatactggtgggcaaaatctctccaaatggaaccagtacactaagagaaagggttgagggggtttatctaaattgatgtcaatgtaatgtattcgtgggacatttcttagtcctgtgtgcaatacaaggaagttaaaggtagccttgcctaatgacacggtatttttcagtgccgcttcgccagccggaaatcttccacaacacgcagcgctcctgcctgggcctcactgggttccgagctggccgctgagctggttctgcccactcagtctgacaggctgcggtcggctcgtgctacgacccctgatcccacgcccaccataggcgtgccaggcatggagcggtgaggggtgtgtgagtgagtgagtgcggaatccagccaccaccgcacagagccaggtgcgccagctgctgcagtgcggcaggcagctttaggtgccggcacaggcgctggttccctgtgaggcggcagctggaccaggcatactgcaagcaaattctgccttcgatgctggtgtctggactgggggaacacggtgacacccaaaaaacttagagacgccaacaaccacagagccccaaaagggtgttacagcatgtcaccgtttgtttgttcccgtagcccagcaaacaagggtgtgtcagagctctggctccgggagtcccaaggtctgcacctccagaagggttgcagctcttctctccttcctgccatatgcagcacagtgaacggggcaaggggtgggcaggagtgtgtttcggctcctttgtgttacagctcattcagtcctgctgcactactctggcccacagctcttgggctggcccggccccactgcagcttcttgtcgtcttgggtggccactcgggcagcagtggagggctggagggctacagtgttacagctccttttgcacctgatgttcaatgggtcccaggttcttgtcctgcatccaagaagaatgaggttgcttggataactggagagtgagcaaggtggagaaaagttttactgagtgacagaacatctctgggcggagaggcgatctgcagtgggtagtccccaggtgtggctgagtctggagtttttataggctcagaatgtgggaggtgcagcctgtaggtagccatggaaaaggcaatatttgattggttaaaaagcattattcaggctggacccattggctcatgcctgtaatctcagcacttcgggaggctgaggcaggtggaacaactgaggtcaggagtttgagaccagcctggccaaatatggccaacatggccatctctactaaaaatacaaaaattagccaggtgtggtggcgcatgcctgtaatcccagttactggggaagctgaggcaggagagtcacctgaggcggaggttgcagtgagccaagatcgcatcactgcactccagcctgggagacagagccagactccatcgcccaaaaaaaagaaaaaaaaaagaattattcagaaagaaccaatcaggaaagaacaggcaaacaggaacagaagttctcactctggtcacagactccattcagaaccagcagcccagttttcaggctttaggcttttttcggcttgaaggttgggtttcactggggacccacccctgtctgcctgggaatttgtctgcctcctgccactgtcactaacatgagctgaaacttagaaaaggagaccaatagaatcatatctactatttctcaattaacttgattcaccaggatccatcttttctataaaactaatcactaatgcaagttacttaaagcagtgaggtgcctatatcccaaagccatatattcaaaatataattgttataaagagtacaaaaagctcaaattgccattgaactgcaagggtaattgtgttaaagttgatctatgtactcacagcactgaaaactgtcataatctccttgtttcagactaagtggattatttatgtgtgataatgggcacatatgctcattaacatgctgtcataaacagctgtgttaaatgtattatgtgttctgtgacataaataaggtgcttaacatgaggttgtgtttaaaatataggccccaggaagaacaaaaaagcaatacatgctttctaatatagttgcctgctcttgaatttcaaatttatttcttctttattaatgctacttgtatggaaattgtgggtattactctagcgaaatatcttggcattcaaggacattagaacttctttctgctgtctcatccttagtgtttctcaagccaggtttgctagcttgtgtttcttttctggtagaggaagagatcacgtagacatgggaaaggtattttcagcaaaatcagccttaagtgattcagcaagcttagagcagggttcatttgacagatgctctcaattcaatcttgttctaaaagcctccaaactagatgttgaacttagagatcatctagttcaacttcttaatttttgcagatgaaggaactgagtttctgagggcttaaaagacctttctgagtcatgaattttgaagtgataaaaccaagacctaaggctagatatccagacagccaattcaatgtacttcccactagaagaacaggatgtactataattgggttgactacaccaaaaggatctgtggggagaaggagcttatttgaaaataaagacaccaggctgctgtcatctgggatctttatcaatatccatctataatagagttatgtgctcaccattattttacaatttatattaattcaagcaaagttccagatgctttctgagtgagtggccaaggtgaaaggaatgaatatatgacagtgagcgacacaagacatcattgggcagaataacagacttcaaacgtaagttttagaaaaattgagtatgcaggaacgaagcaaataaaaccagggagaaaccgtaagaagctgttctgctttctcttcactgtaaaatggggtgtacaaagatagaaatagttctgtccatcaggaccagtatgagttaaccccttatgagaatatggattacctgcaatttagatgcctgccttttaaatgacagaagattggaatgattttacaaagtacaacgaaaagtgttcccattacagaaaaatgaaggaagctaatgaagtcaaggttgctatcgtggaaaaaaaaaatgaagactaaaacataatttaggtggtattttttaagaaatgaaatgccatttcaaacaaataaagggctcttaaagaaaatgtccatctcttctgcattttcacacaaggtgtttcaggagaaaatgggattaaacatcagcaagaaaattcagttagactcttaaaatgattaaatattgaaaacaagataccgagggacattgtagaatctctagccccaaagattgttcaaaatgaaattgaaagtaatttgacttgaatgatttaagtatacacctgtctgagcaaatggtggagccaatgacctcctgaaaccttgtcaaggtctttgactcaacatgtgagtattctgtcaaatgctatactgccagcttcaaaaacaatatactttaactgattatacttgcttcctcccctcaagattcttaaatgaatttctattacccttggttgattctttatgttcatttacgtttatgaaacaaattcaactgtaatatttatttagatttccaagcccatgagaaacatttggatgaaaattaagacccttcagggatttgtgattttaggtagtagctttattgacttgcttctgccagtgggatttacctattttaaaacccacctgagctttgtcctaaataactttgcccatgctgttcagagttgacttttattcttatagaaccctgtatcagattggattttttaaaaatttcaatggatgccataatcagaatgaagagatagaaatagtctccccaaaagtcttagctaccacactaataactattgctactttaaaatatctaattttatttggaaaatattagttttttctgtctaaattttcatgtactgactgatatgtggtaataagcatgccaggatttatatgaatttgtaatttctcataatattaacttttggagccaattgttttcttaattatgattacctcgactgggtacttttttgcttatttaacataatatccttgattttagtttttatttattcttggacattgttcaaagccctcagcttttgtgaaaagctttgtaaagaaaagacagggaatctaagcctgagatttatttgaatacatgaacatatttccctgtgctctcttgttccaggttttcaaattaaagctttcacagcactgcgcttcctctcagaaccttctgatgccgtcacaatgcggggaggaaatgtcctcctcgactgctccgcggagtccgaccgaggagttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcaggtaggtggattcttccttctcttcctcctcctccttcctctcttcttcttattcatttttggggatgagaaaataatttttgtagaaataatgtacattttaaaaatcttttaaattttaagttgacaagtaattatatatttttatgaagtacaatgtcatgttttgatgtatgtatacatcgtggagtgattatatcaagctaattaacatatctgtcaccacatacttctctcttttctgtggtgagaacatttaaaatctactcttttagcaattttgatatatacgttgctgtgcaatagatattaaaagcttatttcttctctctcactgaaaccttgtgccctttgacaaacatctttccattccttaccacgccccatcttcccaagcctctggtaaccattctgctctctagttctatgagtctgacttttttataatagattctacctgtaagtgagatcatgcagtatttttctttcagtgcctggcatgtttcccttagcataatatcctgtaggttcatctatgttatcacaaataacaggatttactctttttaaaggctgaatagtattccattgtgtgtgtgtatgtatatcatatatacacacacacacatatatatatatatctcatattttctttacccattcgtgattgattccacatcttggctgttgtgaataatgctgcaattaacatggagtatagatatctcttatataccctcatttcaattcctttggatatatacccataagtaggattgttgtatcatatggtaattctaattttagttttttgagaaagctacataaccatttttcataatggctatctaatttacattttcaccaacaacgcacatttttaagaaaaaggaaagatgtaaaaagattcatgtttattctgtcatggatttgactgacctttctccttaaattatcttagaaaacagtcataggacctcaactggctgcgtaaagttatgagattatttttttaaacaaaactgtttcaagttgacttactacttatatctaagggaggacttctcattaacagaaaaatattagaaaatataatttgctaattttactttacagcttcattaaatgctaaacttttgcagagtccatttttttgttgtggggccttaagaagagtaaattttattttaattatagtggcatggcctacaacatatacatgtcaagtaagaaataaaaattccttctagtgcttccaaatttcttaacgcttggtaacatgttggctcaacagctgagtaataagatgaacagtttttgttttcacctggatacactgaagtcatgtagactctgaaaaaatggtactgaccattctggaacccatgatattgctatttctgccccactcttctggttagaaggcagctcataattatttctgttggcccctgaaatgttagacctgcaaagtgaagaatcagtttttttacttgtttctataaagatttgaccaaaacctgtctttttttttaacttttatattgaccataaagcaaggcaagcagattgaacttgaaataaatttaagttatgaatgggtaagcagatttgaagggctgctttcaacgtaatctttagttctcaataaaaacaatattgaatcataggctgtttagtcatttgttatgggttttctttcccaggtcctacttagtctagtctcatcttggaagactgatcagaataactcattttcatcaataacaggacaattgggcagaatcaccactccttcatgcactctcctagtgagggtctgagaaagttgaaatctgaaagatgtgattttgtcaggtggtgctataaagaattacatctcatagatatgtggttaattcccatatgtagcttcaaaccactcttctgtagcttttctccactaagaactctgtagactgaatgttttttctccctaaaatgtgtatattgaaattctaacccccaatgtgatagcactgggaggtggagcctttgagagataattagatcatggggtggagccctcatgaatgtgattagtgccgttataaaagtaaccacagaacacccctgctcctttcaccatgtgaggatacaatgagacgtctgtaatctgcaacccagaagaggaccctcatcagaaaccaatcatgctggcaccctgatctcagatttccagcctccagaactttgagaaatcaatgtctgttgtttacagcctacccagtccagatactttgtgatagccacccaaactgatgaaggcagagttttccatagtcagttaagccagattttacctagaggtagactggctagccattctgcttttctttggactgacttggcttttgcacttgaaagtcccatatcctgggaagccacctcagtgccaggtaaaaccaggacagtgggtcactctacctcaaagtgtccctggtctgctttagcaatgacagactgaggtgcagatgcagaaaaccccctctactcaggagacaggccaggtgacatcctgatggtgaaaatcaaggctataaagtaactggaaccttggagtgatgagtgtctgaaatttgattgatgagtataaagtgtagagagaactgaatgttaatgttaattatgattgattaggagaaacaagtggaataaatccttcagatttggtaaaagcagctttctcagaatgctccaaatgaagtggaaaggggacaatttgactttcagtcactagagaatttctggcctcatagatcccacccatcagttgtccacaaggccagaggaggtctgctgatttgaatgaagcaggctgatattttgatgccttattatgaaaggcagctgcctatgcactgttaatgaaaatggcctgttacattgcagtttcagtcttcatgcaatctacattcacatttacatgtgctgtctttcagtagtgaaatgaagaagagttccttcgctgtgagatattaaaatacagtggcttggactttagtattctgtacaaggataggcacacggattcagtcactgagttaaaatctcatattagattgtatcatttcaaggcaataaggctgttcacagcattttaaacacttaccatgctgtttggcaacacagaatacatcaatgttatgtctgctgaggttaagattgccaaaccactagaattcacaaggggcatatatcttcccagtaataaagaccatggacctgatttaatctcagttttaaagcattagcactcaataaaccagtcaccactaaatggtaacagtaggctttgcttgggtaaaacaacaacaacaaaaaaatgttttgtactctcaggtgctgtatagagcccatattaaataatgtccctcttccatttttgctttctcaaagtgtcttttgataaaaagaagtgtagcaaatgaaatctgtctttaatcagtcagcacattttacacaatgatcttgccatgcaccattcatcctattttctaggagcttctcaagtgctcttaaaggcttgagtgcacacttggctggagagggaaggaaagtaggaaagataaacgaagaactatcattccatccaacattttcttaaaagttgcaaagtaacaggctactgactctcagtatttctagtcattttgagttctatcagtaaagaatacctgggctattaagcctccatttgaaagcaacttcatcatactggctgaaatttgggaattttatttttatccaattagctctaatctaaaatgctgcagtgtttctgtgccatgtatacttctatttagtcctctagattgagaacagctgaagaagggaagcagcgctgaacttatctatgaagctttcctaccatcccctctactgtgtatctagcaaagtatgtcatgttaatagtagacatttgccttaccaatgaagacctggggctttatgccatataaagagagctttccgctgttgccatcctcctctctacctctccttctttgtctcccttctactcctcctccttcttcactggatttcagcagatcaaactcacccatatatgtgcatacataaacatactcttaacaaactgagttggaataatttgctttatatctcaatagcctacaaattaattaactattgaaaactttgtgattagaaaattgactgtttgggaatattcaagtgccacttaaaaaggaaaaagcatgagcatttcttcattccttccctaacccttaccgtgaaaatgaacttgcatctggccaagcacatcttccctactctaaacgttgccagctatctgagcctctggagtattttctgttcagcagacataataataacctacctcccaaggctgtggtaattttcaaacaacatctaggatgtaaagctctagtgcagagtagattcttattcaatgacagccatagtataaatagaactaacaattattattattgtgttattttaataattattaggaatgaacaactttcaatattcccatgtgatgatgcaaaatattttttttcagggcaatgaaaaataggcaacaaatcctgagacatacatattgtaatcttggatcagatatctgcctttgcaatctgtgaacacaaactggcaagcctgaattaagttttcaaaaagttaaatctatgggagattttttggcaagcagtgcccaaatcccttggaataaaagattcatttttgaccactggatctactattatgttaatgcaatcaatacagtttgtactgaccagagcaggcgtttgagattgagtgaccttgcaatcatttccaaaacatgtacagggcactcctctcagccttcttaatggcttttcaactgaaaaagattcactgaagctggttcatgggagttcacttggtctcgacttggagtttaacacaactggtaccctcctggggatgaggaattaattctaatatgtaagaagactagataacaatagatttcctatgaataaacataaaaatcccattttattttgcttttttatacaaccatgaccccctgtccacccttccccacacctacccacccacacagctccttgtccactgacttgccctgcacactctaaggagcacggttggagcctaagtggtacttctgcttgcatttatacttctggggatggcgtgggacaggctcctccaagggtaaagcaatgttgactgctggatacattatattgtatttgtgtccaggtagatttgtctttgttaatttttcagcatttacattttaacattaaaaccactgacttgctttttatagcagtttctgcttcagaaagtgaatctctatacattaccttgtaatgctcagaaactgtgatttaagtacccaaattgacaggttaagaacttactggaaaaagctaagagctctatggccagagattgggacttagatagtctaaatccagatgcacacttattcccttatcactttgcttctcaatctaaggactagatttcagaacgctgtaaacaatttcttatgtaatcagtcatttatttttaatcaatgaaactctccacaatacaaattaaggaaaataacaataatggtaataatgataataataatgaaaatcgatttatccacttagtcccttgaaaatgtcaactccttgtgggaaacactatgatttagatgttttcttctaagatgagaagattttgctatcatagctatacattcaatagtgacacatgacaaatctgtgtcagaaaaacagacagcatataatttttaaaataagctcataaataatgatctttctaggaacacaatttggtaatcttttatctttctaagtggttttacaattcaggcgaagtttgcatattttttttctgcttcttaaaaatcaagaaaataaaaggccaactaaattgcatttcttgacttgttatttcattcagggacatatttttttcttccctattacaatagatgttcaagatgcaaattgtcacactctgcttttaaataacacctgcattataattaaaattcccctgtgtttttaaaaaataattaattacttgaggagttgtttcagtgaattctcttctagaatgcctcccatttaaatgagttatgaaataattagtgaaagcatattatggtgagagaagctagaatgaagcattttgtgaaatgataacctgacctttatgttcttacttaaaagaacctgaaaaaaaaaaaccttaactgaagagaaggaagaataaaccacattgcctcaggtcactcaaatgttatataaaggaaacaccaagaaaaatgtttatattccttctctctacaggagcaaatataagaattttgcctagaaggtcaacttcatcctgtgcagcagtctggaaaatgtatcccagggcccttgaatacgctcagaattctatttgggaaggtttggttacagtgcagagctttccattttacatttatagagatattgtttattttcaaatgataagcagaaaattaaattgctctgactctgtaattcttaatgacttaatgatcttcatttagctaaatgttcccattgttttgtagttaaagcatgagagaaagaaaaaataagaaataaatgtggtcttataagtaactgttatatgtttactagtcttatcatttttctttaattttattgctaaatcaaattgagatacagccatcaccaatatttccccaacgcctattccatcacacagcccccacaccctcaacttaaataattgcattttaaagagtagggttttagttgcctccttcctaagtcaattaactctgcaataaaattaaaatacaaatatattcctgaaaaatatgcagagtgaaaagacatcttctacattataaaatttacaatagagaacttgacaaggctttttatagtagaaacatcaacaaaataacctaaaaaaaattttcaacctttcatttccttttctttgttatgaattctaattcatgtgacaatggaaatagctaattattcattctaaatttaatcagtatcttaagagctctgttcttttattcaactcttaagctgtctacagttcgattttgctggtactgtaatgaaaatgcaagagaaacatctaacacaactcagtaatagtaaccaaaaactcttttgaattttagaaaacctttttggaatacaaaaatttaagtttcttgaaaaacgtcaagataaaaaagattcaaatcatagtaatgtgagagaaaataatgtaatatctgttcctttacatcacaaggaaaatatattacactgttaatcttgttaatctttaacaaaacacagattaacaagaaaaaagcataacaaatttatttaaacaaagttatacacaagtaactttcagaaatgaagacccaaacccctagggaaagctttatatttttatgctaagtcttatcagagaagtggagaattgtggaaaaacatgattggacagagagcatagacaaatggaaataaactgggggaacttgagtaaggtctgattgttcaaataattgtctgcacctctgtatgatattccttcctgtattagtctgttctcacactgctataaagaactgcccaagactgggtagtttataaaggaaagaggtttaattgactcacagttctgcagggctggggaagcctcaggagacttgtaatcatggtggaaagggaagcaaacatatccttcttcacatggcagcaggaaggagaagaatgagagaagtgcagagtgaagtgggggaaagccactcatgaaaccatcagatctcatgagaactcactatcatgagaacagcattggggaacaacccccatggctcaatcacctcccacgaggtccctcccacaacacgtggggattacaatttgggttacaattcaagatgagatttgggtggggacacagaagcagaccatatcacttccccggctatggggcaggactcctgtcacatgagggtttcttttatggacagctctcacatagaaaggtgggagatagtcagagcgtgacctccaaaccaccacattttggtgtagcatgtcctgcaccccatcattaagtagaataattgtagcattacattagatagcacagttatacaattctgatgaaataatgatggataataactttatgaacctatttctggtactgatttttgtcctatttttatgtgtatggtaaaatatattatttggactcaataactgtatacaaacacatttgaattaagatattaatattagatacaaagcttttctacaaagtaaagagacatcaaaacctagagtgtgtcctggaagccaagtaaattaattagaggaaatcatggaaaatctcagtgtatggtacttcaaccatcttaaacgtctactgtcataagcagtatatatagatgaaagtaatgaatacagttagtgaacacaattacttatctccctgtaaaaagttattgttaacagtctttatatttataatctatatctgcatactctataataagcagtctaatacattggtcattgtattagtccattttcacactgctgataaagacataccagagactgggaagaaaaagaggtttattacagtctacatggctggggaggcctcacaatcatggcggaaggcaaggaggagcaagtcacatcttacatggatggtggcaggcaaagagagagcttgtgcaaggtaactcccctttttaaaaccatcacatcttgtgagagttattcactaccatgagaacagtatgggaaagacctgcctccatgattcaattacctcccacagggtccctcccacaacatatggtaattcaagattagattttggttgggacacagtcaaatcatatcagtcattatgcctatcattgctaaatttgcctattatttggtagaggtaagagaataaatcagaaaaagccatttggattcatgaaagagcgagataattttgacctagcaaatcagttgttttggaccttgaatcatgaagttaacataaaacaataacaataaaacaacaatgataaatatttctgatagaaattcaataatcagagtaggtcccaaatttccaaatttatcttttcattctatgttatactgggaatgaacaaacacaaacccatgcacacacacacacctgtgactcttagtgctctagcccagagttctttggaagtttcctgttaaaagacagagccttagcctcaaaggtcaaagcgcttccactgaaaaaccttgtttgaaaaattccctctgtagtctcagctactcgagaggctgaggtaggagaatgtcgtgcacccaggaggcagagcttgcagtgagccgagatagcgccactgcagtctggcctgggtgaaagagtgagactctgtctcaaaaaaaaaaaaaaaaagaaaaaaaaaaagaagaaggaaaaaaaagaatttccacagcatctgaggagcagcttttaggtccacagaatttatcacaggttcttaaccagcgcttattgtgaaatgtaactcaggtatctctaattgggccagatggagctatggagttctaatttctggagggcagttaagcctcaaagtttggtttctcagagtagcatgtctaccttcagaatcccaatgagcatgtgtcagagaaaagtcacatttaaatagtttgataggctgggcatggtggctcatgcctgtaatcccaacatttgggaggctgagatggcaggattgcttgagcccaggaattcaagatcagcatgggcaacatagtgagaccactgtctctacaaaaaaataaaaaattacctggctatggtggtgcatgcctgtagtcccagctacttgggaggctgaggcagaaggatcacttgagccaggagatcaaggctgctgtaagctgtgagtgtgccactgcactgcagtctgagtgacagagtgagaccttatctcaaaaaaaaaaaaacaaacattttttaaacaaaaatttaaaaaatatttgataggtctcagtatatctggggctgggagtggtggctcatgcctgtaatcccaacactttgggaggctgaagcaggaggatcacttaaagacaggagtttgagaccagtctgagcaacatagcaaagtcccatctctacataagatttaaaaattagccaggtatggtagtacatgcctgcagtcctagctacttaggaggctgaagtgggaggttgcttgagcccaggagtttgaggctgcaatgatctatgattgcaccactgcactccagcctgggcaacagagtgagatcacaacttaaaaaaaagatggtcatatatgtgggatatagtttgtgtgacaggatctgtattctatcacatctgcatatttcccgtgatgatctgtaaaggaatgagtttacactatttacatcctaacttaggttacccagagatatttagatataaacacagtacacagacacattcacacacctttccatttagatggctcttcctagataagcttctgtatcttcaatctactgatgaacaccatggtcataaaatctgcttgttgatttataactcctgttcttttcatacacattttaaaaatctgctttaaaaaatcagtttcattgtaaccctgaggctttatcacccttgaaacaggctgctcatcaggttcatttactaagattttacctgaaacacttcaccaactagaaacctatttaagaaagtatgttaaagattaataaagcctatatagcttcaacattaaatttcagtgctggttggttttattggattggatttttgtggtcccttttgcaaaggaattcatctccaaaggctgaaacatgacataaaaaataattagtatttctttgatgcagaaggcacaggttccaggagcatcctttgaatcccacagtgcattgggcactccatgagccaaccttgtggctatttttctaaagttgtttccagttatgtcccagcccaggagtggccaggtttggaatatgtaattgcagataaaataaatgttctcttccacctcagtatacacattgtgaatatctgggatttgtttatttgtttttattgggaaatagtttatataccataacatttaccctttaaaagtatataatccagtcactattagaatattcataaaatcgtgcaaccaccaccactatctaattccataacattttcatcactcctatctccccttctgctcctgctctggaaaacacttatctacttcctgtctttgctatttaacataaatgagattatctgattatcctgtggcttgttttttcacttaatgatatatcttgggcatcttcctatatttgttcttacagatcagtttcatggtttttaattcctgcataatatttcatggtttatgattcacatattgaaagctattctatttgtttctgaatttttgcttttgctaataattcattaatgaatgttcttgtatttagtaaatgctcttctgtacatacctttgacaagtcttcttcttacctagtggtgtaatgacttaatcaaacggtatgaacattttgatagaaactggtatattcaagagcattttattagcctggacctaaacattgtaagccaggatttgttttactgctattgactgagcatatagagctgggttcttcttaacttgtaaatatcattgaagcctactgcctactctgataagaatagtgacgagttgacactgttaatgaatagccataggcatttgtcagagagaatcttatacatggaaacctagaggaatgcatctcatccatgtcctgggtttctgactatggtttggatattcatcccctccaaacctcgtgttgaaatttgatccacaaggtggggcctaatgggaggtgtttgtgttatgacagtggatttctcagaatggctcagtgccatcctcacagtgataaatgagctcttgctttattagttcccaggagagctggttgttaaaaagagcctggtgtctcctccctctccctcttgtttcctctcttatcatgtgatgtctgtacatgctggcttcccttcaccttctgccacaaatggaagcagcttgaggcccttatcagaagtagatgttggcaccatgtttcttgcacagctttcaaaaccgaaagccaaatgaacgttttttctttataagttatccaacctcagacattcctttatagtaatacacatagtctaagacaattttccatgtactgatttgtgtctcttctgctgtctgtaaaaagaagtttctagtagatatcactccatgaactatcttgggattcctcttaggtccaaaataacaatttttcaggctctgtatataatgtcagaccccatagagtcacatcagcataccatagaagaatgagaactctttctggtggcctaaatgtcttttagcatctgagtcctgcctatacctctagcctcattttcttttcttttttttctttttttttttttgagacagatcattgctcatgttgcccaggccggagtgcagtgatgtgatctcagctcactgcaacctccgcctcccaggttcaagccaagtaattctcctgcctcagccacctgagtatctgggattacaggcatgtgctagcactcctggctaattttttttttttttttttgtatttttagtagagatggggtcaccatgttggccaggctggttttgaactcctgacctcaagtgatcctcctgccttggcctcccaaagtgctaggattacaggcataagccactgcacccagactctagcctcatttgtaaccaaatccatactcatctcttcatgttttacagcaatttgataaatgtgcattctggtgccacggctttgcaccctttattctatatgccttattctctcatacatcatgctagctcttgccttttcttcctcagactcagttcttgcaacccaccttcaggaacctttaactggccccctagactaggagaggctccatcttctttgtgctcaccgtaatctatccttccctctgtcattgcatggagcatattacactgtatctttacaaggctcctagacaaacacgcctccttccctggccaaagatctcataaagacacagaccatgttacatttgtcttagcttccctaggcagtgagactccacagaaccttgctagttgtgtggggtaacacggtggttagggacacaggcttcagagctagtcagcctcagaatctatctcttggccattcactagttctgcaaacttgggacaaccatggaaacgttctgggcctagttttttcatgtattaatggctatgagatagtgtctatcttctatgcttattgtgaagattaccaaataatgctgaacagaggacctaaaacatagtgaagcaggacgtttccctgaccccttcactggactcgcaacaggggttcttcctttactcagcccactgctctcaactccttgtggagggagcgtacaagtgaacaagtcagcaactggagtacacaagtgctagaaccagtcggccattttggtgccggtaggatcaaactctaatcactagacctgctgcacacccttcacaggagggagcgcacaagcgagcaggtacaggagccagagcaagcacttttgggcgccagcaggagcaaactctatgcaggccccatggcagcatccaggtggggtgcctgcaattccggaaggcccagagggtgtgttacagtgctttcagctctgccatctgcagacagcttaagtgttagcagctcagtgggcccatagctaccctctgccaactaaggcaaagagccagtgtgacagcctcctgtatctgcactcatggctcccaagctcttgtccagcatccaggaaatataaggttgcatgaataaattgaaggatggtaaatgtgggggattttattgccgatgaaagtggctctcggtgggaagagaagctgaaaagagtacagtgtgggggaagggtaggtaatcttcccttgaagtctggccatctctggctgaattcttttttgaagttatgccatcaagctgttcctctgaagtcaagccacttctctccaatcatccggctgcttctcccctctgctggctgagtatggggtctttacaggcacatgatgagatgcggtggggccatgggtggtttaggaaaaggcaacatttgagcaggaaaacagggatataagttctccttttaggtggtgatttcaggctttttagcttgagggtgagattttgtcagggaccgacccttttctgcctagaatttctctgttccctgtccccatcaatggtaaaagctcaataagtgaggctttatgaaaaacagaaaatcagggtagtattaaagattccccaggtaccttgcagcaaataggaagagagaatccccatgaagaaggctttttctatgtggggacacatatcctgtgtctttgctgctctatgagtattggcctgtttcccatgcaaagtttgttcttccccatctaggtgggccctctgcaaacatacgagattatatttatctttttaaagttcttagcaccaatattgtaggatcaatacttctgcctgaagtaaataggatcaatcaaataatgactgtgctagaaagtagttggataatactcagggttcatgatttttttatttgatgatattgaaacacatctctttaacctcacttagcaaaagtcagaagtaaagtttgtcatggctttgaagaactttctatgggtcagcaaaccttgggacaatttcactacattctaggaaggcatgtaaactacctattggccagctactccaggcagcctttaacatatcacaaaagtaaatggtcattacagacataaaaataatggggtcaagagactcatgcttattatgacttgaattaacaactatgttttcacacaaatcttcattatttataactggcttagacaattatccctccttttacgcttgttggtttcttgtgttcaaaaactgcaagcagttactttattttgcccgaaggtctaaatttgtttcttccaacactaagccatttttcccaagtcttatttttcccttgaatttgtgtaaatacctgtagtacaaacgtttcactttaaaaaagggctttttaaaagccgtttttctaggaaatattttaataatcagcattatttatgttgcctgtgtagttatgtaaataatttcagcctttcctcacaaacaactcttataacttaacatgccttcagaaaatgtgaataagattaccagataatgcctccccagtaagcatgttagcacttcaggaagaaaatgtgagtgctgagttgagaatgtgtgttaggcacaatgacaataacaaggaggattacaaatgaaatagcgctacaaatagcaccacagtttggaggaggaaagcaatttggtgaagtgaaagatgttaaatgttttaattttcttctatgccagtaaaatcttgtaaaacaaggtgacatattaaattttctatactacagtctctccaagagcctgtcaacattttcattgtaaactctattttcagagctttataactcagcattaagaattcactctggcttgacatttagagtgtaaggtcttacctggggaacatgtgtttcatatgttttaaaaattacgagtttatccatttctcagtttataatgagtaaccttttcacactttttcccttgtctgctgtgcctcagaaattgcagggagaaggcttacctatggtaaatcgccaatgggggaagaatctacagatgtggtcaacacaggtcagggctgctgattttcattactgaaactcacaaagagcttctgtagaaagcaaagagctctgctatgctgccctcaacatttcagactagactttgtgctatccaaggggtatattttaccacgacaaaaacctgactgattgcagaattcttagtcccctgtctgtttatttcaacatttgtattatgttgtgtctggcataagacctttttctaaagctttacaacatacaccctaatcttgcttctttgtttttaagtcttctttgcatgtgtttgtgtgcatgtgtgtgtgtgcatgtggtttattttccacctttctgtcattatttagcatagggaggttttcagtcaatattattcagtaatacggctaccctctttataccttgaaatacctacagtttaatctctggaagaattagtttttagaaagttagaattagaaaagggtgagggagaaataaacaaggaagcaacagaagagaaaaatatctgtggccatttgatatcagaccttaaaatgtcttgaggactgagtaactaccatggcttcccaaaaggatcatatgtgggttgtctaggaaaaaaatggaattccttcaataaaatacatggtagcaagtcttcagttctaggttatttcaggagaatcctagaaaatcatcacttcctgatatgtattgagaattatttcactcccacctaattgcattgtattttacatggctgacaaattatcttccaaagtggatataccattttgcatttccactagcaattaatgacagtttgttgctccacataaccttcatcatttgatgtcagtgttctgacttttgggcattctaattagacgcatagtggtatttcactgttattttaatttatcacttcctaatgacatatgatatagaatatcttttcatatgcttatttgccaccagtgtgtcttctttggtcagatatatgtgcaggtcttttacctgttttaaaattgaattattcatttttttctgagtgttaacaatttttgtatatttggtttgagagtcctttatcagatacgtcttctgtaaatattttctcctgttctggagcttgtgtcttcattctcttgatggcatccttcatggagcagaagtttttaattttaatgcaattcagtctatcaattatttctttcaaggatcatgcctttacatattgttgtatctcaaaagttgtctaaaagccatctctatacccaagatcatttagactttcttctatgttttcttctagttttatagtttcatattttacatttacatctgtgattcattttgagttaagtttgtgaagtatgtaaggtctgtgtctagattatttttcttttgcatgatgatgtccagttgtttcagcatcaattgttgaataaaactgtctttcaccataatactgtctttgttcctttatcaaaaaccagttggctatattttcaaaacatttttagtgtgtttatttctttccatgtctattaacaccatccaaacagaaactgccatcatctcttgcctgcttctcctaaaacagtctattaattagttgacaatatatttcatacacagaggagagttgtcttttaaagcatttgaagttggtggatgattttccactgcttttaggatcaaatataaacctttagtgaaatataaagccctgtggaatctggcttcctcctgccatcccttctctctcttttcctctccttcctccccagccaacttcatttctgccaatttcttcataatgctccagccatatttttttttcacttccttgagcatgtctcacttcctcccacatcaagtcttggactatggagtaatttcgtggaaatcctaaacgcagctgcctttggtttagctcattgctctgttcattctttaaagctgttttgctgtttctttctctgagctatctgttgagtgtttaggtatcactgctaactactatcgcataccatgccctcaatgtccttcataacaattgccaattataatttcattattatttgtttagcacatgccttcctcactagagtgaaggcttcctgagagcagtcagaatcatatctgtcatctttgctgttgtattcacagtgggcacagtattatagtgtctgaatgtcctaccagagtcatgggcagtgactgaactggaatcatcagaactgcagagccaaggagctgagggttaagctcaagattactggagcccaggacttctctattcatctaggagtgaagtaatccaatgaaaagtcaaaagactttagttatcagtgtacagggaaaacctagagaacaaggacttggtgagtcatggaatcttggacttagaaaagataaaagtctgcatgtagaagtcagtagttttaatagtgatctcacattcagagcattacatgattcagggttcatcttccttcgccatccttcaaagcacatagtccagagatcatttcgttttctatacatggttcctcacatgctgaggaagacgggacaatgttcttggcctctccttcccactgggcctccacaggggaaaattagcagcattcattttttccattttaaagaaataatccgcttttcttttcagaaagcagttttccaatgctctgaggtttacgttcatgcctcactgggcctgatttactcagtgtcatctgagcaaagaggcgccctgggatggcccagcattagagctggtgcttgagcccagatgcacgcacagaatggtacatgaagcaggcagaaggtggagaccatatatttcttttaatgcagtaaagaaaaagtattcacatagaatgaatatttaaataaatgagtaatgtaattatttttcagttccattcaattaaaaaatatttattcaaattaaaagggaatatgcctgagccccttactagctgacattggtgatttctctagcgctttctcccttagagagccactagccttcttctccttccagaggctggggatgctctcacttttctttcctatactctatggagggacagataagcaggaaacttcctctacatagaaacactagtgagtcaatttccaaacccagagacattttggtgcattacactcactaatataacatggagacattgttatcagagaggtctctaacaaagttttctctgtgctattttatctatgtgagggaggtgggaatttcttcaatatcaaaaacctcctttaatattgagcagttttttgcacttgatcttagccaaaaggccaagtagcactgaaatgttttttgtttgtttgccccctccacacaccttctctctctagtcacctctctcatattttaattaactcgtaagttcagtgcttctcaaatttggtgtgtaacagaatcttctgtagaaacttgtgaaaaaaaaaaaaaaagaaaaagaaagaacaaggcccaggtgttctatctcagtgaggctgttgtctttattagctccccaggtgattctaatatataccaaagttttaatatgtctatggtttcatgtttacacgagataacactatgctttgttactccataatatcctctttttttcctaatgtggttgtttactcaatgatacattctttttacttactagagttgaatcatttttgattcttggaagctattaactatcagattctctttattagaagttattgtcatgacaaacacttaggtaaatggcgattttgtcaatttatgctgaatatctcttggtttaggaactttatgttaactgttattcttttaagactagaccattgtaccatgactaaaaacagacagtaaaccatggatatcaagagaataatagcgagaggtttgtaagtgtgtattgtggggcaccagcaatttatttttcagaaagccttattaaatgcatctctacggattgccatggtttatggcagaagtgatgtgatgatttgtattagagttttaataagtttagagttgaaaaatttattctgctttcagttccttccctctggctgacagttaatgtccaaggtacttaatcagagaaactaccatgggaggtctaataatactgtgcaacaaagggaaaagcacatctctaggatcaatttcagagccagctgtattttctccttaaagaaataataactcaaatgagataaggtcctgccttcaaggagatttcagtccagaaaaagatctgatccatcacagtgcttttgttttttattatattgggtggtgttttgtctttctttatttctttctttcatggtaaggactcaatggaagctgaaattccccgaggagtgttttagcatcttatctctagtttcttgcctctaaaagttgaagttacagtagcacagtatacatgtttctccttcttgcttatcctggagacttcctgcttaaatatatattgaaatggttgcaaatattttcattgccaagaaaataaactgcaaattgtttggttgtttggcattcagagtgctatgggcatagatccttgatggcagattgactgtatggctatagctatcatatgatgactcttcaatccctttatgacttttatgagagaaccccaccacatcctccagaggctgctgtaacgattaacagcaactgcaaataactttgcaaaaggaaattatactttgagtggaagagcctagatttaaggtaatgaaatccctgaaaactatagcctatgtgttaagatttattctttaagttggttagatatcaaactatgattctggcctttgaactcttaatggtgaagatttttatcttacatgatgaacacattacaacaattttgttatctgaacattgagtaagttagtagccacaacgaagaggtcagccttatattttatatccttaactatgagttctatttcaagatgatgtattcaccaaatctttattagtttccccaacaatactgtgggcattgatataaaaagtttataggaattgaaaaattaacccccccaaatatatatctctatatatctatatctatctatttatctatctatctatatattttgagacagagtctcgctgtgtctcccaggctggagtacagtggtgcgatctcggctcactgcaacctctccctcctgggttcaagcaattctcctgcgtcagcctcctgagtagctaggattacaggcatgtgccaccacacctggctaatttgtttgtatttttagtagagacggggtttcgccatgatggccaggctggtctcaaacccctgacctcaggtgatctgcctgcctcagcctcctaaagtgctgggattacaggggtgagccactgtgcccagcccatatatatatatattttttaaaggtgggagtatatatacaaaagacaacaacaatttgtaggaaagataaatcagatacagggggaagacagatgaatcaaggctgttgaagctgcagccaaccaaatttccccaataataatttccacaggtggttgttaaatttaccagtttgtaattaccaaattgttgtggggcctggcaaaccactctgtaacaggggccccagatgcttgtgatattcagaatgattaggtaaactgtggcgtggagccatggctgtcagaaagtgtggtccctgatcagctgcatcagcatcatctgggaacttgttaaaaatgaaaattgtttagctttattccagatctgttgaatcaaagatgatggtggtggagcccaaacaatccatgttttaacaagcccttcaggtgattctggtgcacactcaagtataaaaactactggtttagaccaggcccagtttgattgcagttgatgtggccggctgaatgttgaagacgcttcagtaccaagaaaaaaccccaaggtaggagtgagggagaaagggcagaatgaggaagtggggatattaatgagatatctaattctatcgctgtagctacatcttcttccctgtttactttgtgcagaatactcaacaagtagccattactcccaaggtaaaagaagcagcatcttcttaaaaactgagtagactggagaggtcagagcagcaaagaactctgcattctgttgaaatggcaaaggttcccttgttcccctcgcagagtgtgtgatgggggtatggcttgcttcttcagtgccccgctgctcacccctctaggggagcatacagtcgggtcctggttactgcctgttttctccagccccactcatggctgctggactagcctttgcctgctgggaaaggttaaggagaggtgcccctgaaccatgagtgtctgcggctgtcgaggtgaaggcatatatgacacctctaggaatagttagtgtgatttacaccttcggcagctgagccaaatcctcactttacttagtaacattgctgtagcctgtaccaaaactctttacattgtaaagaaagtgataagagccatttcaaaccatgtgagagaaaagagagaaagtctggggcttttgaccagcccagttagagtggagttttttaaagcccggtgaagggaaacagagcctcttaccagcaggaaaaggtggcagggttttggaggaaaggcagacctgacagtttcccttcgtccacgctcaccttccaggatcctgggtgaggccccagttgaaacgggaaaggttcgcctgtccccctcgcagggtgtgtgacatggggagtggctcgtttcttcactgcctcactgctcatgcttctaggggagcatacagatgggcaggctatggggttccaaccccatggcagtgtctaggggtgaatgtttacagctcctgaagccccagtgggcgtgtgtgatacagggtgctctcttagtttgctgtctaccggaggcttgtgttaagcagctcaagtagactctctaccttgtcgcaaggacagatctttctgtatcccgggttcttgccttggtgtactggaataatcagatcacacgtgagcttggagaatgagtgcaaagttttactgaatggaagtagctctcagccaatgggggagccagaagggagatggttttcccccagagttgggctgctgggtggccccagctttcctccaactgccgggtcaaactctgcctcgtcccgccggtagatggcctgcaggcctgccactattagttggtgtgctcttctgccagagtgctccctcatgccctcttgccatccagccacttgtgtcttcttccgccgatgtgctcctcttgacgtctggccgcctgtgtgtctgcccactagggtctcaggcttttacaggcccaggatgggaatgtggtcttggaaaatgcaacatttgggtgtgaaagtaggagtgctcatgctcacctaggtccgtgagggtggagccccagccagggacctgcctttctctacccggcacttccctgcccccttcatttaaagggtcttcccttcccagcactcctgtatcactgtcatcaagatgttcccagcacaatagggaacttctttctcactcacactacagcagagttggatactgactttctccccaatcaacagacacaagcaaatatttcaactggctcacacttaatataaatttacaacagtatcaccagacatttacaaaatttttgcaacacaacagagaaaggcaaaagtgaacagtagaaaaataaaataatcccaagataattgaaggaaacaattttataataaatactagtactcttagaggaaattgatgaaacattgtacatatttataaaccaataaaagaaactccaaaagaagaacaaaaatgagctcttaaacatttaatttattatatttataacttatagttttaaaatgtattaggtttgttaagaacttagatattttagtagaaattttaaaagaaaaagaagggttcaaggaatacaggaagtctataagatctgttctatttttaaaaaagctggaagaaaaagtaggattaggtcaagagttctagagtatccgggtagcaagaaaaccagaaaagattaaatggaggggaaggacgtttacaaatatataaaataacatccctgagagatcttctgattgaaagggtctaccaagtgctgagccaggttgcaggaggtggggatgggcggggaaagcttatagtggatctactatacgatttaagaaaatgaaggataaataaaagtttcagagaaaaacgcacatacataccaaaacatactcagtctccctgtgactcctcaacaaactaagtgtaaaatcataaaacaatgttccttattactttgagaaaagttttctgcaaactagttatttaaacattcaaactattaatcatgtgagtataaaatacattgtcagatgcacaagggctcagaaagtgtctcaaatctttgctagaaagttaatttttgtaaccacgtatccaagaggagaaggtccttgactagcaataggtttgggactagcatgaggccaaaggtgcaagttcagagcctttttgtgtgtgttttgattttgtttttccattatgggattttttgcatttatttttactttttaaaaaattaccttataaaatgttatttatcttaaaattgagtgttttggtgccccgttaacttttatgtccacacatctgcctcgctagtctcatctcagtcctgtccttaactagtgtatgagtttcctatggctgccataacaaactggatggctgaaaaacagaagtttattctgatagttgtggaggccagaagtctcaaatcaaagtgtcaggagggaccacagtggccctgaaggccatgagaactcaggccttgccttctcaggcttctgttggccccataagttatttggcttgtggctgcttcactccaatctcagtctccataatcacactaccttctcctcctctgggtgtcttcccctctgtatgtccatctcaaaattcccatctgtgtgtctcactggatttagagcccaccatgatagcccagaatgatcatctcatctcaagatccttaattacaaaaatcctttaaaagaaataaggtaacatttacaggttctggggagtaggatgtaaatgtatttttttggtggtggggacaatattcagcccatcagaagcagcaagcagtggatgcaaaatcaggaaataataaaggaacattccagaaagatacctgtgcagctgacctaaagagtatctagtccagactaaagcagaagagaatctaggaggcagatctccagggaaaaaaaaagatttggtagaatcagtgggatgtttgagggagcaaatgaggcgattataaaggcaaatttttttaagtaagaaatgccaagtgtatctatggcagaaggtagatggaaaaatggaaaggagagctaaaagcagtggacaaggacagcagtctcttcttgctgtgtataaaatgaaagattatctaatcttgatagaaggaaaaacaaagagctgcaacaattgtattacttacaagggtttttaatggtcaccaatatagataatccaaatagcaatatactaagcgaagcaaatcgtggcaaaagtgaaccaaatcctcagctatcatactaagaagtcagtaaataatgtctaaagttgaaaaacttaaggaagaaatacactatgtagagacgtgaaagaagctgcaagtaaagttttaaaagttttcgatagagagtgaaactattgtatgcaagtttatttcctttggtgttttaaatgtgcactaatacataaaaataaaagaacttgtaacactttcttcagttgcatgccttgggaatgtcttttaatgaatcttggggtgtctttaataaatagaattttttaattttttgcattgtcttataatgcctatttcactattaaactctgtgaaccgttaacatttttttccaggcattggctgatacattattaaaatgcagtgaaatgaaataacataaaaataaagacattctaaatccaaacaattttaaaatcatactcaatagaccctttccccatcaaattgttgttaaagtttctaaaagcttcctttagatacatatttcccatatctcatactggtaacacaaagctcgcagattttgataattttgagaggcataatttgagtaattgcctagttttttctttttcttttctcgtcattaaagtctttagtagttttgtttttactgtcttgcctgagaaaacctttcctaaaccaaggttgtcaagatattctgttttattatcctctaaaagttttgtcactttattttccacacttaggcatcaaatacacatgggcattgtatatgataggagatagggttgtaattttattttaccttatcaatatccaattgtgccctgctcatcaactgataggatcatacttttcccactgctttccagtgacttaaaaacatatatgacatatcaagagtccattaatgtatgatgtgtttcaggactcagcattctgcatcagtgttctatatgcctagcataaatcaaatgtcaatttaattgttgtgctgagataagttgatgttcttggaaaattatctttcaccttgttcttttcaagtgtatgttggcttctgatggccctttgcatatccataaatctttttttttatactttaagttctgggatacatgtgcagaacatgcaggtttgttacataggtacacacgtgccatggtggcttgctgcacccatcatcctgtcatctacgttaggtatttctcctaatcctatccctccccaagtggcgcataccccaacaggccccagtgtttgacgttcccctccctgtgtccatgtgtactaattgttcaactcccatttaggagtgagaacatgcagtgtttgatttcctgttcctgtgttagtttgctgagaatgatagtttccaacttcatccacgtccctgcaaggacatgaactcatccttttttatggctatatagtattccatggtatatatgtgttgcattttctttatccagcttatcattgattaacatttgggttagttccaagtctttgctattgtgaatggtgccataataaacatacatgcacatgtgtctttatagtagaatgatttataatcctttgggtatatatccagtaatgggattgctgggccaaatggtatttctagttctagatccttgaggaatcaccacactgtcttccacaatggttgaactaatttacactcccaccaacagtgtaaaagcattcctatttcttcatatcctctccagcatctgttgcttcctggcttcttaataattgccattctaactggcatgagatggtatctatttgtggttttgatttgcatttctctaatggcatgtccataaatctttagttgactttgatgctttctccattaaacatgttaagattttgattgaaatgcattcaattataaatttggaaagagaaattgacatctttacagttttgggatttccaatctatggatataatttactacttcatcgtggccttttatacctttattttaagtgttattaattaaccatcaaggtttttcatagctttctgcaggttcatttctagtacatcatatttatttttgcctgactctttacatagtatttttagttgaatttcatctgtttttcctttatatgagattcaatagatatgtagttatacaaattgacacaacccaggaatctagctcaattctgtgcaattctaataccttagcttgacattcttttgaactttacagttttgagattaataaaatttatgattgtcttgtaaaaaattattaattccagtttttagatatctttcaaaatatatagtctctagaggtatagggaagaaaaagtaatattttcctcatcatagcaagggtcatggctgtgacttctattaataaaagataataagagaaaggcattcacatttacttaatctaagttttatatgacacaggaacctttagaactgaagaccccccaaagcagggaaaactgtgtatatttatgcttacgtttgatgaaaattggataattatacagaagaattacaactggaagaaaaaggagtataagctaatggtaagaaatgggagaacttagcaagtcctgtttattcaggttctttctggtgtccttgtgtgatattacttccctccaagtgtgaggcagaccacctgtcacgtgaaggtcttcaggggagaagggaggaggaaggtcagagacctttctgcttttgctgttttctcaatttccaagctgccatactttggagtagcatttcttgtaccccatgagagggaaatataaggagagaagtcttaggtggtgaaaagattgggattgtaagagtggaaagatatgatttctttcttccctcatcattagagttatgtatgacatttctacacaaaagacagattaacaagaaaaaaagcagaacaaatttatttcatcaaagtttttattaaataaagacttaaagacccagggaaagtgtctatttttatgttcaggttggatgaataatgctcagccatgtagaaatacaactggacaaaaggatctgatctaatgataataggttgagaaaggaaacctagcagagcctggctgtttgaattcttcttggtttcattgtgttgcattccttccccgcaacccctgcaacttccttgcaggcaaaggaagtcatagaattattttatggccagttatcacacagaatagtgcgggaagatcagagtgactttcttccttctgagcctctcccaatctatttcagttcaaggtactttgggatagcattctccgagctccaacaggatccaccaaactgctatctgagcttgattacaagtcatcatagacagttgaattttatagtcaacgtgtgttgaatacttctatgcaagtgtcattgtgaccgctgaaagggagtttctcacttagaggagctaacatagtatcaagatgagtaaaaagagtgcctctaacattgtattaatatatatagtattaatatttcatagtctgccatccacttcatcctccagtctgatcagtaacagaagttattgatcatttttcaaaacagcatgggaaattcattttatttatctcttataaagcttaataaacagctatagagatctttatgaagaggactttgtctcttgaaggacaatattctattttagtcttaaaagcattaaatttttcaatttttaaacaaaattctcatcaattggatgttatacccatctatttatatgtgagaagaacaaagcttatattactttgttttttttatactaccagggcatattttaaagtttgaatgtttaaacatacttggtcagttgaagagaatgactttcttcattactgattgaatatacagggagaaattttagcaagaagaatgtatgacttttttaaagaaaataatttctgaatgataaaaaggaccattttcccataaagacagtcaaggtaaaatacaattgagtagaactaagaaaggaaacaacctcttcagttaatgcattttcagagctaagcacaaaggtgcttcctaaacaaaaggatctttacaaatgagggtgctctttagagagaatattttcaaaggacccctatatagttcaacaggctccttcaaatgcagtgcattttaaaagcttagaaagtaatgatatgccctctagactgccaggcaggagttttattgtgaaggttttggcaacacagttcggtttgtagcatccgctttgaactagcctttcatgattctgagacacgtgcttataataataagtatttacaagtcaggagatgaaattcaagtttctatttttatttcccccatcctctcatctcctacattttatatattggacctaccctaagattgcttctgactctgcacactctagtgtcccaaatttattcctaaactctgcctctatcctaacttcttgcatacatactcaccctttctagccaaggacttgcattcaatcccaaatacgctgacctctggaatctcagcctttctccatgtgcatctttcttcctccatgtgtattcacttgaggacctttcatgcttgtgactggctgaacctggatcaattgctctgctcctgcttggctttattccaacctctcttgttcctctctaggttagtgtacaagaaaaatcagcatatccccaataatctgttaagtgagttgtgaatttgagaagttaaggggaatgtattccccattatactcttcgtataaacattttaattttaaaatctgacactctacctagaagaaatgggtggcagatttgcccagcaaggtaaatcatcactatttgttatatcatgtatactgttgaaaggcctaaatgtctttggacagatggtgccctgttagagtaaaggaagctaaaaacaagagatcatactgattcccagtgtgttagatgtttctaaaagtatgtgtatgtcataatgaaaaacagacctaaactaccaatactttcagaggaagcatagtcttagactctatttatcatttaagtgaataataattatacaagaaattcaatttatataagctgtcaattagaatgagttggacattcctacttgttctttttacagcaactgctcttaaaagtggtttaacaccgatttaaactccttgaatacagtaagcatatgtttatccagaactaaaaataatttatactactactcttttttttttttttttttttttttttttttttttttttacaacacaaaggttgaagtacataaaaatgctattgctttacacaaggcagcaaagttttaatcttggcatccacaggtgtgtaatgtgacttgagacctaacaacaccctctaattctttctgaatccttataaaaagtaagttatgtccatgatgttgatagtattattttttctgtaaaagacattgtagtgtttaaaacagatttctggtacagtccttgttctcaagcatttggtaaatagtctgacttaacaagagtcctcatgtctaatccctctaaatacaggcttatacttcactgtatatacaagtgtatatgtgtatgtattatatatagtgtgtatatatagtatatatgtgtgtgtatgtacacacacacttgtaaatacaagtaggtacaagtttatacttcactgtgccttacagggcaatacatacttcataaattgatgcataatgattgtgcatatttatggggtacatatcatattttgatatatttatacaatgtggaggaatgatcaaattggggtatttaggatatccatcacctcaaatgtttaccatttctttgtgttgggggcattttgactcttctaactttaatgtagtctcatgcattttgaaatatacaataaattacatgtttactaccacacactagaatttattccaactgcatatttgtacctattgactaacctctcttcatcctcctcctccacccttcctagactctcgtaactgtcattctagtgtataagtccatgagatcaactttttttgctcccacatgtaattgagatcatgcaatatctgtttctgtgcctgccttatttgacttaacatagcgacctccatttctgtgttgctgcaaataacagaatttcttttttatagtgaatgatattctattttgtatttttataccacattttctttatccatttactcgatgggtacttagattcctatcttggctattgtgaatagttctgcaataaacatagggggtgaaggtatctctttgatgtaccgattccctctccattggataaatacctagtggtgggattgctggattgtatgatatttctacttttagtcttttgagaaacttctgtactgttttccataatgtctgtactgatttgcattcccatgaacagtatatacgggttcaatttttctctacatgtttgccagcagttgttattttttgtctttttgttaatagccattctgactgaggtgagaagatcttctcattgtggttctcattgtgatgactgatgatgttgatattgaaaattttttaaatatgttttggccatttgtatgtcttcttttgagaaatgtctattcagatcgtttacccactttttaatagtgatatggctatgttgcttgggatatgtaccctggggttcatcgtctcatgctgagaaagaactcaggacccagacacatgtgagtgggttaagaagtagaaaatttaatagaataaaggagagaggagagcaggtcctagggaggtggagggggagagagagagagaagagaaggggggagagagagagagagacagagagagagagacatgtccaaaaaagtggggaggtggttgactgcagcagattttataggaaggctggagaaggtggtgtctgatttacatagggctcacagattggttgatcaggcacgaggtttacatagtgcacagggaagactggtcaccccaacctagaatgtaaatggactttccagttaatcgacaccatcttgattcctgttgattgacaccagtaagattggcaccatttgctctttactgtgcacatggctgacaaagagaagggaagatggagctgctatctttaacatgtgtagtccctagttactgctggcattcacctgtgcaagctcccagtttgcttgtctgtctgcagctctactttataggctgctctttgttagaaaatgatttggggctgcttttcattaaagagaaaagcattaccaaagactcccatgcccttactctctgcttaagtaatttcttaagtcctatatcattccaccctctgcagtggtaaccctaactgctgttagagaatgttggatgacaactttttctggctacttcctgctgaaaggggtatcatgtggggaaaagcagctagggctcctcctggggtcaatctaagggtcctcagaagaaaggtgtgtccatgtttgtttggtctgcagcaccatttgcagtttgattgctctcaatcattctaatgggttgtgatactggtttgcctccaccagatgctgctaaatattaatataaaagtaacattcttttttgaataagtggcattggatttgggtggctagagtaactttagtattgaccttggctaaatctttcctgcaattattaatcccctcatgacttctgcagaccatctaaggcatgtttaaactttctaacttctcctaagcatccttctttttaaacaaccaactattatttttaggacaagtatttaccatctttataatcctttcatacttcctttttggtgaaactattatccctgctataaggataataattaagcaaaatactacagcaatggaaactctgtgtccactattccagttagaaggtgctactgtttatagccctactgcaaatagcagagtgagtatagcaaatcttgcaagtgtggtgtagtaggtactttccacataaaatcttacttgtcaagatacagaatttatctttgggggtctatgaagttccttggttttattttcctaaacaaaactccaggttatgggcatcctatttactttcactgcttggcaggatttgcaggataattgctcagaactagcatattaatccagatttttgtgttacccatccctttttgtttcttccaagctgcaggaaatcaccatttgattacaggaataagcaggattagtctaaaatgtaggcaaaaaaacttaaaaacaattagtgagacaaggatttaatgacatgtatgatatgctttggagcataacttttatctctccagtcctcatttttggtaaaaaaacaaattatgataggaccatgttgtttgtagaaaaaactttaaccttatacttggcctgattatttggaataaagttcagcaagaatggttatttctacatagctcttttggattggcttagatggaactcagttccacaaggaatcttagataggaccttttaaagctgagcccggccataggtttatattctctaatacctgtgagttgggtgatccttttctcttaatgttccaagataaacttggagttcgtggacctgttagaaagtgacattctttactgaccacaggttaggaaccctgtgtggggactgtgtagacaaggtatgaggccagtcttccccaaggggcttttatcagctctgcaagtcgagattgactccttaaagggaagcatatacttccagtcaaagccttgataaaataaccagttttccaattgtgtcccattgcaaaagaaaaatggattattattgcgatgatgcaaacaactatattgccataagttaagagtactcacagatagtttccaatttctagaggaactaggcagagagaaacatgctccaaattttgttcacagaagtataccttactcaattattaaaagctttaaaaagttaaaagtatgtttccttgagtctaaaaaacaaaacaaggatcagaaatacttcaagcaaaatattccaaaaaggttgctttaactttctgagtacagtccattagttaactcttgttttgtttgacacataaacatttcagttcttcataagtcccatacattctttctctattccaatgttacaatcttcaaaactattgaaaacctgcatttgcaatcacctgttaaggtccttaatatggcttgatgataaaccacattttgagaaggaacaaagcaaggtgacaattgtctgcaaatggtgacaaagtttccagggtagttagttaaaaacatgactaagaagtttagttatctccatggtttacaataattttacccttaattatgattgatagcatatactcagacattagaattttagaaatcccatgcactgttggaacatatcttagtattattcactaaaatataacttaaattgtacatcattttggcaatcccatgcaactaaacatgtcaaataatcctgtttacctcttttctgaaagtttcaggggccttctgagccatccagaaatcccagctcagggaagataatttggatactagaagtttgatttttgggatgcctgttaaatgttagagatttaaaacacttgatgttatgaaatagaatcccagattaccataaattatttattttgccaaaatgatgactcaaaaagcaaaaatcttttattagcctttactattgcatgaaaatcctgttaaaagccaaatttttacccttgcattagtttattaatgttaaccccaatgtttaatgaaacctcagacaatttcatataatcttaaccaagttgaacatgaggtgaaatctgtacaagccttttataactgcttttgctaaagaggaggttagtgtcttaagacagtcttgctgtgcttttatttcaatgctcaatttataaaaagaccatataataccctttgaatttagttaatgtttacacatttttgcaagattaatttttacaatcttttcacaacttaaatgtgtttagctttattatatcaaatttaagataatccctcatccctgggcaaaatttacatttccatgctttcttataatcttttactaaaagacaccttgcaaataaaactgtttagtgatttcaaacacatgttgcactgttaactctttgcaacttttaatgaaaaacctggttagtaagcaactttatgtatcaggtgtggagcctaggaaccagacagaattgcagagtaggtctgactccacatgtcccaggccttacctatctgtaaagcatgcagtatacaaccttggaacatttagcaagcctagtatctaagtggtatgattaagaccacctttttgcattttgacgacacttgcattttgccaataatccttaaggctatttttatttcttaaagattatagtcatgtgagctaaaaaatattttaagtgcttatttttctttaatcaattagagctctttttgtagacattacgcataacacatatatagcaacacagaattcagaactagtatgatttttcatttgccagtttcttattgggattattggcttcagggcggagcccttggaggaacagggccaggaaggcatgcatttctagggcataaaaaacaggcacagctgaaggcaaagacagaccccccaaaaatattggtgccgttttataatggattttggatccccaaaaggagggagagcctatgggagaagagagtatggtaattttaccatgcatttcattgcaaggcaacccaaatccattcagcttattttgtaatcagcccaacccccacatgattcttatctcttgggggagtggggaagtttgtatgtttcaggtgaccaagagtatgcttctctgattcaaaagtgcaaagagttaactatccttccgtaactacgattagacatcccttaaagtatgttttctctctagttattccccacactaaagctctatcatgatgcgaggtaatttggtacctctaaaactcaaaactgtcagataacacaatgaaaaacagcaaagcctttggttttgagagggaattatctgcttttaattcctggggttttgtgagaaaaacaggttttttctcaaaagagagtttgtggtgtcacctctgtttttttcccaaggagttccaggctaccagaagttgtcttagggcctctcatgtgtacattaagagtggcaagacaaaaaatggagaaaaatgattcagttgactgagaagaaaaggctttttctaggaaagcaagattcaagaagagacaaacataaaggccttttaaaaaaaatctagaacttggatatctgctttgaattaagctgagcactctttaagaaaattattttaaatctcttgttactcaactttagccacgctaagcagttaagattttcagcttttgaactttataaaaagtaacctcacaggtgaaaccaacaagcctgagttagtttgtgacttaaccatgagtgtacaaggtattttcaaagtggtggtaagcagcttttgaaactgtcattgcaaaattgtgactgagacagtaaaggagatctgacccaaacaactccattttgtttccagcccctaagctatccttgcccatccctgagtgtaggctgaaccaactttgggaggagcctggtttacagtttatagtccaaaacaaagataatagccccttctgaagatatacttccctcttgtctggggaccagaccaagaaactagccacaagatcaggaaccatggctcaggagtcacgcagctgaaggctacaaaattttgaccctcccttaactgctctcaagatcagagcttaaggtattttgtaaacactgtcattgatagatcagctggtaccacctagatcaacaaactaacttatctgattttctggccctcacccaggaactgacttagcacaggaagatacccaccactgtaaaatggtggagactaaaagtattgccacgtggttacaggtattgctcccaaagacatgaaacaatatggaagcctgtagccaagtttgttatagactgttttgttgggctggcatgaacaggaggcttatgggatcctgggtctgcatcctagcctaacatatgttttcttttgacagaaagacacacaaagcacaccagatttgctacagcttaagactaacctcacaaatcccttttcattaatttaaactttacagataatataaacaatgatccttgttacctcttttaccagtttgcatgggaagagagaggccaaaagcctgaatggtaagaaatttctacccttttgctggcatgtcaggcttctgggttcccttccccctagctcaactagagaagcattttaaggtttggaaaattaacatttcccaggttggaagaacattataaaaaaagatagccattttataccgtaaaagaaggaaccacaccatacaaaagtctgggatatcagagttgtcaaagaggtactgcttcctttcctatcaacagtggtgtttcccctatttcttcaccttcccgattttctcttttccctttttgcctgttataggagacatattgctcatctccaaaattctctgctgcctgcagaattgcctgtttttcacctacagttggggttaagctttggagcagcataacatccctccatgagaagtcaaatatctgagttaaattttagaaagcttctatatacctatcagggtcattagaaaattggcctaagtctccctttacttgcctaaggtcctgcaatgagaatggaagttgaaccctcgtggcatcacctccattggacattttctgcagggttaagagctaaggtggcggaatgggaaattttggagatggtggagatggaggagctggtggtgtggttggagctggccccagataatggggaatgaaagggccaggatgctcaatggctgcctcaaatggttcccccaggagttgcttttctaattttggggaattctctctgtgcctgtctgatatgattgctaaaagagccgggctgattttgcaatgcttgcaaaggtctagcaaaaaggcaatgcccttatgtagaagaaaacaagccactttttctttaaaatctcagggtgaaaggagttccagtgcttcagaatgcaccccaggggagtgcatgctgaagatgatacccatctagaaagagaagtgagaaaaaggcatctgtttagtctccttccttttggtgtgacccagagtggaaaggaagacagtggaggcgttccccctgctgttttttgtgttttgttttttttttgtttttttcctaaatggttcctgggtcctggcatcaccaaccgtggctgcaggcatgaccctcagccatagaaccagaggaactaagccattggggttagtaatgctcacccaagtggctctagtcctctgcttgtgattttgctttgacttcctggacttgtgtaacctgcctgactcctcaaaaaatgtatctcaggagagattatgtgacagttgcatttaagcatctgttgcactttcctccttgatggaggaagtgtgctgatttgagctctatatcctgctagtatggttcgtgttaaagcatctacccttagagaatggttccagttaacttccaaacttaaaatacccttactaattaagtactattctaaatggaagcagaatacgtgccttaaaagaaagtaggtatcaaatggccattttcctgctgatgggatagtattgacactaaaatctggctttggaggatattttgctcttaattgttgaaggtagagttttcccatttgcagaagcaacataaagcctggtctctagaagaggggtgcaataagggcaaagaattgggaagccagggtgttttgataaaggactgacaatgtgcctcatggagagagtacctattccactagttggtgctgttgaccttgaaatgccatgaactctccagaccaagggcagagagtgatgctcactgtggggggtgcgagggtgggggcctctgttcctagaaaatcccaaagatgcctacctttgagctatatccacagttactacaacattcccagatctttccaaacaagattatttccctgaattgtaaaacttcctacacattgcatacatagagagattaagagatgtgatggtcatggacgagaaaggaggaaattatgataggaaagttggagatcctgttgccaacaccccaccagggtggtcagaggccgaggtcagtccataagcctttgggtaacactcaggggtagccccagccagaagttctcagttgccccaggacttcttccagccccatacaatggctacgtcttccatgaaaggaggctggttcaaacatggcccatatgccatatgcccagaaacccataggtattgggggattctccatgttctctccagtaggtgtgacatccgagtctttaagaatggcaggcatgctaatggtatttttaaatggctggcagatgcctgttattgatttaatttgattttaaaatggaggctgaggcaaccattccagttgattctattccattctattccattccattccattccattccattccattccagttgattcaattccattctattccattctattccattccattccattccattcgggttgattcaattccaattaaaggacagattttgaggtttttctccatatttaccactcacatgattctaccttctgatccctttcttttagaaagaagtcaggacacagacacatgtgggtgggttagggagtggaaagtttaatagaagaaaggagagaggagctcttgtgtgtgagagacctctgataaagaggtgtggtggcagactgcagcagattttataggcaggttggagaaggtggtgtctgatttatgtaggacccacagattggtttgatcacatatgatgtttacatagcccatggggaaggattgtcaccccaccctaatcttatgcaaatggactttccggttgattggcaccatcttgtctgttctttattgtacaagtggctgacaaagagaagggaagatggagccaccaccttgaacatgtctagtcctagttcctgctggcattcacttctgcaagctcccagcttgcttgtctttgaggctcaactttacaggctatttattagaaaatgatttgaagctgctttttattaaagagaaaagccttactgaagactcccatacccttaccatctgcttaagttatttcttaactcctttatcagtagtatttgttttttggctgttgagttgtttcagttctttgtatattctagatatgaatccctagtcagatgaatattttacaaatattttctctcattctgcatgttgtgtcttcactctgttgattgcttcctttggtgtgcagaagctttttagcttaatgtagtctcatgtatctattttggttttgttgcctgtattataaagtcttggccataaaatctttgcctagaccaatttcctgaagcatttctcatattttcttccagtagttctatgtttttgagtcttatgtttaactctttaaccattttgagttgatttttgtatgtggcaagagatacgggtgtagtttcattcttctgcctgtgagcacttagttttccctgcatcattattgaagagggtattctttctccaaggtattctctttgtgccttttttaaaaaatcagttggctgtaaataggaggattaatttctcggttttctattaatctatatttctgggttttatattgtgccattggtctatgtgttttattctaataccatactgttttggttattatagctttgtagtatatgttaggtagtatgatgcttctagctttttccattttgctcagtattgctttggctattcagaatcttttgtgtttccacataaattttagtttttttttatatttctcttgagaacgtcgttggtattttgatggggattgcattatgtctcttgaatctgtagtactatggtggcattgggaaggatggctattttaaaatattgattccttcaatctttgagcatgtgatgtgtttacgtttgcttgtgtcttcaatttctttcatcattttttttgtagttgtagaagtcttttgcatccttggttaaatttattactaggtggtgttttggtagctattataaatgagatcacgtccttcatttttaaaatctagtttgttattggtatataggagtgctgctttttgtatgttgtttttgtatattacaagtttactgaatttatcagttctgagttttttggtggagtctttaggtttttctatacataagataatgttgtctgcaaagagggatgattgttctttctttttccaatttggatgccttttatttctttcttgcttgattgctgtgctagcacttccagtactatgctgaataaatgtggtgaaagtgggcatccttgtcttttagttgttaaaggaaaggctttcaactttttttccattaagtacgatgttagctgtgttgtgggtttgtcatatatatggtctttctttattattttgaaataccttctttttattgttgagagtttttgtcatgaagaggtattgaattttatctttttgatgcctgttgagaagatcatatgatttttgtccctcttctattgatgtggtgtatctcatgtattgatttatgtacatggaaccatccttgcatccctgagacaaatcccccttaatcatgatgtattatcttttcaatgtgttgttggattaagtttgctaatattttgttaaggttttttgcatctgtattgatcagaaaaaatggcctgtaggtttttgtgtttttttaaaatctttgtctggtgttggtatcagggtaattctggccttgtagaatgagttaggaataactgtctcctctttaatctttgtaatagtttgagaataatctgtgttagttcttcatacatttgataaaatgcagaattaaagccattcagtcctgaacttttctttattgggacgcacctgatttctgattcaattttattattcattattaatttgttaggttttctatttctgtctagatcagtcttagtaggttgtatgcgtttaggaatgtttcctctagattttctaatttgtttgcatagagttattaatagtctctaatgatcctttctatttctgttgtatcagttgtaattccttctttttcatttctaacttatgtgggtcttctctttttcttggttaatctagctagcagtttaaaaattttaccttctcagaaaaacaagtttttgttttattggttcttggcaatgtttttcatttagtctgtttttagttctctaatttttgttatttcatttcttctgctaattttgttctgttttcttattttttctagttccttaaggtgcattgataggttgtgtatttgaaatctgtccacttttatgatgtcatttattgctataaacttccttctagcactgcttttgctacattccattggttttggcatactgtttttcgttcttattttttccaagacattttatttccttaatttcttcattgatgcaatagttgctcaggaccatgttatttaatttccatgtagttgtacagttttcaatattctttctattaaatattgttcaataatgttattgaatcaatatagaataaaacttgtcttattctattgctatatcctcctgctaatatgatttatttttcaatatatgaccttgtctcttcagtttttcatttaaattgttttctataggtacagttacttttttttttctgcttttggtttccatttacatggaatatctttttttatcccttcactttaaatctatatcggtctttataggtggagttagtttcttatcggtggcatatagctgagtcattgttttaaatgcattcatctagtctacatctcttaattggggaattctgcttacattcaagcttattaataagtgaggacttactcttgtcattttgttagttttctgggtgttttatataccatttgttattttcttatggtttatcatcatggtttggtgattttcagaatggtaacacttgattcctttctctttctcatttgtgtatctagtctaccagtgagttttatactttcatgtatttccatgatggtagatattatcctttcacttctggatgtaggactattttaaacattttttgtaggaaccagtctattggtgacaaattgcttcagcttttgcttgtctgggaaagactttatttttccttcatttttgaaagatacctttgctgggtctagtatttttggctaaaaggtacttgttttataaagcattttgaatatgtcattccattttctcctgacctgcatgatttctgctgagaagtccactgttagtctgatggaggttcccttttatgtgacttgatgctttttctcttgctgtttttagaattctgtcattgtctctgacagtttgacaataatgtggcttggagaagacatttttgaattgaacctatttggggatctttgagcttcatctatctagatgtctatatgtttttcaagacttgggaagtttttagctatttttattaaataggttttctatgcctttgcccatctcttctcctttgggaaattccagaattcatttaaaattttggtcattttatggcatcctactggtcacataggctttcttcattcattccttttttttttcttctgcctgcattattagaaaaattattttgcttagcctattgacacttgtatttttttatttctttgatttcttcagttctaggacttttggtgctcttaacatatctgtttcttttttgaatttctcatctagagcataaattgtttctctgatttatttgtattgttggtgttttcttatatttcactgaatttctcatcataaaatttctaataaggaattcaagataaagttcctgttttggggatctgttattgaagaattattttgttcttttggaggcatcatgtttcctttttttgtttcttgtgtccttatgttaatatctgcacatctggtgtaatagctgcttcttccaattttatggataggcctttgtaaggaaagatattttcctacagatgtattatagtattggttaagtaagttgctttggctttgattttggatgggtatagcagtgtagtctttgtatgacttcagttatattcagtgtcagcgatatctggaagtacctaagtggcttagactgcaattgttaatggaggttgtggtaagactttgatgggggtgggaacatcagctgggttagttcttgtgcaccagtttggcagcagtacaaatgttgggtctgacctcaggcctctggatggtgtgtgcaggcaccagcagtggtaggtaggttgaacttatactctgccctgtacaatttgtatgggtgctggcagcagtggtgatgggtgggatggaacccccagtggtatatgtagctgctggctgtgatggatggggccaggtccccggacagtacattcacatgcaggtggcagtggcaatgggaaaggctggctggttctcaagccgcataaaacacatgtgggcaatagcagttgcagtggtgtgtgaggcaggcctgttctcaggcaccactggtggtggtgggtgcactggacctgttagacctccatatggtgcctttggagggcagggaagattaatccccagatgccaggttgcttgcacgaaggttgcttgcacgaaggttgcttgcacaaaggctacacatagcagcttcttcctctggtacctaatgagatgttgcatagggcaaccatcagtatcagatagggtctgtcaatacccaggcctcgaacaatgtgtatggcaaggcaagctttgcaatacataatttttaagtgacttaatatcaggctatatcttaagatttatatgtctttaatagagtagagaaaacaaaaatttggaaaacatttccttactgagtggtagaagtagcagactagtctttggctgatccagagagactgcagaggaagtttcttttctttttaaaaatgttttaaagacagagtctcactttgttgctcaggctgccctctgactcctgacttcaggtgatcctcttgcttcagcctcccaaaatgctgggattacaggcatgagccactgcacctggccccctgcagaggaactttctaatacaattagaggtgtttttctttgttaaaaaataaaaatccaaatactttctgagttgaaaggaagctactctaattggccaaagattatttataactgtgtctgtgaggctagttaggctaggaaaaaaacctgaaaagggtgagtaggaaaaacaataaggcaaaggagaatgcagtgaggtggaaaagctgtatttagagccccaaaccattcgtatgaagttttgtatcttttttttttttaaggtggagttttactcttgttgcccaggctggagttcaatggtgggatcttgtctccctgcaacctccccctcccaggttccagtaattctcctgcctcagcctcccgagtagttgggaggtgcctgccaccacgcccagctaattctttatatttttagtagagatgaggtttcactatgttggccaggctggtctcgaactcctgaccttaggcaatctacccacctcagcctcccaaaatgctgggattacaggcgtgagccaccgtggccagccttatgtgtgttttattaatgtttgaaataaaacaggaactattacaaactcacatgaaatgttcttgtgatgcttaatacatatagacatatttctaaagattttcttctgaaattagaagccatctaatccgtggctacttgagacttccattaatttatacacattcagcggagctaacattcttatgatccatgaagttgtttatgttgtcctgcattgaactgcttcagattgctatagtttgaagtttgggaatttggggagtaatatactcctcattttataaaaaggaaataaacttcatcaaaggtaagagaatttttgttttgtggcatgatatattattgctcatgggtatacatgtaacaaggaagcatgaaaatgagaaggtgaaaaaaagggaagatctgtgacttgcttaatattgcacacctacaattgggcaaaatcaaaattgaaaaccaggtcagtctcatatcaagtcacatgttcataatcatgataggctctatccagtaatttcagcaattgtacccaaatacctaaagttaattccactttccaaatacttgtatggagcccatctggcacccatgaatcagtattttagaagttctctcaaatggctcggtgtccaagtgctaggttggttactacaaaaagcccagcataattgatttctgaacaattgccaggaaataaacaccaatctattaatgcagcttgatttctgatactttgttttatctgttaataactagcaatataataataatgcctattataattgaatcacttacaggattaatgtcaagtttggctagtttgttgttgggtgtggatattttaagctctaattgttcttcagttacatcattttttccacttgacggggaactctgtaagggcagagatggtagttcttcactttgaatcactaatggctatcaaaattttaagacgtagtagttgtcaacaaacatttgctgaactagtttaaataatttttctaaattatacttttattatgataaatagtgatagtattcactttcttgtggtgttcagtgaattaatgaaattagttactgcagagttcctagtgagaaaaggcatccatgggtcctactcaataagtaccttcagcaaaatctgttctgaaagtcaaagtgttccccagctaatactgtgatgaaaatgcctgcagaatcaaatgcaatatgacattcaatgttttaaatgagtcattaaacaaagaatattccaatattgtgaatcttctgtgaagtttttacagactgatggaatagaaaagatagtattctatttttacaacaagaaatactgggagatgcactacaaaatgacatttccagtgagatttgagcagcatcttatctttcaatgtgttctttattcattgattcagggtatcattcctggggtatataggtgaatatgacgatgataatatgtctggcagtacatagattgctatccttctcagttgaaaatggtgttgacggtgaggttagatgcagataaaaaataatctttgtgtgatagcattttcaacaccaaacagatgttgcatacttatgaatcagtgacttctcataagtagcaaaatgtacattgtgttaacgtatcaccttgttttcataagtacaattggttcctgagaggctgcagagtatagtagagtaaaagcaagagaagttttcttttttctccctgatgtatcagttattgttgcacagcaaactaccttagacgctgtggcttaaaacatctatttattttattcataattcactgggtaattctactggtctgggccagctggactggtataattatgcacctactataagctggcgtattggcagggtgcatcattgacaatagccttgttagagagataggagcctttcttcaggtagtctcatcctctggcaggctagcttggaattgtttgcattgaaatcccatggagattgcagggttccaagagtgagagtctcagtgtgcaaggtctgtctcttgagtcctgggctggaactttcaatgtggcttctgctacattctactggtcaaaacccatctcaaattcagctgaggcttaagaattatagaagtacactcttccctatgatgagagtggaagaggttactaccatttttagaatttgccacagcttctattgtaattctcaaaccaccctcttcaagaagtcatgtcttttagtgataaccataaccacaactacaacagtaacaacagctcacacgtatggaggacttaattgtaacaaagcctattctaatgttttatatggattaactcaattttcacaataacaatgaaggatgagtattagtttttctttatgggtgaaaaaaaaattgcctcacaaaggggttaatcattttacaaaacattaaaaatttccaaaagaagattgccttagtcaaataaatgcagaaaatgcaagacaaaataataattaaaagtctatctatgtttctatccatacaaccatttatcctcttggacttctcaaagttttgaatgcagtaaagtatattttgaatcttacagaagggaaagaaggttataagccacgttcaaatttggaatctaggaaccccttcattttgcagagtatctgttaacatcttacatgacagtggtattctatggaactgtttgtaaaatgctgtaattaggctttaaactagattccaaattgccctgatttgtagcacatgtatctctgtcactgagactataaagaatataaaacatgcaatatgcctgctttttttctctatgtgcttgtctgttcaaaaaatcagtgaccctttagacatgcagaagttaagccagatgtgtctatgaatcacctcaagggttttaagccaagttattttgcattgcattattctattctttttttttttttaaccattcccttcttttttttatcaacatccctctgagcagtaacacagtattactgctctaagggatgacagttggcaaatagtactatagcatggcaataagatacagaatgaaaattatacctgtgtcaaattgcttctgaatcatttacttcaagatagtcaaattaggaagaccacccctgagccatacagatgaggcagtaggttggagaaagttatctctagctctttaggttttagtatctaccgtttaatattgctattgccagagtagcaatctggaggagagttttggaatcaagattaggctacagaaggaatttaaggtgtgtgtttttgtatatatacatatacatgtatatatataactgtacgtaattgacccttgaacaaaacagggttagccatgccaacccccacacaatcaaaaacccatatataactttttactcccagcaattttttttttttgagacaaggtctcactctcttgtccaggctgcagggcagtggcatgaacagggccgactgactgcagcctcagtctcctgagctcaagtggtcctcctgtttcagctttctgagtaatcggaaccacaggtacacatcaccacgccaagccttttttttttttttttttttttttttttttttttttttttaatggagacacagggtctcactgtgttgtctggactggtcttgaactcctgggctgaagtcatcctctagcctcagcctcccaaagtgtaaggattacagacaggcgctactgtagcccagccctgaaaatcttaactactgatagcctattgttgaccagaaaccttgctaataactagcataaacagttgattaacacatactttgcatatttgttatatattgcattcttgcaacagtgtaagccagagtaaagaaaatgttataaagaaaaccataaggaagagaaaatatatttattaaagtactgattaatactgtaggtttatatcatgtgttgacaagatgaataatctgtctgaagtggtgggcaatgcagctgcagaggtcaatctacagtacatatcaaacaattcggccttttcttgtaatgtcatgacttgtctctgcctcttgggaacactttgaacatcactagtggcacttcgtatgggtcccatggtgttattcaaggtttacaatattgcactaaacactatgaaaaatatacaagaactgcaagagatcactttttccatgataaacaatttattgaagagatgaactgctctgtggagatgatgagcatcacacggcattttaagtggatactcacaacacttgaactcactgcagtaacaatgggaggtggctatgaaattatcacagtagtacaatgtgtactacagttaattttatgcatttattagttaatgctgcattctgtttacatttctctctactgtgaacggtgccatgtactgtctgtgcacattttaactgttttatactagatttgtgtatattgtagtaaatgataaaatagactagtacctatatattatatacatttagagtataacttagttttactttatatttaggctacacggtttgtctgcaaggttttcaaattattgcaaatctccaaaaaaagtttccaaaatgtctattgaaaaaaatctctacatataagtggagcctcacaattcacacctaggttgctcaagagtcagttctttatataatttgccttagagaaacaacacattcattcaatccacacactcatggacctctccaggagtttgtaaaagaataggtaatgacctaatattaactaagtaaatgccagcattttatttaatcatcaaaacaacacgatgaaatagatatttttaatcctcatttttacatatgtgatgacgttttgctggggatgcagcaccagatgggccagtccttgggcaccagcatggtggtggtggtgcgaaggctgcacctggactcgggcgtctgggtgatgtgtgtgggtgccagtggtggcatgtagggtagattgataacctggcccctgtacaatgtgtgtgggccaccttgaagaggaagaatcacaatttttacctccaatattttttaaatggcaccactaaaaccaaaacaaatcattaaatgtatttatatcttaccatgtgtcacattctgttaaacactttacattcttcatcttatttagtgtatacaactttagttctcatgatttctttttaacgaaggaagaaactggggcttagagagtacataaattggtcaatatcataccatttgtaaataacagaaaaggtccatgatttaaagccaggccactcatgaccaaaatctgttgttcttcattaaataaaacttcaacttatgaaatagtttcatctacattgtatcgttgaatccttaaaacagctcagctgggtcagaagtatcatcggtttatagacaaaaaaagataagaatcaaaaaagtttggtaatttcccccaaggtcataaagctacaggttttttgttgttgttagtttgttttgtttttgagacggagtcttgctctgtcaccaggctgaagtgcagtggtgcgatctccgcttactgcaacctccaactccctggttcaagcgattctcctgcttgaacaggagaattctctcagcctcctgagttgctgggattacaggcatgtgccaccaagcccagctaatttttgtatttttagtagagacggggtttcaccatgttggccaggatgatgtcgatctcctgacctcatgatccacccaccttggcctcccaaagtgctgggattacggacatgacctactgcgcctggccctaaaatttcgttttaaaaaaatatgcctggtgtttcttctagttgtccatatttctttcttatgacaacagataaaatacacaaactttatattttcatcaggatagatttttttcaagtctagcctctgccactaaatgtgtaattttaaacaaatttcttaatctctgtgagcctttgcttcttcatctctcaattaagggtagcaattctagctgcctcacagagctattgcaaagtttacatgaaaatgcatacaaatatgtctagacaagtgcccagtgtgcaggagagactcaatgtataatctctggctttccttctctctgtgcctttcaacgcaaatggaatagtttcaggataaagaatggtcagcttacataaccaagtgaggtgtatattaacagctggcaccaaaagtcatcttaggaactttgtcagaatatcttcataagcctttgtggaagatgtgactctgacagcagagatgtcaacaggagaccaagctataaaaggagaaggttagatggtctagataaaaaaaattatatgaatttttgttttgctcacaaaaaggaaggaaataagagacgaatggagaaggtagggaggagagagaagagccagagaggtaggatgaggtgaggatatatgtgctggacagccaggtaaaattcttccacaggttatagaaagatattttaaaaatgggacatacattgttaatttaaaattgtttacattaccttgatttaaagtctaccaaagaaactactttcagtaaagtctaccacaaatgaatactagaaatgaatgtttcatattctatatggattaccatgacttaaaccagaaatacataactggaagtagaagggaattcaagaatgtaagccaccctcgcattctcagaaatctgggcaacttgaggatctaagacaattttcaagggatctcaagagataggcagtaccagctgacatgtggattttgtgtttagttgaaatatcctctttttatttgaaagtccacttaaattcactgtaccaagaaatcattttaatttcagcatgatttagatacatttgaaggagacaaactgaagatattaccatgcttgaggtttaaggtgatgaaggacttttaggcatatttgaaatataccccttaactgttaacattgacaccagtggtaagaaatttcctccattagataataccggcttgaataaatcagaagcttgctgtgatggatcatttctgtatcttatttgcagttaatagatattatttcttagagcagtttttggttcactataaaaccaggcagaaagtaagagacttcccatacaccccagtccccatacgtgtaaacctcgctcccgtcaacatcccatgctctagtagtgatatttttgttaaaatagatgaacttacattgatacatcattatcacccacattccatagtttacattagtgttcactgttggtgagtctttgtttttacctacaaacttattacattggtagtgttaccatcaagccagtgctcaccaaaatagggtctttacctttttagtgccctgaagctaatatgcaaaattgaaagtgaatgcataggctttatttgatggccatgaaattgagaagcagaagctgggatcacaaacttctcagtctgtaagagccagaacttcacagataaagggcatctttaatgaagtggttgggcattaaaagaaaggagaggaatatttgtcttttctgggaatgggtagagaacttcttgtaaccaattgccacctttctttctgtcactttatggcttcttccggttgtcatgattgtaaactatcatggcagtggtgggagtgtcatttagtatgaatattagattataatatgaagttagaggttcttcagaagtcaagtgagccaccatcttggatcctaccagtcttagccagtttggtcatgagggggaacttttgacctcaggcatcctgtttcctaaagatatgcagagttggttaggtgcagtggctcacgcctgtaatcccagcacttggggaggctgagacaggtggatcatgaggtcaagaaatcaagaccaccctggccaatatggtgaaaccgtatctctactaaacacaaaaattagttagctgggcttggtggcgcgtgcctgtagtcccagctactcgggaggctgaggcaggagaatcgcttgagcgcgggaggtggaggttgcagtgagccgaggtcgcgccactgcactccagcctggtgacagagcgagactgtctcaaaaaaattcagagttaaggtggagtggtactttacctaggtcacataggcattatactgggtaatactagacgcactgcgcctcctgcctctctagcacggtgagatgccccatctgagcatacatctgtagctagattgctgatgactaagtataaaatacaaccatttcccagacatgtgaactgtatggttcactgcaaaactgatatgctccctgtgatattaatacactcactcatatttcacactttgtcaaagagaaagctgcgtatatataaattcaaacatacatacttgattgttttaaaataatgacagcaatattgaaagcacagctattagtttagtaatgaatagcaaaaagaggatgctggaggctttaatggaagaagaaacattattacaactttgtcctcaggatctcgcttttcattacatatcagtctgaaataaatatcagtctaaaataaatcaattccaccatattcttctctttttgcctctggacaggtttttaccagatccgtatataatacttcatatttttaccaactctactgcaaacaggtgtttatcctctttgcgaaatgctgctttaacataggtgcagatttaaagagtttaatgtgattttacgttttcttattatgagggagggatcatccaatcatacacctcatctctcaatctctcctggatacatatgggaaatatttcattcactggtcgtttggtccagggaactgaaactcatcccctttcatgtgttaattcggactgataccacattaaatggctcaggggccttggctctggggttgctgtgaccgctaatgctttgtgttgctaaaacccacacatcaaatgtgatgccttcattttgcagttattccctagcaagtttccctttatgtatgagatttcacaagcttaggtgcctaataagaactagtagaatcacgtgcacacatatacaagttaggaggaagtgtttaggcactatctacctgaatctattgctatgtctaaaaggtcttgttctggatttttgaatcagaattattagtttgatgttgagccttgttccttcatggtagacttttgccaaatgatgtgatttgacatctaaaccactaggaagcatttcataggtgacataccagtagacagcctgtaattctgactaagtgactcaatcaagatttggctttttttttttttcctacaacctcccacccacaaaagtctcaatatcatagattgaactataaatcttgtcatgaaaaacaaaagacaaaatagaaaacaattttataaatgtaaaatggatcactgttagaaaagaaaaaataaaaattggcatggtcaggaaaatacataaatggaaactccctattttggaagggataatgatggagaacactgttccaaaatacaatacataaatccaagggagtgtctcctgccacctgccagtggcaggcagaagtttccctgttgtacggactccttgctttaatcatattatggaaattcttatgattgattctgctgggtaaataagggtgtccttaagtttaaccccattgtctgtactcacttcttcttttgattgtcagttttctatattcttactttcctctcatgttctaagcattggatggtctggacctatgagattttagagcttctcaacggacttaatgaccaattaaagctctttcttaaactgtaaatttttggcatggggatcttgactaaaatgtttccacttactttaaccctaggtttatgtctacaaaagcgtatgcctgggtaatcctggtttcttgaggatgccatatgccaaacagtcagtaattgcatttctgttggtattgttgaccaattccctcatatcttacaggtttgggtgcagcagggatccagaaggaactgccaaaaatgacagctaggaatttgagggcatctttagaacatttgaagtttggcattttagtacaaatattgttattgttgctagttttaaattttgccaaggacataccctaaagtacaattaaacaaggaaaactagagataccatgtattttgttactgacaggtctttgttcttagagctcccaagatggcggcaggccactcccaagatggcagcaagccttttattctctgacctggggttcttggcctcatggattccaaggaatggaaacttgggccatgtggtgagtgttacagctctattagaagccatgggtcacagaagagaaccgtggaatccagtgactagtgttcagcttgattaggatgaacccgggcacttagctgctcaggaacaatggcgagcctttagccatatcgggagtggcaatgggcgacttgctggatcaggagtgcagcgaacacactgctggatctggaggggtggaaatcagcagtgggtctgtgatggcggcaaacagcagtgggggacggtgagtagaagctcaacttgtgccctaacaaacacagaccagaagagcgtgcagttgcaagatttcatagagtgaaaacacagctcccatacaatgagaggggacccaaagggggttgccactcccaactcgaatgcctggggtttatatctcaatcattgtccctccccctgtgctctcagatgataactgatttgactatttctttacctcctgcttttagcctaatttgtattttagtgagccctctacctgattggttgggtgtgagctgagttttacaagtcccgtgtttaaaggtgggtgtggtcaccttccccagctaggcttgggaattcttagttggcctaggaaatccagctagtcctgtctctcaatttcataagagaaaaatccttctaacaaccaaaaaaaaaaatatattctcaaaaagtttattgaaaggaaacaaattggatatagtttacaaaaagtcaccaaattttaattttcttaagacaacaggagctaatgaaagcatcaccaatgacccacttctaaagacaggaggaagagatgtatgggatgcagatagagacatctaaggcagggaggggatccaaaccagcacagagataggaaattctgctcataaatgggtggggagtgagaacgatgcaagccagggacccctggctggtgatgccctacctgggccttgctcagccatgctattatgccccagctcacctatgttatagcttataccaatctggcagttcctgagctattgtaccatgcccaagaacaataaggatgtgctgtatattgaacggtgaggagggcaaagaagaattttagtgcatgatgagacagctttcagtggagagggggacatagggatgttccccctacccaaaggtgggaaagtcccccatgtggctgggtctgaggtcttttatggactcaatggggagtgcgcactgattggttggtgagtatgcaaaaatggtcaaagcaaagataccactcaaaggtgggcatgacagtgtagaaaaccaattaggaaagggtaggtatttttgaaacaggtgaagggtagggatcaatcagaggaaagcacaccaaatggaagacaagttctcaatctagtctgaggatttaacttgtaacttggctttcaggcttcaaactgtcttcagctcggaggtagggtttcactgggggcccaccccagtctgcctaggtatttggctgactcctgtactcttgagagggatggcagatggcacgttgtttcagcatctgaaatataatgtggatgggcaactggaaagacaaaacagcagcagtggcatgaacagagcttagcacagaggggacaacacacaaatcgttgatgaatttttaaaatgtgggaaattgaacaattcaagctatagtctgcatttcaaaaaagatatgtttgcttaaaaaaacaaaaaacaacaaaatgaccccttcaccacaaaggatcagcctatatcacacacaggtacatgcaaactggcaaattgtcattatcgtctttcacaggttttatgaataaaaatgacctatgaatatttatatgataccctttttcttatcacttttggtggtattatgtaatgaaaataccagctcaggtgttgttatgggcgacattcattagtttgttgggttaactatgaggatgagctaattacttttaaaatgtgctttcatccagtgattcaacagaaaatacccatgctcaatagcattcgcttggttaagaaatgaaattgggcaaataacttatataaattaatgttggaaaattatattgaagagggactcataacttactaaaaatcactaaagaaaactaatttggattgagtaaaattttcatacattaaattgagtaactggtgaaagttttatttttttacattacaaaagaagtaaacaattttagtactacaaacacagtcataatcttattaaacataaaaagaattgatattataaattataagaagagatcatgctttgtagcttttcattatttttatcgaagatctgaatagacggattttctttttaaaaaatgttttttgcttcaaacttagctctaattctcttatataattgacatcaatcacacttttaattatctttatcgtatcaaataaagacatttggtaaatctgaggaaagaatgaaatccagcccaaacaaaatttcggtttattctgttattttttgaaatctcaactatgttttgtattttgaaaaataagcaaagccaaatttctttcaaaaggcaacttttaagaatttgctgtttttaatttggattaggattgagagccagcatggtccatgaaagtggtttgagaagaaaaataatctggttttcataagtagaaaccttgttgagttaggagaaaatcactcagtattttagaaattgattgaaaatgattgaatttagtttggagcactttttcttttcaatatgtaggcttacaaaatatagcatttataattcacctcagctaccctttctgatattatttttgttttatattttatgtgtgtttcaattaaattttgtaagatctttcttagaatgttattttccctttccaatgatcaatgtctatgccttgcttctaaaaatatatacttatttctctaaattgaggttgacaagttaattgtgatttcaggtaggagggaagacaagtatcttcagtacaaccaacaattcactttattaatgtttgtcttcaaggagagcacaaaggatgcatcagaaaggcagaaacacacatattgtgctcatcaaaggtcttaaaggccagagaagagaacttggcaggaaagttatcatccaagttcaattatttaatcttaaaaaacatatgatttagttagatagccaaaacctgggtagaactcagaatagatactatttattttcaaagcctaagggcatgcattttcagaaaactcagtggcttaaatagtgcttaagaatttacatttaattaaactggatgcaggtaatgggggtctgggtttcggctgtctcacattatgtacttgctgctcattgtgcccaaaggcaaagctccatttaaattcaacagatcttagcaactactgaacactgttgggctgagaatttgatagtgtatcaggctgggaacttacgcctctgggtaaagataggccagaattctgtgagtgttagcaatgatcaccagcaatcaggcagaaaccctagtctcccaaaattgtagagtggggagggtattcagtgagctgatccacttagtatttacagaaaaagaaacacatggcttctgaaactccaatgaagagaacacatgggcttaagatagctatgttttaaagaaaataaaatgatgtgaactttccttggttctgaaataaagttgaacttaatgatccctaatgatctttctctataaaatatcacaattccaggaaaaatcttcttaaattttctgatacaattagacactgatctctaatctttgtggtggttgtagttcactaaatgccacatgaatatgaatccacatttttgtaaagaatttgctagaatttgcagatgttataggtgaaaacatcaattggagtacaaatgtattagggtaaataaagggcaaaaagatggtagtttttagggagggggaacagtacagaatggcacatgagatgactcttgacattctgtatgcaaagtgggtctcatctggattatcaactgtcacaaaccagggatcatggtggattccacagtatcacatggtatggattaaggatatacttcacaggggacagtggaaacttaaaagttatatgtcgggaagaaaagacaatgtgtgatggttaattgtgtgtgtcagtttgactggtacacagtgtgcccagatatttggccagacatcattcttggtatatctgtgaggttgtttttggttgagattaacagttgagtcagtcaactgagtaaagcagattgccatccctagtgtgggtgggcttcatgtaatcaattgaaagcctgaatagaacaaaaaggctgagtcaatgaaaactctgcctgcctaactgcttcagctggatattggtcttttctggccttcagaccagactgcaatgatgctgcaacaatgactcatcttctgtcttgaggctgctagctttcaaattggaacttttactatcatctctcctgatattcaggccttcagacttggactgaaactacacataggctctcctgggtctccagcttgcccactgcagatcttggtacttcataaccattacaatagcatgaatgaattcctcataagaataaatcctattggatctgtttctctggagaaccctgactaatacacataggtgtaccctgttctttcattctcctagaggtgagccacagctaagatatcgtgggtttgtgttgcagtgcagggatcctgcctgccatacctctcctagccctgtgagtcaagcacaaggtcaacctcatcagtgaaggaacaaacaaaatattgggagccagccagtctggagtgggatagggcctatacatagaattttctgagataccagtagcctgactcctggagaccttgtgacccatgacaagtttccatcttgactgctgtgaggaggaagacacaagcagctgagcttaggtgcagtctctcctctgggagaaagagaactctgacacctcctctttcaggcaacgcaaagagagcaccagggtctcttccatacaatcttgatccttgtatcacaaactgatgatctatgaatagcaccatgaaaaatgtagtcttgcatacaagaaaaggttaagatagaaaataaagattgctaaataataggcaaaaaacatttagtatttactcaaatgtaatacgcttcctcccaaaattatagttcataaatttgtattgaaaagtaattggaaatataaactatttaattagaattcataggctatagaatatcaaaaagcctttcttaaactcagttatgatgggaaatgcatagatttttcagcaagtaataaaatgaagataggattacattggaaagagcaaattgtgcatgattctctgaatggaggaaaacagaagcaagattagttaagacgttggtacagtgagtgattaggaccctggaatgaggtggtgatggctaaaaaaaatgaggctatatttctgagttgcttgaaagacaatgggtcattcaaatgtggtgactcattataaatggatggagagaaatcaaatataacttcaacattgcaaaagtgggcaacaagaaaaaatagggacatcaaacggggtgggctgggggtatctattgtaggccaaatatagtaaaagactttatgatgagagataccatccaaataaaatgaaatacaggcttaataattttggtgaaatatggactgattagcatctgtttaatgagtagaaagttaggtaattgacatgaattgtgtcccctcaaaatacatgtgttgaagccctatccctcaatgtggctgtatttggaaatagggcctataaggagttgataaatgttacatgaggtcataagagtgggtccctaatccgataggtccagggcccttattaaaagaggaagagatagtagagcgctcacttgcgcttgccttctcacacgtacacacacacacacacacacacacacgttctctctccacgtcccaccacccccctgcccccctgtccccaccaatgtgaggacactgtgagaaggcagccacttgcaaagagaatagagcccttaccaggaaccaagtttgctgacaccttcaacttggacttccagagctgtgagaaattaatttctgctgttgaagccactcagttgctagtgttttgttatggcagccagagctgattaacacagtaactttcatgtttacaaaacaaaataattatgttttaccctaattattgtatttgaggcataaaagctaaaacatcaataaatcataagtaataatgatttattagataactatgatatatctccaatgatataggacatgttatataaatatcttgcaaaagacatcgacaactccagctggatttgctttagaaatgtttagctttggaattacatggaatgacagaatgtgtccaaaggccaccagtttgcacatttacaacagagaacaactttattaggctacagatagtgacctaacgtaacaaaaaagagataaaccaaccaattagtgaataataagtaatagcaactgataattattgtgcccttgcattgtgtcagatattttctaagcacctcacatgtatctgtttcggaaacttctgtgctagggagatactattattaatcccatttttaagatgaaaaactaaggcacagtgaatcagtaacttggtcacactcacacagctgtgaaggaaatgagtagtagtgaatgacaaaaatgctggcaattcataggtccagccattgtcatgcaggaaaaaggggaaatttttataaacattggttgaaaagttatactgaactgaaggaacttataaggcacaacacggtctaactctccagtcaacgaaaacattcctctctcagctgctctggtgggtcatccaggctcacagtgaatgttcccggcaagaaagtgccttcctgctttccaaagaagtccttttcaaggtggcggagcactgaatagtacagaattcatcagtatattgagttcagatcctatctataacttaggtacttttgttttcctgttttaaagataacattaagaacctgctgttttttcctctatagaatctggcatttacagcactttctcatcgatcacaccactgagtgttaccattcctattttacagagggaaatgtgaggctgagaaagtttggacaacatagccatggcagtttataactcaaagtatatggatggatgacactcgctagagagttgcaacagccgatgcagctgtccccaggccccaaactcacttatatttcctgaaacaccaggaaaagcatcttttatttttatatgagagccctaagagattattttcatcttattcaaaaatgaaaagattttatttaattaaaaaatctatttctattatcttagaacttttgcttctcagtgtcaaatatttttggttacctcagttactttttgcaaggtacagttttcaaatcccatttcatcctgattgtccttccctgaattatttaagtgtagtttagctacacttaaagcacagtattcgctaaaattggaaataatgttccagacgttatattacattgaccattatatcccttgatccaaattatttattgttgacaattattacttaagataataaagaataaacttctaccagaaataccagaaaatcaatatatacatatgtaagaatggaaaaatgaataatataaattatttactattccattgatcaggccaatcactttttgtgtaatatttcttgatttgttttctatgaatatttttataatatctgcctttatattacattgattattttgagttctgcttttcttcctttgcctcaatagcatcgaaattttatagatactcacaaactctgagaatatgattttaatgccagtccttcagtagtcatctttatagaaaatgctaagttaattataaaattataaatgatttggtgattagtatctttgtaaatattttgctaccttctcatattttaaattattaggtacatattttcataattgagatttctggcttgaaaagtatttgagaattatagaatcttttaagtcagtctctcttcctctttctaatatatattttcatcttaatgagtgatgacaatgatttttttcaaaaagaaaaaatgaaaacgtatttgcctaatgtgtatgtacacgcatgcatacatagacacccacatatttcttaacactgcatttttagaaaattcaaacttggatattttctttaggaaaactcccaatctgaaatataaaatgtttatatatatatatgtgtgtgtgtgtgtataatttatgtgaatacatataaatatacacatataatgaaatacagtactcaaggagaccaaaaagagaatgagggtaaagccagcttgtggaatgctttgcatactatgctaagtggattgttacgccattgataaattttaagcgtcatggataaatatgaaatgctacatgtcattgttttgaagaggtagtgatgatagtttcctaagtctaattttatgctgctggagaaaacagaatgattagaattcttatttatgcctacagaaaagaagctgggcacaggggctcatgcctgtaatcccagcactttgggaagccaaggcaggaggattacttgaacccaggagttggagactcacctgggcaacatatagtaagaccctgtctctacaaaaaatttaaaaattagctgagtatggtgacaaaaaatttaaaaattagctgagtgtagtggtgcatgcctgtgatcccagctactcgggaggctgagagaggaggattgcttgagcccaggaggtcaaggctgcagcgagctatgtctgtgccactgtactccagcctcggcaacagaatgagaccctgtctcaaaaagtaaaaaaaaaaaaaaaaaaaaatttaaaaagaagatgaaaagcatatatatcaaataggcagcattttggcaattagagccatttgtaaaatgggtgaatcatgaatcctattcatagttttatgcttactgagcttattgatgcaaatggcctgctctgggatactaaaagatataaaattgaatgaaataaggaacccaaaacaggtgaaggagaaagatcattagatcaatggtcaccaaacgttttatttaggtagcatctgagattctattggactatctgtacattccactcttcatgtgctaaacacatacttggtcatcaaaacattcagggaataacatgctaggaaatgcataacacagataaattgaaagagtaatgggcatcaaagccatttggtgcaataaagaatcattacctccatgacagtggctagttagagaacagatacaaaaagttagagacttgaatcattctatcaattacatctaagacttgcattcttaattttttgtatttttctaaggtgattcatggagagaattagcttgtgacttaacactacggagttaggcaaataagcatttaagtgaacatcataaaactggaggggttacaaaagagataggagatataatctctaaacttagagaagtttacagtcgttttacagaaatattttgcatgtaggtaacccctgattaacaatacaatcaagtgctgtgttgtgtgggtcaatatgagctatagtatcaaaataaaagtgaagaaaccaacaagacaaagagctaatcaccctcctcttcccaaattaatcttcctcattggttctaaaatatgctttcactggtaaaatccagcaatgtcattttccgagcttgcagggaaaaaaataaattaataattttctcaattataaagattgtgcctaaaagtttttcttaaagttttgttgtctacaacttcctgactagattagaatgaaatggaagatattacataaattagctgaaaattatatatctggttattttaagtttattatatttttatttcatgatgtctgcaaagaacataatgattcatgtggtcttacacttaaagcttaaatgggaccactttgtatggtgcagtttaagagaccatgtgtttttgtgtttgaaaaaagataaaagacctgtttattaatctcttataatccagacgtcagttgttagtgaggtgtgttgtcttatttagtatgtttttgagtaaacctaaacctaattctccttttatatagcatgattaacttgtgaacttttttttttttgagactgagtcttgctctgtcgcccaggctggagtgcaatggcgcgatctctgctcactgcaagctccgcctcctgggttcatgccattctcctgcctcagcctcctgagtagctgggactacaggtgcccaccaccatgcccagctaattttttttttatttttagtagagatggggtttcaccgtattagccaggatggtatcaatctcctgacctcgtgatccacctgcctcggcctcccaaagtgctgggattacaggcgtgagccaccacgcccagccaacttgtgaactttcatattattttttcaacgtgggagtgagcatgattgttgggtaaataatttcctgtggacacatttggtttcattcaccccacttgacattccattgctaaagtagacttagatacagcagtcctcccatgaatttaatatatgggaaggttaacaagcagagtaaatgaccaagtatttgtggtgattgaagttgccaagttccaggaatacataagccagaagcaccttaatgagtgatgaaactgatgatgattttcctcaaaaagaaaaaacgatgaaaatgtctttgcctaatgtgtatgtacatgcatgcatttataaaagcacccccaaacacgttcctaacaatacatttttagaaaatttacacatggatttttttatttaaaaaagaagactccaaatgtgaaatataaaatgtttttaatgtttttgtaacctagccatacattcatgttttttttctcaatttctagagctcgtgggtccatccaaaattatactgaattatactgtttaatttagcccattcagataggctacagaattgaacaggatgaaaagggcagcagtatgatgcatccaacaaggggccgaccagaaattctgacctccagatgcagcattaagttcaaataggatcagtaaccacattaggagggtcaccagatagagaagagaggtgatacatcccagagttgattgtgaacatcttagctcaggcacacagaaatcaacttactatcattgttcaagtctaacctcagagacactagcaattagaagttaggaattcagggtagaacactggaaaacgaagagcctggaacctcccttccaaaatctttttgttagtgaacagcctattctccaccttccctgaactctgaacagctgaactcacctggagaaaaaaaattgcaacatctgggacccttatctcaaggcaaccctaagaagtgggtttactctgttttcgtgctgaatttgttctctcattttatgacgttatttcatagtttctcttctcttctctaaactctaatactctttcttctttcctcttccttatctactacattcattttctagttaccaaagaaagtgaagaaatcagaaaaaagaatgctgtcattctttcaacatcaaacctactatcctatctgcatctatgccaatggctccacttcccccttgttacctgagtggcaccacgttacttctatctaaacaacctctcaacatacattccacatgccctcccctctttccaaccgaggtgtattcctctcttcccctccttcatcatttgcttcactatatattagattgttctcaacagcctaaaaacattgtaatagtttccattaaaaatatatgctggcagtatattcctttcagatatcatctcatacctgtatttatctttgtagaaaacttttttgaaagagtgttttattgtgttgacttcattccattcttgtctcccttcatcattcattccggctttagcccccttcaatgaggcttttctctaatccctccattaagaccaatctcatgaaagtcatcagtgacctgcatcttgggaaatccaatggtctgcctcagttcttaattaaacttctcaaacttttaacctagctgagtacttctttattggaatgctgtaaatatttatttctgtatgtatctgtttgcttgtgtgttgcccttctccatcactaaaacgtaagagcaagttctgttttgtatactccttggtcttgtatcttgttttgtattcccaatgtctaaaacagtacttggcattgactaggtgctcaaaaatcacttacagaatcatttaaacagtcatgtatttgagtaacaggcacatgaagttataaacacaaacataatttatcaataagacaaatattttgggagtcagatgtttcttacctttagtctgtccagagccagtacagcctaaaattaatttggtaattgggctttagaatctcttcatttgcatttgaaatgaacccatccaatatgtccactgaactacacagcttagagtgaactctctccagttgacttaggataagtaagcatattcacagaagccattaatctggatccgtatcccatgaaaatataagactaaatcttaactggttttgtgaaactatgagcaaaaaagtgtaagccctatattgtcaggctattccaacaggcaataccactgaaatgcagtagctcctccctaagctaagtgccaacaaggagtgaaatgtgctaggtgcccaattagtatctctacctactgctcattccaaaggtctccaaccagctattgacctaaataatccacctagtttcaggccacagccaagaagtctatttatagctcagagtaaactaatagctgagctgagaggcctttttcttatttgtaattctcccttctaaaatgtaaggaaactaacataccagaaacacatgaaaattataagcccctgcaacagccaaattccaattctgcgttttccccctaaacaaaaaggaaacaaaatgttgagagaatgtcaagctgctaccagccacattcagcatacttgggatccacagttttaatgaaatcatttagcctttcaaccacatggcacttctttatctgcagatgaaaatcctggtttttagtattaaggttgtgaaattaaggttgtctttaggattaaggttgtggtggagatacaattttttccttaagttgttttcttcaaggaatttatccacaagaaggttaattatgacatatttttatagatgcctaagtgtaggatttgttttagcattaatggaccatctaggccattacagaaagatgttgggatatttaagaagtggtattttttaagaaagtaagtcaaaacatgagaaaatgaacttaaatagctagaatttataatcttttaatctgggtctgtgtcccatgaaaacataagactaaatcttaactggttttgtgaaactatgagcgaaaacgtgtaaaccctgtattctcaggctattccaacaggcaatacctctgagatgcagtgtcccctccctaaacttttgtttataattacagtcaacatttattgaaaatttttggactcaggccaggctttgtggctcacacctataaacccagtactttgggaggctgagatgggaagattacttgaggccaggagtttgagaccagcctggtcaacatagacactgtctctcaaaagaaaacatccgtactctactgaattctgggtggatcgacaagtgaatgcaatggtcctcactcctgagggtgttttacttcatatgatgaaaagatatattagaaatacatttttaagaaatgtattaatagtgtgatctatgataaatatttggcctaatttcttctactttctgagcagttgtcttggcacggtgaagattttcttgagttggggaatacttggaatgtcaaagaatctgtcttgaggctacctgctattttacttactaaggtgggagatgtaggggactcactcatttcaccaggatttattttttggacaaggacaaaataaaaatgagcttttataaattgtgttataagaaaattcatagatcagaatcatagctctgattatacttcatgactataatattttcatacttggtgtctgtgtttaataagaatgagcccaacaactaggaaagcatcctgttagtatcttcagggggtgtcctgtacgggatacataatggggtgcctgagtgagataaagcaacataaaacttttatgtccagggaacaacacgtatgtgacaaagcaaagggaatctaggactagagaaggtgtaatgcctgcaggttgtttatacagcttgtactatctgggcagtgagtggaaaacttgatgcaaaacagaataaggaaacatgctcgctaaaactgagcatggaggtgagaaaaaatagattattttctcagaaagggtgaattgcaactccatggccagttggtatctttccatttaaaaagacctccctggttgacttgatttattctcaagatggcttcgacacacggaaaagtgggtcacttgatgagaaatacgctggttttcaataaaggggaaagtgatgtttttttcttcaacttagttccagtagaagttccaaaataactggaaagttattctgtttcttttactctccttgtgtcttgtgaatgatggcaggtttatttcaaaattgtgagaaaagaaaaacagtggttggaaaacatgaagtggtctgtttattttggccattggtgagaaatgttctggaaaagctatctaaactgaattccagctgtatgtcactggatgctggcaggatttattggtgggaagttatggcaaacatcttgatggctttaaatctgtattcatagctagtatcttttgtgtaattatacttaaaaatcattaatttcaaaaaaaaattagagaatttctctaatgcttgtacattgagaggggaaggaagaaaaactagaaggttagtcttttgaactgctatagttttaaagatgacagaacccttcatctcagcaagagcagtggaagattaaaaatattagacatggccaggcattgtggttcactcctgtaatcccagcactttgggaggctgaagcaggcagatcacctgaggtcaggagtccaagaccaacctggccaacatagcgaaaccccgtctctactaaaatacaaaaattagccaggcatggtgacaggtgcctgtaatcccagctacttgggaggctgaggcaggataatcacttgaacccaggacacagaggttgcagtgagccaagatagcaccactgcaccctagcctgggcaacagagcgagactccctcatatatatatatatatgtcttgactaagaccagggatatctcccttctgttattctgaaggtctgcctattgaatagtcaatcctgaagataagcaagataaagaattaagaacaggaaaccacaccaagctctctgtctccatttaccccttagacagatgtttctttaagttttttgaatgagcaattcattattgtaatgatatgacaaagagaatggatgctaaccatcctatgatccaagtttatcagctacatgatattggtcagcttacattcctttatctcttggcttcctcactgttaaaatgcacatgattctgcctaactaataaggtacttataaagattacattagaatatgcatatcataccttggtgtctgaaaaaagctgctgtattactcttattaaaaataaaattaagcaactcctattcctcttaaatttctattttatataaacctgcacctaacatgtggaaattgagagaaatagcttcagttttgtttgccttttttgttatggtattgatttctattatagttatataattatagtatataatggaaattacctattttttgtctaaatcagtgacaatggatgcaaaaagtacaacactccaaggaagtatctctgcccttgaaatttctgagaaagtttcaacaactacacttcagactaatggaaaatatgatcataattgttttggtttgttttaaaaaaatcaccttatgtttaaagaacattatgaacaagcctcaaactgttctgctgctctacacacctacaagtgaaaatcaatatttctttcaaaaatttccatatatgtctcagataaaagttgcgctgtgctcacatttttctaatgtgacatatggttggtttcaaatgcatgcccaggaggcaaaatactgaataaactgtgatgacttatagtttagaaggttttctcctgagggggggaaaaacagcagataatattgttacaggaaatccataagccaaaaagaagtttcaaataactctttctcccaagtcttccacaagctgtccttaaatttttaaagagcacttgaataataaaatgtgttggttatagccccatttttcttcatgactaccctcaaaacatttactgaagatgctattttaagctgccatttcaaaatttttaccaccagtttgtagatgatttctactcagttgtacaacacaatagcatacaatattccctccattcattctgacatggatcatctatttttctgcccaaaggattgaagtgagaatggcatttggaagacatttcaggaacagttagggcaagagataggattaggtgtccctgtgcctacacggaggaaaataagtcccactcctctaccaaaaagaaaatttagctttactctgatgctagatgacttagtgattagccggccatagcttgaaacattttggagtcttgtttttggtagagaagagggaacattctaaatttcttccattctctttttttttaatgggaatgagtctttcccctttgaaggaaggggctggagtgcagtagtgggatctcagctcactgcaacttcggtctcccagcctcaagcaactctccggcctcagcttcctgcgtagctgggactgtgcgtgagccaccacactcagctaatttttgtatttttagtagagatggggtttcaccatgttgcccaggctactctcgaactcctgacctcaaattatctgcccgcctaagcctcccaaagtgctgggattacaggtgtgagccaccacacccagccaaaaatatgtttatcattttacagtcagccctctgtatccgtggagtttccatatccatggattcaatcaacccagataaaaatattcagaaatatattgtatctgtactgaacatgtaaatacttttttcttgccaagattacctaaacattacagtatagtaactatttacatagcatttacattatattaggtattacaagcaatttagggatggtttagggtatatgggtggatgcacataggttatatacaaatactgcaccattttatagcccggacttgagcatccccagattttgggtaactgagggagagatgactttatacgtgaatgatcagtctagcaaacccagccagggcctggagggggccctactcagtctcaggctgagaacacctattgaggttaggtaggtcatttaagttcattgaactcaaatagtcttttagtatttaaattccttctagatcagaggttcctaaccccaattgataagcagagtttcctagttagagagcctttaatagctacatcctgagcttcacctttgaggggagggaccgaaaacagcattttaaaatggctgaggtgattttgatatagcatagctagcattaatttgtgaatttgcatttgggaagtatatccctagagaattcttaagcaacttctctagagtcttgtcaaccttgataaccacacgtatgtttgaatatctcatactgcaaaactattatttgcctaggcagcacatgctcttttcagtagacttgactgcatcaaagaaaacaatattaaatgaaaatgcacctgcataaattctctatcaattggtattctgttacttgggggccatagaaaatctaattcctaatccacacaatagctcttctactactatttgcagacaatggcaggcacttgcatttcagtcatttcttctctagaaaaatatttctagttcatttagtctttatgtgacttgattttaaaatgtatgtattccccttgcttttctttgaatttacccctgaggtttctcaagtgagggcttcaactgaacacaagtcccagtggggctgggttcgtaggtgtgtgagctgcattatctcaaaggaccctccaactcaggtctgtgcttggttttgtgttgttcattgagttgaaatttatagtagtagtttttttttttcttttttaagcaagggcctccacatttccactttacacagaggtcacacaaattaggtagcctgtcctgtgtcccagctctagtatgatcttgtataaacggttcaattcccacatgccccatgctaatggaacatggtatacattatctgttttagtagccatgttactcctcagttcatactctacatactacgggatgcaactccaagattgttttctactacacagccatgtctccttcatgatggatttttgagattgttgtgggaaacaaatacaagatgttatattgattccagttaagcataatctttaaagatttggcttatggttccagacctattgagacctgattaggttctgattgtatcatccatcatgtttgttgtccctcttaactgcatgccaccaaaagacacttacaaccccgtcttataaagtgatgaaaaatatcatagtaggaagcatttaaagaaatatgaggaataatggttttgatcatgtgatctagttgctattgtcttaaagataccgaaagtctccaatttcagtagccagtgtgtaatctttattcttcttgcctaaaaatagtttgatagtctttgttgtcattgtgaataagaatgtgaaaatacttcagttgtaatgggggcttcggccaacagaagactcatttctgaaactatatggtatgaaaaactcacctcagaggagttataattatttaatgcaaatgtagaaaatctagtgtttctgtctaccttggcaatgacatcttttggtttggatgcttcagggagccagttactttagtaagtgctttggtgctgtatgagagaagacatcctcaagtgagaaaggtacaagagatgtgtaaatgttttcccacttacaataggtgatttctgaattatttgcttttattccaatttaatcatggaaagttttaagaaaagtaaaattgtttaagatgatgacagttttgatttcagctatgtatatggtcaggtaatgaaatatgattttgtttgcttatataattaaaatacaattaggtcaaattaaatactagcctggctagctgttatgctgttaattagaattttaaacagtatttggatactttaatcatttccctattttatctgagtaatcattccctcagaaatacagaaatgaaaacctcagaagcccagaaacataacattacatttgagctaacttttcttttcctacataaagctgcatgcattagtgaaggctgatgctcagtttcttgtctgagatttctcattgtactaaaacagattcaagggtgaacttacagtaggatccgtatgctggtaggaacaccttagtcctagttgcagtgctggaagaacttgttaatttgctttagatctattatttacccatcatctctaaagtgaaggagatatcatggcacatcactgaagtctctttaatctccaagattgtacacatctgtaaatttgtgaaatgcctccagagagatagggcagtataaatgattcatactattgattcacttggcaagtggaagggctgagctcagaaataaaaaggcaattctattacagttcaagagtctgacaggaccccactactcagacctcaagaagtgctttgtagcagttgaaaatgatactttaaaaagcatgtgtgagatctgtgttcacatgcatatatatttatgtattactcaccaaaaattactgagtgtatactttttgccaggaactgttctagatgctggggatatagtagagaacacaacagacaaagactctacctttatgggcttttattatgtggcaaaatataccaggtgttaaataagataagcaattctattacattaaaactagactgaaagtttaggcagcaaatgagtgggagggatctgcaaaagaaaatttcactttaaatattgtggtcagggaagcacccactgagaagatgacatttgagtgaagatctgcaggaagtaaaggtgcaagccttaaagatttctggagggatgatgcccagaaagagccagcaggtacaaagttctagaggtgggagcctgccagctgtgtctgagaaataacaaatagaccagcatgaagggaagtaagcaagccaggaagagaggaagatgcagtggagatacaataggaagccaaatagtataaagcaagcttgtccaactcgcggccccatgggccacatgcagcccatgaccggtttgaatgtggtccaacacaaactcacaaactttcttaaaacattttagatgctttttgcaatttagtttttttagctcatcagctatcgttagtgtattttatgtgtggcccaagacaattcttcttctagtgtgttccaatgaagccaaaagattggatatccctggaaagtcttgtcaactattttaaggtccttttcactcagagtgaggaaatggatgtcttactatttaataggatccctctggctgctgagttgagaatagtctatgtgcaagggcagaagcagcaggcatgttaagaggctattggatgaaattgcacagtcacacattatctttttctaatagactaatacctattactagactatctgtagcctgatcttctactcttgaattagtcactcatttatagatataattgttgactggtacaaaatgctgtcattgttctagactgaagttatttaattgtaactgttaatgtgaatgcccccgttgggacccaagaaacctcttttatctaccttcatagacctagggtaatccatttccattaaatgtaggtttatcaaacccctactttatatcaggcactattccaattacttggaataaatcagtgagcaaaggagactaatagccttgtcctcatggagttgaattttaaagggagaagacaaaaataatggctgcaataaacaattgatagagtttattagatggttatgagtgtaatgaagaaactacaatatagatctcagggcatagggcaagtctcggtattagtaggacattctgatcaggctttattaggaaaatgagatttaaataagaccttaaggaggtcagaaagttatccacggagatttcttggagaagaatatttcaggcagaggaaacaagcagtggcaagcaaccaacagtgcaaaacctccaaggcataaacatgacggtcattttcaaagcatagcaagatgatcagtatgtctagagtgaagtgagcaatggagaattagtaggacatgagctatgattagaagtgagagccagaccatgtagttgcttggaggctagtgtaaggactttggattttgctttgtatgaaatgaaaagccaaagaaggagaaatatgatctgatcaagcacatcgttctggctgctgtgttgcgctggaatatgggagggcaggcgtgaatgcagggaagccagttaagctgttgcaacaatccagtttagagaggatgaaggctcagagaagggtgatggcagccgaagtgttgagacgtggtaacagttacattctggttatattctgagctgaatcaaacagaatttgatgacagattagatgtggggtctgagacaaagagaactattatgacaagattttggggcctgagaaactagaggggtggaattgctatcacccaagatgaggaagagtatagcaaaagaggatttattgatctatccatagttttgccttggacaagacaagtttcaacatttaagtgaagatgttgccttggcagataatatacaaatgtggatttaggatggaaaatttgggttgaatatataaaccaggtagtcatcctaatgtgttaggattatggtttacagtggggtttaaagccatgggcagcatgaggtctataaaggagtatctgaagatagaacaaaggaggccagtgcccgagccctgcatactcccaaatgaaatgatttaaaaagaatttttaaaaatcccttaaacacctcagaattcagcttcgtaccttcttctacatcagtaaagatctgcaatggaaatagtttaaacttttttcagactggtgggttatttagccatgcttgcagcatgatcatttcgggaggtactcaaagcatagtgtatcccaaacaaaaaagggaataggttttcctttacatgatggcaccagccacttggtagtgactgattggtatgctatgctgcagcagatgtggaggttggatgtgggtttcataggggaaagagcctcacaatggcttagtgaggccttccaagggagcaaaatgggcgaagcctggtgccatgggtttgcttatattttgcaaatctcataaatgagaactctattgtggggggctctgacttttggggatcaaactccttttaaagaattaggattataaataatacctatcaaaactctgcatgtacctgtgcaccctcaaaaaccctgtgcaccccaaaatttatgcatataattttagtaagacttctgggcgtcttccgtggactcgtttaagaatccctgctgtactaactcaaaaacagtcttaatagcttaacacaatttctttccaaatgtagtcagtttcaatattaagtttggtagactctactatttagcataagtagcaaacagacatgagatagttattccactattattgttctaatcacttcatggagaaacttgccaagaataattaaaagtaatttgcaacttcattgcccttttattggccattgactttgcaaacagaatgtagctatggaccaagtggcacatgttcatatggtttgccagtttggggtacacttataaaatcttttcattactaatgtagtaagcaaggctaactgaattggtcccctcaaagacagatggcaattccagacattactaaatttttttttccaaaatttaaaatgtacatattaatgatgtggaactactcttagattagccatatgcatagccctctgccatagccaaatgagaatatataacctcttgtttaataacaatagggttttgccatcaaagaggattgaatagatagagcattctggcatttaactattgccagaaattgtacctcagctttaattacactgaaacaaaactcactggcacatatcttccacatgcacctagtccacgttaattacctccacttagcaagtccacctgtctgagtgttagggccacattttcaatacaagttcttctagctgttacactgctaacccatggttctcaaacccaaagatccttgggaaggctaatgcatctcttttagagccctggagtttgatttgtagccagctgttttgaaaattccaacccataaacatttctgccacactttatagagggattctaaacacaaatgaccactgggatgaggcaattacaagacctgtgataaatagcaagcacatcccctgcccaatgacattgagtattttttttcttttgagacagtctcatcctgtcacctaggctagagtgtaggctgaatcccatcccagagtctcagatttagtaaaatctaaagtagaaactgctagcaagttcccaaacaatgctaaggtttctggtctggagccaccacattttgagaaccaccactacaatccttattaaatgttatatgtttctgttgggatatgaggtgaaatggacttcaaactgtttaaaaactttacttcctgacaagagctcactgcagccttaaattcccaggcttgagcagtcctcctgcctcagcctcccaagtaactgggactacaggcgcgtggcaccatgcctagctaattaaaaaaaatttttttgtagagatagtggctcgctacatagcccaggctagtcttgaactcctgggctcaagcaattctccggcttcggcctcccaaagtactgagattacactgaagatggttttacctcctagtagaaataagcaggtcagtctgccaagctccagcacagaactcccggggcctatgtgcttgggtacatacacagcagcttctgcagaaaacaggtctctcatctgtggcttagcactgtgtggaggagggcagagcttccacacaggtgggaacacatccggcttggcaattgttgtaactgaatattagcctcatgccttcttctctttatagcagttggatccatcttcaatcagcatcacagaacacaaactctccagctctttttaggaagtaaagtttttaaacagtttgaagtccaattcatctcatatcttaacggaaacatacaacatttaataaggattgtagtggtgattctcaaaatgtggtggctccagaccagaaaccttagcattgtttgggaacttgctagaagtttctactttaaatttactaaatcagggactctgggatgggactcagcaatctgctgtcacaagtcctctgggtgagtctgatattcactgaaacttgagaaccactaatcccaggcaacgtttccgaactttttgtgtgcctaaggattgcatggtgagctcgtctggggtgttactgaacatcttaatttctaacacttataaaagcacacaagctaatgtgtgccttctacaccaaaatatttgtaaaaaaatttgaaaaatatatgaccttattttacagaaccatttactgcttagaatcaaagcttatcaaaattatttgaaaaattagaaaagaaatatgttttcttagtgacaccatttttttaattctctgtggtcttccttgtgattagatgagtaatttataattatccaatgcatttaatatacttcagaaaggcaaaaaaggtaagttttcttgttggaaaaaaatgactggtacaattaactactatatgtgtttatgtgtgtgcatacactatatatgtatatgtatattggacatatatgtatatatttgatcttttcatgttactgctcgatattaaactatttcttcttttgtaggaattctatgaagttgaacaatttgcattttcttaaatgtcttattttacatgttttcataggcaaacagctttttaaatgcactttagtaattcactgatatacacgattgaatttaggttatttaacattccatgggtgttttgtaattcataaagtgagagtagtgtgttatttaacacaatgccacgtatggccatggataaactggttgttgccataaatcctgaaagaaatttctgggagaaaaacaatttatattacaatcctctttgttttccaaacacaagaataattcaattttaaaacaccactcaagatgcccaaccatttcaaagtaatttactttctatttttttcccttgactttcaaactcattttttatacaaattgtaaagcatggattttaaatagggaaaatattgctgatagacatttgttttgctcaggagttaaactactgctgatttcactgcattgaaaatgttgaaggaaatatgactgaatattttcaggagacagattttgttttgatttttgttatatcatacgatcctatttcaggtctataattttgaccacgcaactaaaatttacagcttcaaagaatcttcactttagcaaattgaaatggcttcagagtaaattcacttaaaataactctcagtttgtatagagatatctatatatccatatataatgtgtattttaaggtatatttccattcctttaaatgaattcaaaactgatttttaatgaaaatgattcaaaagtaacatttattgacaaaaacttctttgatacgcattttatttttaaaaaatcttttcacctaggcataacatttaaaaatatttcaaaaagattcagatggcaccatgagaaaaaataaaatttgttatccttttgtttactccattcttatgctgctatggaaaaatatccgagactgagtaatttataaaggaaaaaggtttaattgactcacaagggaggcctcaggaaacttacaattatggcagaatgggaagcaaacatgtccttcttcacatggcagcaggaaggaggctaatgagtgcccagtgaagggggaagcctgttataaagccatcagatctcatgagaacttgtgcactatcatgagaacaggatgggggaaaatgctcccatgattcagttatctccacctggtccctttcatgacatgggattatgggaactacaagatgagatttgcatagggacatagccaaaccatataattcttcccctggttcctctcaaatttcatgtcctcacaattcaaaacacaatcatgcccttccaacagtctcccaaagtcttaactcattttaacattaactcaaaagttcaagtccaaagtctcatctgaggtaaggcaagtcccttccacctctgagcttgcaaaatcaaaagcaagttggttacttcctagatacaatgtgggtacaggcattgggtaaatacacctgttccaaatgggagaaagtggccaaaacaaaggagctacagtctccatgcaagtctgaaatccaacagggcagtcattaaaccttaaggttccagaatgatctcctttgactccatgtctcacgtgcaggtcttgctgatgcaagaggtgggcttccatggccttgggcagctctactgctgtggctttgcagggcacagccccctcctggctgctttcatgggctggcattgagtgccagtggctcttccaggtgcacagtgcatgctgtcatggggtctggaggatggtggccctcttctcatggttccactaggcagtgccccactggagactctgtttgcagggttccaactccacatttcccttctatactgccctagcagaagttctccatagggctctgcctttgcaggaaacttctacctgaacatccaggtgtctccatatatcttctgaaatacaggcagagctttccaaacctcaattcttgacttctatgcacccactggctcaacaacacatggaagctgccaaggcttggggcttgcatattctgatgccatggcccaagctgtaccgtagccccttttgaccatggctggagtgtctgggaaacagggcaccaagtccctaggctgcacacagcaggaggggctctgggttgggcccttgaaaccatattttcctcctaggcctccaagcctgtgatggtaggatctgctgtgaagtctctgacatgctctggagacacttttcccattgtgttgatgattaacattcagctccttgttacttaggcaaatttccatggctggcttgaatttctccccagaaaatgggttgttaatttctgttgcattggcaggctgcaacttttccaaacttttatgctctgctgttcttgaatgctttgcagcttagaaatttcttctgccagataccctaaaatcatctctctcaagttcaaaactccacagatctctagggcagggacaaaatgccaccagtctctttgcataacgagagtgacctttactccagttcccaataagttctccatctccatctgagatcacctcagcttggacttcattggtccctatcactgtcagcattttggtcaaagccattcaacaagtctctaggaagttccaaactttcccatattttcctgtcttccgagccctccaaactgttccaatctctgcctcttacccagttctaacgttacttccacattttcagtatcattataatagctgcaccttatttatgataccaatttactgtattagtccattctcatgcttctataaagatctgcccgggactgggtaatttacaaaggaaagagatttaattgactcacagttctgcaggactggggaggctttgggaaacttacaatcatggcagaaggggaagcaaatacatccttcttcacatggtggcaggaaggaaaaaaatgaatgcccagtgaagggggaagccctttataaaaccatcagatctcatgagagctaactcactatcacgagaacagggtggggaaaccacccccatgattcaattatctccacctggctcctcacatgacacatggggattcaaactaagatttgggtgaggacgcagccaaacgatatcactctgtttattaaattgttcatctacaattttgaaggagcactctctatttgtccttatttttaaactttataaaatttttatttgaggctttagagggggtattatacttttatattatgaattttttgttctaccaagaatattttatgttgacatttttaattgaaatatatggctctattttcttgtcttagaaagtaagatatactgaacatatttgaatcacattctggtgactaacagatttttacaattgttcaggataatacttgcatgtattagtatgaaaaaattctacagttgtacacaatgtcagtgattgtactggctgtgtctttcccctagaagatgccggggtgtggtgggggaggggaagaagaaaaagaaaacttaatttttatggtaagaaatcgattattattctatcctcattttaaatcatcaagtaataataagtattaaacaataataagtatttactcaattcttactatgaaccagatatttggaacatgggaatgaagcataaatcatgttctttaaactaaaagaacttggagaaatggttgcaacagcatgtgataatgcaaattatttttggcttttatattattttataaatggccaatgagccaggacaacagtgaatttcataggagttcataaaatggaaacacgaactaaaatagtttaccaacactttgggagaaaatggaaattgagttagaatttgaagaggatcttagaagataggtgatttgggaggaagtgaaaagaagggatttaagctggttctgggaaaagaaaacagcttgagtaaagatggaaatcaatgttatttttatttagtagaagataacaaatttaccttgactgaagcagaggacatgtggagcaatcacaggaaaaaaaataactttagagtttaggccacattgtagagctgaaaggcaaaagaacttggacatttacttaaccatattacaagtcctataaaaacgttttacttagtaggagaaattatacaaatgaatcaacctattcaataatacatgaaaatgaaatgactttgtttttaattgacacagaagttttctattaaggtgatgaagtgtttgcacgtgtatgtgtgcatgttcaagtatgtttgtgtgcatgtgcgtgctggagtcatcatttatcacaataaaaggttgcagctacccacctaattaggcatgaagcaagcaaagactggataaggtgatctttgtctcactttgctcctgagacatctttgtctccagtactaatcagcagtgacgcgtcaagtcatcgtgagtgacaattacagtcctctcattacaggaaatgattgcacgactaggcagattgatgagtgtattggtgttccctaagaaactgagctcctccccaccagccctcttcttgacaacattgctgaatattattaaatacatatttaaggcaattcaggtaaagcttcttcacttggcaaaacaggttatgattgcttagaaatttattctaagagcaaaatttaacacatctccctgaattgtatcttcattctgagagtctgtgcttttctgcagtgccttttcaccttcagtttgtgcaacagtacctgtgatggtgtggattaggtgttacattttgtttagacatggaaaataaaataggtagacaaagtattttgttgaagactggttagttggaagctgagtgtcagactcatttcatttcataccttgcacttccagttgcagatacctttaaataaaacatagttcacttcttcccactacaggccaatggattggctctagcccagtggtcctcaaacttgagtgagcataggaatcacctgccctatacgcaaggtttctcgttcattagttctccagtgggccccagttacttaacatttctagaaggctcccagggggtgcagatgttgatgctgaagctgggggtctggagaccaagaaccactgaagcctgtctaaaggggtaacttcttattggtcacatttcattgcccaactgttcaattccttgatgttccccagaagctttcttgcattccaatcctatatgattttgagttctttctggacacagtctgctctgttatctgaacaaacattttatctgatgctttcctttgatttttccaatcatagtctcatggtctatcaccatgagacagggattgctttaactagagaaatgataccaatactgtttgcttagattgattttctgatttactagtattcaggcattaatatgatctggtgcctgcattctcagtaacaccaatatttgtagaaccattctaagtgtaactttgatcaaactaatcagcttggtatttttttcatggatggtccagctgtcaaaatacagatgtgttcattaacctaacgaaactgtcccagtatgaactatgctgattactttgactaaagtcatcatcagattggttcttgggatccttctagtccaaactgctcacgcagggcctaaaataaaatgactaaaaatctggctatctggctatcgcaagtagaacaattggaggctaaaaagtaaaatattattcttatttaaaccatgaacatcattaacatatttattcaaaagttcttgtccaacatctgcaatgtgccaaacacattcttccaggtgcaggaaacacagcagtgaactacaaaatgaagtctgaatttgtagaactcatattctcaggaaggagaaatgataaacagggaaacataaataaacctgctaccttctgaaaggttagatgctatgatgaaaaaaaaaagcaggaaaatatgatacaatgactgggtgtggaagctgatttaggtagaatgatctctgcaggtctccgtgaaaaaggcattcaggttgagacttgaatgaggagaagtagtcattcatctgtatctcagagtaggaaaggtaatggtaagacttggagtgatggtggaggaaaagcttttaagaagaagaaatagaaagttgcaaatgccttcagccagaaaaatctgggaccttgttggctgtggaatcatggtttgattttcttctaagtacatggagaatcagaggtgacataacttgttttctgcttaaaaaaaaaacaacactctgactaatgcatgtagagtgcattgtaggagagtaagactagaccagttacaaggctattttatcaggtctgttttagacattgaccttgaacttgcagctgaaactttttaaactaaaatgtctctaagtatttccactagcagatcctaaattgaataccaggaatttggctcctgcttttagataaaacactgtaaaaggcattctgtccgagaaaggaattgccatctgctgagaagtgacaatgaactgggatggtaccagtacatgtagtgagaagtagtgagattcaggacctattctggaattgtatttgaaaaggctgtctgaaaaaaaataggttcactgggtatagtgggtgctattggtgacctgtccagacccactttgctggctggagagtcatcctgtagttgttgggagtgctggctggcaaaagcttacagctgcctctgtcaatcactcgtttccatctgaacaacatttttgccattcccccctcctcccatccatcttctttcatcccctttctccataaggcaatgtttctggaagtgtggtcctggaaagagtatcatcaatatcacttagtaacatgttaatactataactgacaaccggaacaaatatgagatatatcaaacagaaaaatacaaagattaaagtttgaggatattccagaaatgacaatttttgcgcatatatatatatatatacatatatatcaatgaaactattttaatgaccataaaaagtattgcattgtaaagaaaatttagttttatacaatcaaattatcaaaacttatcattgaatgtgtacagtaactgttaatgccttaaataccattgcttcctttcaaacataatttcttgtttttcctttagtcatgagtttagtaagggaaagtaaatctcacatgattatttttagaaacatatatacatagtaggagagcagagacagagctttactataaggtattgttcacttgattatggaggctgagaagtcccatgacacactgtcttcaagttggagacctggaaagctattcatttagtctgaaggcctgagaatcaggaacattgaggtaggagattgatgtaccaacttgtcagtcaggtagaaagaatcttcaaccttcttacttctttttgttctattaaggcccttaatggattagatgatgctagcccaattggggagggtcatctgctcactctctccaattcaaatgctaagctcttctggaaacaccctcatagacaccctgaaataatgtttaaccaagtttgtgtgcatcacatggcctagttgagctgacacataaaattaaccatcactcttacttaatcagaaattctggagatgatggggtccaggactttgtgttctaacaagccctccaggtgattttgatgcatgctcaagttgagaaccattgaaatagagtggtccctaataagttatttgaacaaaaatctcctttcatgctttcctaacagggacctgcaacctaggatccaggaatgaaggaaaaaaataattgagggtaattcctaggtttttgtctttagcatctggcttagtttcactagctgagatgagaaaaacttgaagagaagcaagttcggagaaatcgatcattctattttgaacttggttactaatttaggtgctttttagatttcccagtgggaatgtcaagtagctaatcagatgaagtctggtattcatgtgtaaggtcaggatttgagttataaatgttacagcctttactgtatggatagtaagatttaggaagaggtcctagagaaagaaaagtgtatagcaagaacttgtatctttttttgcatatatttgaaacaaattattagttaaatgtattaaaaatacaactagactgtgtttatgcaaaggattaacaagattttgctaattactaaagaattcaaggatgatttagctttaagggtatatgaataatttttttacctttgttacctgctaagtagagaagccttcttccagaagatgacatctatacctacctatatttggatgctagagaagcagaacctggtgaaagctcaaggcaggtctgatccttgcatcaagcagagaaatacaaagattgaagtttaaagataccctagaaatgaccatttttgcacaaaattattttaatataaaaagtactgcattgtaaagaaaaacataattttacacaaattattaaaactcataattaaatgtgtgcaataactcttaatgccttaaaccccgttgtttcctttcaaacataattttgtatttttcctttacaagtgaaagtaaatctcacatcattatttttaaaaacatatattgtattcagcatcttttcatcactcactgcctattaaaaccccactaacaattaaacacatgctggtcataattgtgtcaactgcttatgatgccaaatttaacccagttgtcaggagcagattgctagaacacatattaaatattttcctattatttgaggactagcaccagaaaagaacaggaaatatgtagggaagaggggacccactgtgggctgactcatttttcagggggtgagtttttatatacaactttaatcctccttagaaaattattagcatgatatagtatgatgctgataaacatcgcttttttgaagtcagacgtaatgacttaggtctactatctaccaattttatgaccctaggcaagagaattgatctctctttgcccaattttcttgtcaataatgtgaacaccccatagggtcattgtgagaattaatccacataacagagacaaaatacatagaatattgcttggaatataggactggtcagataacatcctcacctccatatctactgtgcccaatctcctctgggcttcaggaatgcctagttaggcaaatgcatcattagatgaaccagtgtctgttaagaaggatgattgattgatagataggtagatacatagataggcagacagacagacagacagatagatagatatagatgtgagctgggccctgggtaagcactctttaagagggttaacctccatttaggaaaatcatctttaccttggtctcattaatacatgatcctcttgtatgttttccacacacatagtaattggccttgtaactccagtattaccatgtgttaaattccaaaggagtttgcaaccatttcctcagtgactcatcatggtatacattattttattcatttatctaatatatgttgaggtcataccatatgctggaaatcatgctggattatgtagatcagtattatctgtgagttacaaaaaaagaagtgacacaaatacatatgaactagtacaaagataaagagatctatgtagagttaaaactaaaagtcattctctaaagactgactatattgcttcttttattcatgaccagtcttgtgaacttagagaaaggtagggcttcctctttgatgtttgtcacccagtgatgtcaatgagtgaagatctgattttgaccatcaaaagtctctggacaagaagttctgaatgaatggctctggatttgtgctttatagtcagtatagtccatgaaacaactatgggaaatattctttggtaaaggaaggagaagaatttgccattaaagataggcagttttctgcctaacacaatgcaaagacctgtccaagaggtattcatctgtgctaacatctgacctccgtcttgacaagatgtcagtgaaaaatgaactcactgagatgcatttcagatcccttgggaaaagacagacagagagaggacaaaacataaggtttaaaagcagcccttaggagagatctgagaacaatttccaagaatattttcccatgtgttaccaggaaaaggcaatacatcttaaagaagactgagctgcccaatcagcttacttcacttcagtgaactcctccctgagacccctgtagctactctcaaagctttatattgacacaatttaaaatgtgaaagatagtaaaagttaatgtaattatcccactggatgatctcagcaattctcgatcaaagagaaaaagccatcataatgcaatgcctagcaatggctcaaaagcacagccatggcccccctgagaggataataatgatcccaatagcaatacaaccagatctcttaggaaaaagaccatgaaaacctctaaacaattagaggctgcaaacctggcaccagcatcaggtaaggcacagcctcctgaaaacagtgggaggcctcagggatcatgcccaagttcaaggtaccatgtaaaagattgctcctccatcatagggcatagaatagagccatgaacattaactctttaatagaagttttagaagaaaaacttcaggcaaattaaatttaacagcatttatttgagtaaagatcaagtcatggatcagggcacactcagaaactgaacaaggtttagaaagctctgcttcagcagcctgagaagtcaagtacagacattacttgattggctactgctaggtatttaccttatttgtgtgtgatctgggggaaagtccctccttagaggttagtttgttgtttctgattgattatacttaagtttccttttactgtgtacatggagcttcagtgtgcttatgtaaggatccaaggcactggggttgcctcagtctaatgttcttccagttttttgtttaatagaagcaatggtaaatggcatagttaacatctatttcagttttcctttacaaggatttcattgatttccagcagttaatacattcctctacactatgaactcctctcacaggaagcatggaccaaagaaaagtaccgttaaatttctccttatgggctacagtactatgaaagggaaagagtttaatgaagaagttctgagcctcaaggaattcagcttcagccaggcatggtggcacatgcctgtaatccctgcactttgggaagctgacgcaggcagatttcatgagctcaggagttccagacgagcccgggcaacatggcgaatgctttctccacaaaaatacagaaattagccaggcacggtggtgccaaaatgtattgtcagctactggggagtctgaggtaggaggattgcttgagccagaaggctgaggctgcagtgagctgaaattgagtcactacactacagcctgggcaaaagattgagaccctgtctcaaagagaaaaaaaaaattcagatttaactgcttcctcctcctcttctatctcccccttctgccactccaaacacacacacacacacacacacacacacacacacacacacacacttggggatacttgtcttggtgtctctcgcagagattgggagctttcagaaatggtgtgtcaggtctgaccctattctttttaaactaagaaaaaggagaatgttgatgactgagcttcaactggaaaaagtagtggtggagaaagacttccaacaggagttcaataaccatggagattatgtgatggatattcaccagaaatctgtgcaagaagtggatggttcaggcagggggcgagcacatggagctggggctgtcagtgcaaatatagggaatatttcatggattcagactcactgtgcagtaagaagtcagcctgcctgacttcaatatgtaagtgttatgttgtggagtcctgaccttacaggtagaatgaatccatttttaaatggaacgctttctactgagatgggctttcaatttggagcccgttgttattctcttttcgtctattccttatgtaaaatcccttcctgtaacatacacctagaaacatgttttatattctcaatttagacttggtttgaaagttttgctacttagccattttcttcttgtattaatctctgtgtttcacacttatatttgaatttacatacccagaagttaaggtcaaaatgttggacaatctgtaaagcataagcactgacccattagaatcagcatcagccattgtgttggagtagaatctggaaaccaccttgacccattggttgctggattttcaggtggctcatggagggatgagtgtgcttgaacatcacaacactcaagggctcagaacggtagctatctgatcatcagaacaaatatatttcattattttagcaaacagcataataatgatgcattaagttactcagttggaaatcataaagccatcaaactttgcatctgctagccaaacgacggttctatgagtatataaagatcgtaccatcacttcgtctctgtaaccacgttccctccctccaagacacatactcccaattgggtcaattcttcaattgagactaaaaatacaaaaagaaaaagcttgatacatcctctgactattagtttcctggttagaccattggatcaaggtttattactccaactacaaaacagttccttccactggctagtgtgaagcaatctgaaagagacgtaccctagttgaatggtataacttaaggatttattagccttgtaactttgagtaggtcacttaccatttctctcatctgtaaaatatgagtaggatatagtaatctctggtttctccagttttggtattttgaatctagttgtatgaattgacatcagtttgtgcctattgattatttaagtctgataaattacctggacatagtaaaaccaggaaggtagcttttattctgtacttcagaggaaaaacaggaaaaggttcattgatttgacttttctaatttttttttttttttttttttgagaaagattctcactctgttgcccaggctggagtgcagtggtgcaatctcagctcactgcaacctccgcctcccaggttcgatagattctcctgccccagcctccggagtgctgagataacaggcatctgccaccatgcccagctattttatatatatatttggtaaagatggggttttgccatgttggccaggctagtctcaaacttctgaccccaggtgatttgcccacctcggcctcccaaagtgttgggattacaggcgtgtgctaccatgcccggccgacttttctaatgtttttgatttttacttctcatcaccaaattaatttatgtcagtaagtagttacttttgggacaaaggacacacattttggtggtttaaaataatgcattttggaatcatatcaaactttcgtatttttttcccatagaattatttggatttttatttacttatatttacttaatgtaagtaattggagtaatggctttggagtttcgcatgtttatttacagttgtcttcatatattttatccattaaaatttatcctgtcttattgattgtagtcaggctctgactttactaatattttttcacataactatccagttgacccaacaacatttatggaattatccatctttctctaatggtttaagataagacatatttttccatttatgttaagtgatttttagacttttaattcagttccatttatccatgtattcgtgttcaaataccttgtttggcaacttagtgtaatctcagcacattcagcaacttctttatgattcagttttcttatttttaaaaaggcagcattgacagtgtgtacctcagatgttgcaaacatgaaataaaataatgcccatctaaactctcagaaaatcttagatattactgagcctgaaacactattattgtattttcttcttcctgctgctgaattccttttatattttgcaatcagtttcaacctactctgtgtgtgtgtgtgtgtgttcgttctaggaggtatgtaaacagattcactaagttgaaaatcatatagttgggaaaaggctttctcaggtttttctaattcccagaattagtactgtccagcaggaacctttattctacatagtatcctttctactggactgctgtttccatctgccctaggtcatgcctacctcagttaattatgtgttgtttccccttgaaaatcagcaggaatgcctttcctgcttaaaacaaagactgattccctgccagtctctttcacaaaccttgccaacagtggatggaattgatcagttttgtttctccttctctaactctacagggaaaactttactcataatcatggatgggaatagtgcccctagctgagcagctgagattaaatccagcaactgttaacctggtatagggcaagaagagagtattggaaacaacaaaacacaaaaattcacaggcaatatagcatcttttgtacctatttccaaaacagaatctcagctttgttttaataaagcatcattggcaacagaatatgccccgagcaccaaagttcataaaaagtagcctttataacatgattatttattagaatgcttcttcattttttagcacagaaaatctagcatacaatttcataacagacaaaggagccaaagggacatagatttcttatgtactagctagtgaaatgaacttttgatttcagtgttcacatttaggaggcttagcagagagagtacatgggcttttccactttactggattttggaggtaaaaaagaaaaacatccaagcccagaaataatgtcttataagccacgacaaaaatgccccaggtcatgagagaaaactattgcttctgggtaaaataaaattggaagcaaagagaactagaggttacagcaccttgatagttggtggggttcgtatgattttgagtcttcaaatcagttttggatggtcaagaagtatttttttaccatcccgaggctgttaagctacagatttatttctgcatttctacttataccctatgaaagtagctctaacatcatgtgcccaagggcagagcttaaaggaatattttctgtggaagtggaataatcagtcaaaatttggaatcactcccagttcttcggaagtaaagttaattaatctggaagcacatcgtttgtgtataagaaattcaagagcagcataatgagttcagcaattagctttaacttttcggaaacatttctcagaaatatatgcattgaagtctctcccccaactgtatttttaactggtgtattacagctgatttttaaacatgccatcccattggttgatcttgtcatagagggaaaaatccattattagctctgcttgtacagtaaagttctgctttattatgtaatctcatttctgatttactatttgctctaagtgaacgtatgactacaatgtgtaatgaacattgtgtagcatcttgaaaagacaaagattaatgcctccttgacagtttttttccccacttattccttggggaacacctattctacttgtcctgtaactggaattacacattcaccccccagtaatttttataatgatttcaccaaagaacttgaataaaagtagttcaataaatgacactgtaatacatatactttggagtcctattgtgtttttctaagaaaatgtaaaatcatatttagggtcagattttattttatgtgttattgaatgcattgtaaatctagagggctgtttaaccaggttccgtcaggtaaattaattaccaccacaactgggtttaatttgtctttttatcttttctgtattaataaagtcagtgttttacagcttcgatattacctttttgaaagttcttatgtttctattaatgaacaattaaacggtatttgtattcttcaaaattgctaaaaagtcagtaagtagataattataattaataacacattcatagtctaccagtatcttacgatgtatacttgtctttttcttcaaagtgaggtgacctcaccaaaatattcttcacagtaggttgagaatagaatttgaaacttacaatatttttagctcttttaagattatgttgctctattttatcctatttttgtatctcattcatggatcattcttggtgtttattcaattttagtcaaatttattaaatatgatacacattttcttaaaagtgtttaagacttactccagaaaatagtttgtcataaagcgaaagagtttttcagacaatagaattcccaaacagcctacttaattctgtttgtgaatgacttgaggcatcacatgaaaactgcaataaaccacagtctccatcactcccttttctttcatactgagtttgtaatctctggcctccagaaaaatatttggttaaaaatctagtcaaaaagtttgtatgttgtttccctttgggttattccatttatcatttcctgaaaaccaaaattcccttagccctcctagtctgctcttcttttccaaacaaatagcaaattgagtttaagaaggagcctgaaatgaacaatgtcaagtctaattctgaagctcagctaaagctaaatagacatgctagaagagtagcatccatctgaaatataattattgagcaccttttccatgctagaccttattctagctgctggatattgaaagaaatgtaaatttcaaaattatggacaaggatatgggaattgctgtttaaacaacctttactgcaattatgatcttaccagtgggttttgaccagacaccagataatcatcttataagttgagacaggtgatacttcactaacttactgtggatagaacattgaatatagctttatatacatgaaacatacatataacacaagcacacatccttcagctattcaaaatagattttatttttccaaatttcaatagcaattctagtacaagtataatacaagtttaacttaaaattggcatcctatctaaaaggctgaattataaaaataaattttggtaacatcttcagtttatcttactaggcttaaaggcatatcaagagaagaaataaaaatcaatgtattttatttctaggattggtactattattgacacaaggatattgcatcaatatactctctagctatcatttttattttttgcatattactttttaagggtggcctgtgaaagcaacacgagattcccaaattatagacttaaaggtttactttaaaaagatgagatgattgttatttaactttcatccatctgtttctctttaaaaaactgcatttgcagcaaatcaagagtaacacgattttgaaaactgaaaaacaaaaaacaaaatatctgagcagccaatatactttaggataattttctaatgttctatgaaaataggtaaatcaatacaaggtgaaaatgttttgtttatttctagagatgttgattatgtatcaaacccagtttgtccatgaatgttaaatagacacttaccaagtgtctatttggttaaaatttggttaaaatttattttaaccgaagaattcaggagacatcaggttattatttttatgtagttacagtgcttagatgggcatttgttgaacactggaaacttcttattctccaagccacataaataacaggcatatgaacattcagataatatggatgatagttgccattgttgaaaaatcagcatttattaaattcttactatggaaattacatatttagtatctcatttggtctacccagctgcagtatgaagcaggtactgttagtggttccagctaataagtaagtgattatagaaatgagtagaggttattttggcgatttttctatagttaaaatttctacctcttgacataatccattcattttcccccaaagtttctgccttgctttcctcattttataatataatttagcttgatttttatattaattgttcaattccactcctaagatcaaatgttagggtgggacaacgagacacagtgacagggagtttgaatagagacaaaagcccttggaggggagagtatttaatttgcgaatctcatgttgctttcacaggccacaaagcagatggtcaggttcagaagtttagtgcctggcacagagctgggcacaggataaatcttctgtaagccatttcaaatgaagaagtgaataaccaaatagaagaagtcgtaagaccatcctgtctcaaaatagttggaaagcaggctgaaggaggcaacattagtttctgttcattacatgtttgttacaatacagcgtattgaccaacttttcatactacattaaatttcacaaccattttatgaaacggtacacttttcaggtgtgaaactagcagaaaaaccagatgttctgatttcatcaggaaaaccaaatagatggatttaatccatggtagaggtgaggttgggaggtctccaatgatgctgtcacgatttctctgttctctgtttacctccaggaatctggatgattgacacaggaaacaagtaatttgcacacaatagtaagtggcaggactctgaggtcctggaaacagagtgtctgtctaatgtttcactacttcaggctctcactgttcctaggtcagggaccaagaccacaggtcttgtgagcagatagggtagagataacccaacatgcaaaaatgatgatttttacaactgatgagcaagatgtcgcagacagatgaagcctgcctgcctaacttcggggtaggagtcccagccttcagggttttgtgtaaatgaggagaggcaggagtcatagttgatattcaaagcactaccagcaaagaattttggtctcaattcccactctacagatcattagccactcagtttttggcaaatagcttttcttgacttcagtttactggtttcttcaactgtaaagtaggaatgttgaacattaggctatatggcagaatgaattttaatagatgtcataagtatagatgaggctattttatctgcttgatgtctgtaatgccacatcccagaccactggaaagcacagttaacactgcaaatatacaagcagttttgacttcttttgattctattttgcatcatgaaggcaaagtataacctctcatttattcaaggcccatttatttttttttattcagtgattgggtaaatgcagatagtttctaaaatgcctttctaattattggaggaattatttgaaggtttggctgggtatttctgtgagacgagatggggaagatggagatagaggaattaatatttctcaggtttatgaaaaattctaaatgaagagtaaacctaccttaaagtaaacctaccaggagtaaacctaccatgaagattgtgtggacttccctctctccatgttttcctcttagataaaaaaatattttgaaagtaagtatcaaatcatttaataattaaccaggcatccttcatctaaaatagttgatttacttgctagactcacatgcaccctagacatgccacaggtaactattcttttctgtttttaactgactgtgagcttgagaaaatagaatcgccttgtaagcacttgcttgtacagaagttgtttattagttatccatcacagaaagcccgccagcagggtttggggctatatgtaattccagaaaagaaatctttggtgtcttcatatccaaaggtgtttccactgacccattaacattgggcatgccttcagagaggcctcccaaggactgactgtgtctgtgtttgtcagagaagagataattggcccccacaggaatgagagccatgacctgagcttcctaagtgaaactgtcagaaaagcttccagggtcagacctgcagtctaagcagcctctacactctgttgctgacagtggaatcaagagttatgttgcataaagtccttgaaaccaggtgaaccacaagttctgggtgtcttcggcttcttgtaacactatagggagctcttgtgtgaatagcctaaccatcctcatctgttctcagttctcctgtctcccaggttctagtgctttccagcctcccgatcagtccccactatttccagtttctatttactttttctccttatcccaagttttcatttctacttagagcatcttcaacaaagtatggcacttccaataatttgatctgaatgcggagtaagacttagggtaaaagagtagattgttttgacattacttattttctccctgtattttctatattcacagatgtaatagtaaacaaaacgtcttaggtttccgtatagctttataaggttttaaaatgctgttttaattaataacataatgccgtattttgtcgataaggacatgaccgtgatgtggtacaaagactacacacatactttggaaacaatagttgcaagttcacttctagctttaccaagtatttgataccagagagaaaggcaaaatgctcatgatccactctagcttcagttttcttatttgtaaaatagaaataatcacttgtaccttgcacagttaaagttaataagcctgagcaatgtgatattgttagaggggcatctacataatctgcccaaatggtcataaggatggtgacaggtgacttaaaacattagcgtataaattctttttttttttttttttttgagatggagttttgctcttgttgcccagactggagtacaatggtgcgatttcggctcactgcaacctctgcttcctgggttcatgcagttctcctgcctcagcttcctaagtagctgggattacaggcacgtgccaccatgctcggctgattttttatttttagtagagacggggttttgccatgttggccaggttggttttgaaaccctgacctcaggtgatccacctgcctcggcctcccaaagtgctgggattacaggcgtgagccaccgcgccccgccattagagtctaaattcttatggtggcttgtttaataatgaataaaggtgattatgattcaattcaaataacacaactccttgtttaaataatttaagtcaatgtctgttagaaatacagttgcatgccttgaataagtaagttaatttaaatacgtgtgtgtatgtatatgtgaatatagatagataatttcattattctatttatgaagatgtctttttaagatgtttatggaacttaagatgatagaattactcttcatagctaattaagagagcaaggccgggcgcggtggctcacgcctgtaatctcagcactttgggaggccgaggcgggcgtttcacgaggtcaggagatcaagaccatcctggctaacacggtgaaacaccgtctctactaaaaaatacaaaaaaatagccgggcgtggtggcgggcacctgtagttccagctactccggaagctgaggctggaggatggcgtgaacccgggaggcggagcttgcagtgagccgggattgcgccactgcactccagcctgggcgacagagcaagactccatctcaaaaaaaaaaaaaaaaaagaaaacaaaatggcaatatatattatgaattcactacaacttttaattagaattttgttagtcataatggaatctttatattcttgaaaaatgatctgaaacgtctgttttttgaaaagcatgttaatagctttgttacaatagtcagcatgcatattgatttaacgactcctttgcatgactctaaaacatgctccatgtacgcaccagagttccctccttggcccacaaattagaagtaactgttatacaacaaattaggtatgaattttcaatatgaaattccagtgctccttgacaattctttttctctaggctatgagtgtgggtctcagctttaagctgatgggttaaattctatatgtataagcagatccacattctcttcttttagcttttctgcttcataagtattttgctgtttaactgatccatcaccattacatgtggtttacttttccattttggaaaaaaaatggtaaaaaaataatatcatgtatattccttcttaaatagattcaatactctggtaaaaacaaacactaagtaaatgcctaatggcgtgaatctgagaggagagtgcttttagtaaattcaggctgcagacatgtttgggtaacattttgctatccttgctctaaagatacatgctaatggatgggcaagagtagcattaatgagctcactccattaaattagttctttttttcttgttaaatatccaaaagagaaagatggtccacttaactagggaaaaaaagtttcattttagtgcagtagaaaatatgatgcatattttctttctaatttaatttctaaccattaagattcaattgtacaaatgacccactgaagcacttggagagattagaaaactataaactgaatgtcatttgaatttggctgtctagacaccatgatgttatatagggtaattcgaatttaacatcatatttttatgaggccaccaagataagcccagtgacttctgtgaataatcactaatgaggccctcaaatggaatgtgagaattgatctcttctctggtggttgtttttattaaacaccatattggccaacccttccaatcactgtgatttgaacttttgtttgaatagtcaagttttctcttggaattgtagaaaaaggtcgctgtcagtctgtgggctgaggaaaaaggattacagctctaatgagccaaatctgtgcaaatgagaaaataataatctcctcataattagaactccctttttaaactaactgttggtcgtgagtttttcaaaagaagaaaaatcatttcattatttggttaaaagaatatttggaaattaatgccactggaaagggggaattaaaatgacttcagctcgtttacccaaatatgttcattgctggaacctcatcctgattttctagtcaaaacaattattgttgttttccatgaagtttagatagcgagaatcatgcattgtctgttcatgcagtagttgacatttactgcatacagcaatcactttcagtctttctgaagactgcgctgtaggaaggaaggctagcacgcccattttacagatggagaaatggagtattgctttctcaagcctcaaagaaattcttgaaatggtattagaaatcaggactgtcagctcccatgctcaatttgtagatcattgtaagcagcagcagcagcagtaacagcagtactggtagagtaaatcgagaggagaaagcatttcaacaattccagcagtactcagttaggaggagattttatttggaactcacaacacacagaagcatgtgtctacttggttgtgggtgggtgctcaggactgccctaggatattaagacatattactttagtagaggcatacaattctcccaggctttcctagctccttttttgagcttctcctggcattgaagggtcttctgggtcccccgtgtatctgcaacctgacctttctgaggcttgaaaccaagagagtttagaagccaacctgtaattaaatagccatgtggaaaaccatgctggaaaaggcaaccccatgggggagttcaaactgaaaggaaaaacagtgaaggtataagatgtgagccttcttgtatcccttctgtggaatgtcacatcacagtagaggaggattccagctgaagagtgggtcatttgtgtgcaggcccctggaatggggcagcaatgtttgcttgcttttctggagtttcagggaagccaaagttcaaaagccaaggactttccatgattaaagttccattctcaagaaagcaccactatgcattaatgtcaataagtcaccatgacaaaccagtaaaatagggcaaatataatcttacttttcatatattagtgatgttaaaaaaatggcccattggctcatgcctgccatcccagcactttgggaggccaagatgacaattacttgaacccaggagtttgagaacagcctgggcaacatagaccctgtctctgcaaaaaaaaaattaaaattataatttaaaataatggcccatagtggtaatgtggctgtccctaagatcacaaaactagttgttatgagagcttgacttgctaatcctgttatctgatgctttgttgaggactaatggtggattgatcctgtagaggccaggggaagactttctcttcaccttctgaagtttcactgagaaatcaactgacaaaaagaagattcattgaaaaaaaggcatacatatttatgaacatacacatgcggaggaccacagagggattgcttctattccccagtaggattcagaagctcgtatacaatcttgaggttacagcaagaatgggtgcttggatcatggcaaaataggctatagtggtaaaacacatgaggggaccagggaagaggaggcctggatagcaaaaggtcttgttttgcagatgagatcaaatagatggtgaatgtttctttaagacctttaaaggtatcagatattcagttaatcttttctaaatctggactagagaaagcctggctccatcaatgcaggttttctctacatatgctcttctgccccatgaagacaattttcaaggctacttctgtttgcaggccctctgaacagccatctcaaaacaggccaaagtatattttggggtaaattattttggtttatttcagttcctactttgaaacttcaaaaaattacatacataaaaaggcaaattggtagctttggagaaatttgggttagaggttcttagattagataggcaaaggaaggggaagacaaactaggataagcaaaaagataaataaataaataaataaatacattattccatatcatcttgaatcagttttgtagtccagagagtagatcagctacagctgttttccattctagcaggtgcattgccaatgggctagacgtctatataggatgcagcaaatccatctctaataagaggcatttctatggaaactaagaaaaacaaaggttaatatctggagtggtctgtagatttgtttttctagagtgtctaatgcatcttcagatggcagtggcaatgtttctggattgtagtttaaatcaggtgttcaagtgaactttataagtagttcatacatcagctggcacaaaagctgcttatatataagttgctccggtgatttctcccaacatttatatcaagttgtgtagcttcagtgtgcagagcttcaagaaaagcacagtttttggttttaagtgattctaaggcagaaaaatgggagaaaaatttgaaaacattagtttggacacttgtagccaggaagtaattcaggattcagttcaaattatagacaaataaaaaaacctccaaaacaatgggcagggctagaatctaaaaacatatgtactacagttttcttttgaaacataatttctcctccggttccccttttctaccaaagacaaatcatgtgtagtaagaccatttgtttgcaaaataaattttagtcttagaatactcagccttattatttgcatagagtatagcaagaatagtgattggccatataggttctttaaaagttggctttgctagccgggcgctgtgcttcatgcctgtaatcccagcactctgggaggctgaggcaggcagatcacgaggtcaggagaccgagaccatcctggctaacacggtggaaccccatctctactaaaaatacagaaagtgagccaggtgccaggtgtggtgacatgtgcctgtagtcccagctgctcaggaggccgaggcaggagatatacctagaacctgcgggcggaggttgcagtgagctgggatctcaccactgcactccagcctggatgacaaagcgagaatctgaatccatttcaaaaaaaaaaaaaaaaaaaattttggcttcactgtgactttttcataacaaatctcaggttagacttttaaaagcctctaaagtctataaagccaagctaagtatttggcatcagactgtgcccgtaacacttacatgaattgagtgaatttctgttttctagaggtttcaaaatatcttgaggttcctgggcctgtcagaaagtgacattcttacttgcaaggtcaggaaccttgtacggaaacaatgtagacaaggtaccaggccagcctttccaaggagctttttattggctctataaagtcaacttcaattcctcaaagcagtctggtcgtatctgaaaataagccattacagtcaaagccattaccagtcaaagccttggtaaaataactagtacccacaagtgtgtcctcttacagaagaaactgattcttgtggaacctatgtaaacaacgatattaccataaaataggaatgttcatgaatagtttccaaattttggagaaatcatgtagatagaagggtaaatatttcagttttgcccacaagagtatagagcacccaattgttgtaagctataaagaaataattcttgactctggaaaacaaaatataaaaaagaatcattaatattccaaacaaaaatcatttaaaaaaagcgtttaagtcctatgtcagttcaggaccacgtaattaacttattctgcttgctgttgggttagcaatatttatgattacgtcagcttttaaaatagagccctggaaggttttacatgggtctaatgacaagatctccaaagttatcagaagcctgtattcaagagtatttcagggtacattctgtaaaatttattgaagaagcaaattttggactgtagctgattgtaaatggaattttgagaaaaattaaagcaataattttctgtgaatgataaaagacttagaatagccacgggtaaagatacaactgacaaggaaactttgttgtatcatggcatacgacaatttaacataatcataattgtgactgataacatatcagaattttaggaatctcatacagtattagaacacattaataacatgtttatagaaatataacttgaataaagttaactccatattttgacaatgctttccatatgatttttacataccagataaacctcgtatgttcctcttgggcttccaggagttctttttggaatttccaaaagttaattcaaggtcaaaaagacaattttagattcgaaattaaatatggaagttcgtcaaatatcaaaggtttaaaacacttcatatcaaaataaggaaagttaaaaatacttgatgaaaataggatcaccggtcactgtaaaataatagttaatcatttagctaaagtgataattaaaaaaaaatattccggccgggtgttatggctcacacctgtaatcccaacactttgggaggctgaggcaggtggatcacctgagatcaagagttggagaccagcctgtatgctgaaaccccatctctactaaaaatacaaaaattagccgggcatggtggcacgtgcctgtagttccagctacttgggaggttgaggcaggagaatcacttaaacccaggagagggaggttgcagtgagttgagattgcgccactgcacttcagcctgggcaacagagcaagactgttgtctccaaaaaaatatataactaaaaaaattaaaaaaaattcaaaaatcaaaaacacttactcttttacagagaggagaatcaggtttccaaataatcaaaagatggaataaagaaaatatgagatcaacggaatctttcccttgagttcttccctctcttttatttctttagtttacttaaaagatagatagaaatattttactatgtcttgttaatgctacacaaatatcttgttccaaggagaaacctaaattctacctttccatcagtatattattaatgctaaggctaattttaataaaatttatttcaattagctttgaccagagaagatattcataaacattttataacctcttacaatttttcctattttctttctttccctttttatattcatccagtttcatctattctttatttcttaaatacaatttacaacaacttttaaaaacctttagccagaattactattcccttaatgaaaaccacattctcatgctttcttataacatttcttaccgaaaatacatctcacttttcttatacactttgcatacagaattgtttctcttgtatctagtagttttaatcatacatattaatcagtgttgactcccataaccctaattttcagtgaaaacctaggaaataagtaattttaactgtcagtcatgtactaacaatttataaatacatatcgtataagttttaaaagcataagctttctatagaacaatttttctatatggaacaggacatatttactagcagacctacataacttttgtttttaagaaaaaagccaaaagcatatgagcttaaactcatatttagtaattaatgtcttagcattatatcttatttggaaatgatctagatattcaatgattattcatcatttaatttagcttaaactctaagtgcatagttaccaaaaaattttgagaaacctttttaagtaaatatattataaaacataacttttattaaaagtgtatttatgaatgtttatctcatttacagctatttaatctatttttaacaactatgtttggtaaatttcataagacaaatctagccatcatctcaaattaaattttctattaatcatttttgtattactgtctgttaggcaagtatcataaaagcaaggaccttaaaggaccttaaagttagaaacatacatatttcattgataactcagcagacttactttattaagctaacaatattaaactagtattatttaccagaagactgctaaagtaatgcaaacttaaaaagcatttaggtttatttacttaaattatgagtggtcatttataagtcaatttgctaccaggtagacaatatacaaatagacatgtatatacaaaaatacagacataaagatcttatagctttaatttttaaatttttagccatgagtcaggtaaaactcactagtttaaaagggcagttggattaaaactgtatctctgtaagtggaacaacttaaaatttatttcttccacatgttcaaagcctttactaaatttcagagaaaacagggtagcaaatttacatttgaaagcatagagagattttaagctttttcaagaagtctgggtgtgttagaggaagattaaaaatggatgctaaggtaacataaaatcataagaatttatcacagtattttacaaggaaacacacagatgaacctagagaaagttcagaaaccttcacaaaataatgagctaaatgcaagaaagtcatattttggagaccaatctagtttgataggtggctttttaacatagtttccattttctttttttaatttaattttgtattatactttgagttctgggatatatgtgcaggtttgttacatgggtatacacacgttacataggtatacataggtgccatggtggtttgctgaacccatcaacctatcaacaacaactacattaggtatttctcctaatgctatccttccccagcccccaatccccccaacaggccccagtgtgtgttgttcccctccgtgtgtccatgtgttttcattgttcaacttatgagtgagaacatgtggtgtttggttttctcttcttgtgttagtttgctgagaatgatggtttccagcttcatccatgtccctgcaaaggatatgaactcatcctttttttattttatttttattgagacggagtctcactctgtggcccagcctggagtgcagtggcatgatcttggctcactgccagctctgcctcccaggttcacgccattctcctgcctcagcctcctgagtagctaggactacaggtgcctgccaccacgcctggctaattttttgtatttttagtatagatggggtttcattgtgtttgccaggatggtcttgatctcctgacctcgtgatcctcccgccttggcctcccaaagtgctgggattacaggtgtgagccaccacacccgcctgaactcaccctttcttatggctgtatagtattccatggtatatatgtgccacgttttctttatccagtctatcattgatgggcatttgggttggttccaagtctttgctattgtgaatagtgccacaataaacatacctgtgcatgtgtctttatagtagaatgatttataatcctttgggtatatacccagtaataggattgctggatcagatggtatttctggttctagatccttgaggaatcgccacactgtcttccacaatggttgaactaatttacactcccaccaatagtgtaaaagtgttcctacttttccacatcctctccagcatcagttgtttcctgactttttaatgatcgccattctaactggcatgagatggtatctcattgtggttttgattagtatttattagtatttctctaatgaccagtgatgatgagcttttttttttttatgtttgatagccgcctaaatgttttcttttgagaagggtctgttcatacccttcacccactttatgatggggttgtttttttcttgtaaatttgtttaagttccttgtagattctggatattagccctttgtcagacagatagattgcaaaatttttctcccattctgtaggttcagcatgcaaacagagacaacttggcttcctttcttcctattcgaataccctgttcactctgatgagagtttcttttgctgcgcagaaactatttagtttaattagagggaatttgtcaattttggcctttgttgccattgcttttggtggttatgaagtctttgcccattcctatgtcctgaatggtattgcctgggttttcttctagggtttttatggttttaggtcttacatttaaatatttaatccatctttgagttaatttttgtataaggtgtaaggaaggggtccagtttcagttttctgcatatggctagctgattttcccaatgctatttattaaataaggaatcctttccgcactgcttgttttcgttaggtttcttaaagatcagaaggttgtagatgtgtggtgttatttctgaggccagtgttctgttccattgatctatatatctgtttggtatcagtaccatgctgttttggttactgtagccttacaggataatttcaagtcaggtagcatgatgtctccagctttgttccttttgcttaggattgtcttggctaaaggggttcttttttggttccatatgaaatataaagtttttttctaactctttgaagaaagtcaatggttgcttgatggggacagcattgaatctataaattactttgggcagtatggccattttcacaatattgattcttcctatccatgagcatggaatgtttttccgtttgtgtcctctcttatttccttgagcagtggtttgtagtcctccttgaagaggtccttcacatcccttgtaagttgtattactaggtattttactctctttgtagcaattttgaatgagagttcactcatgatttggctctttgtctattatttgtgtataggaatgcttatgattttcgcacattgattttgtatccggagactttgctgaagttgcttatcagcttaaggagattttgggctgagactatggggttttctaaatacacaatcatgtcatctgcaaacagacaatttgcttcctttcttcctatttgaataccctttatttttttctcttgcctgattgccctggccagcacttccaatactatgttgaataagagtcgtgagagaaggcatccttgtcttgtgccagttttcaaagggaatgcttccagcttttgcccattcagtatgatattggctgtgagtctgtcataaatagctcttattattttgagatacattccatcaatacctagtttattgagagtttttagcatgaagggtgtggaattttatcaaaggccttttcagcatctattgagataatcatgtggtttttgtcattggttctgtttatgtgatgaattatttttattgatttgcatatgttgaaccagccttgcatcccagggatgaagctgacttgatcctggtggataagctttttgatgtgctgctggatttggtttgccagtattttattgaggattttcataccgatgttcatcagggatattggcttgaaattttccttttttgttgtgtctctgtcaggttttggtatcaggatgatgctggcctcataaaatgagttagggaagattccctctttttcaattgtttggaatagtttcagaagaaatggtaccagctcctctttttacctctggtagaatttggctgtgaatcctcctggtcttgggtttttttttttgggtggtaggctattaattactgcctcaatttcagaacttgttatttgtttattcagtgatttgactttttcctggtttagtcttgggagggcgtatatgtccaggaatttatccatttcttctagattttctagtttatttgcgtagaggtgtttataatattctctgatggtattttgtatttctgtgggatcagtggtgatatcttgactatcagcttttaattaagctgacttatgaccctatagcgttctaaaagaaattctttcaaatctactgcaatgtggagtagacttcactgtgaatcctgcaggagattctaagtaggctgtctgaatatacaaaggattttaactttgttttaggtcagatttttgctctttaacttggtcaagatagtttctaaggctaaccattacattattatgtgtctttcttttaatttgatcttcccataaatacaaataaggcaattgttttgaatgagattgctaatatgtgtatgtgtgtatatatatatatatatatatgtgtgtgtgtgtgtgtgtgtgtgtatatatgtgtgtatatatatatgtgtatatttgtatatatatgtgtgtgtgtattatatatagttttaatttaggcttctttttaatttaacagattcaccttttggtcactgatgattaggatttttactggtgtacttgttctaatagcagcctaatagccttttcatggaaagcccatgatgtaattttccaggtataaaataagttaaaacgggtttaatggagagggcatagagggaatcctaatgatttttcccccaaaaaattactcccagaagtaggctaagattgccaaagtcttctgttgccacagacagttaagtatggcatttgtatgcgtgtagcatctctgataacctacaaatttgtggagtgctgccactaatgaaaccgctgttgcaaaagtatgacagtaagagaaatttgacatggctgactccatcttgcttctagcacagggtggctgtctttgctcattcctaggcatggaccaagctaatttgggaagaaatttagtttatagttaaataatagtgttatgggatctttggggtgtcattttcatgactgtgaagctctgtggccggtggcacttttgcccaagttttgcttaggcctgctgggctcattctgcccattcagcctggcagacactgctcagctcacactactggcctgaaccccctgcctccaagggagactgtgagtcaggtagggagcaccaaggggtgtgggagtgagcatggggtccagccactgcacacagtcagacacaccagctgctgccatggggcaggaagctccaggtgccagcatgggcaccggtactctgcaaggctgcagctggaccaggtgcaccacaggcagtttccccagctggcactggggaatgtggtgtcacctggaatactggagatggcaggaactgcagtgccccaaagagggagatacagccctggctcttgaagctcccaggtctgggatccccaaagggtcacagctcttctctacttccctttgcctgcaatgtggcaaatgggtcatatttcaactgttagtgttatagctcttttagcctcgccatttgttggttcccaagttctcgtcccgcaaccaggaagaataagttgcgcagacaagtggagggtgagcaagatgaaaaggagttttattgacaatagaaaagctcagaggagacccacagtaggcagctcctctttgtagccagggtgtcctgataactctcagcagagagggtagctcctgtctatagctggtcgtcctgttgtctgctctgctctggttgagcccagggcttttatgatcctcagagtggaggaagtgtgcctgcattggtccatgggtggccataggtgggcctggaaaaggcaccacaagtttccactctggtcacaggactggcagcctggcctccagccttcaggcccttcctggcttgaaggtggggcctcaccgtggacccacccccttctgcccaggagcctgtctgcctcctgccactgtccatggcacccagactgctcatgccgaggggcaccagcaggccagcaccgagctgccctcagccctcccttggcttcctcccatgctcgtcagcacccaaagtctagagggggccaaagtctgctggcgtgtcagcactgccctgagtgtatgtactcctggctgggctgtgacagcccgggcttggccccaaccctgttccaatattgcagtgggtgccaggagctaggagaggccagacggagagaacagacagccccaagcctggggggtaaaggcggccttctcaggcccccaagggtgcagagtgcagagacacctgggtcctgcgacagggagggcagggctacagccccagccatgactcctctcagcctggggtgggggctccaggtcctcactgggcccctttctgtccgctcctccaagcccgaccacactgttcccctgccagtgggcgacttggcctagccccatcacagtagctctcagggcagcaggctctcgggggtggggctcccactggctccggggagtgctgcacgagctgcggcccagatctgcctcctccttgcacactccctgcaggtggtgggcaagagtggtgacgcaggaacagagtccggagtggtggaggctccaggcctggtagcaggtcccgtgggggtgggggctgtgcagtcagctgccttggggacatggggcacaggggacccatcagtgccatttctgctcctgcagctgctcctgccaccaccactcgcaccttcccacagcagctggagcgatggcagccgctgctctggattgcccaccactgccatctacagcccttcccaaaaactaaactgttgctgtgaaacgaatgaaaggccactaagttagaagggtgagaacggctttaattctaaataataccagccattattccggaggccgtaggattcacaacttccccaattactcttgcagataagatcactgttgtagaatctaagattggccttttgagatatcttttcacatttctgcagttttgacaaccagacggtcccaccttgacctgccaatcagtcccgtgccccaccccccacccagcaactgactcagcaaaataggacagcttaggttcactatgatttcatctctgacccaatcatcacgctccctaccctagacccctacccaccaaactatcttggaaaaaatcttaacctctgagccttcagggagattgatttgagtaaaaactttgtctcccatgttgcatagccagcttcatatcacttaggctcgctctttactgcaatgccacggtctcagtgagttgactttgtgcagcaggcaggaagaaacttttgggcagttacagtcacagatctgttaatctatgacataggataggcctcccgggattggacttttccagcactaaccagacaacaaaggttgacatgacaaaagccccatagggatgagacttcttcagatgaacacctgcaagaggtttacacattcaggacaaaaagtgtgctgcttaaaatcttatatatcttgggttctcaaccattttcagactggccagctgacacgacctcaaaatcatgcttcaggcccaatcccaacccctccacggtggaaaccaagagagtgtgctcccacttggtcaccagtcaacctctcagtgacataaaataagatgagaaagaacagtgtcttttttttttttggctgcccacagcaaagtttatagatgctggtatgatcagaactgcaaaactgaacagtctgtaggactggtttgaataacagacttatgggggttttaggctcacattctaccctaggctacccctctttttttcctttagagatggaatctcacttttgttttgcttcccaggctggagcacagtgacatgatcatagttcactgccaccttgaattcctaggctcaagccatcctcctaccttcatagctgggactacaggtgcacaccagtgtgcccagctaatttttaaattttttgtagaaacagggtcttgtcatcttgcccaggctggttttaaactcctgggctcaagcagtcatcctaccttgacctcccaaagtggtgaccctctttgtgacaaaacaacacagaaagacaaagacaagactatttctaggaggaaagggaccaaaaatttatgaatattcatagcagaaggtacacgagttgctacatggaagataatcactcaaattcttttctctcattaatcaagattttgcagagcaaaaagggacaattatttttttccctctgcttgactgaatctctgtctactggtatgtcaagtcctgggttaccttaactgtggctttcagaaaagcacagctttggtatcatgctcatagtgccaaaactgtagggccaagggaaaaacttttcctttgccctctgaagtttcactgaaaaatcaactcatataaggcagattaataaaaggcatacatattcatttacaggaacatgggagaggaccaaagagggattatccccgctccccaattgggttcaggagcttatatgcaatcttgaggttacagaaagaatgggggcttggaatggcaaaacaggttatgggaggggaagaaaaggacacttggctagcaaaggtgggtggtcttattatttagatgaaatctcacaggtagcagccctcagagagaatcgacaatggtgaatgttcctttcagacttttaaaggtgtcagaagctcagttaatcttttctaagtctggacaagggaaagcctcagcgaaagcccagctccatcagtgcaaatcttctctacgaatgccgatctaccccagagacagttttcagggctacttctgtttgctagccctctgaacagccgtctcaaaatatgccaaagtatattttggggtgaaatatttttgtttccttcaatctgatgccaaatcactttataaaaagaacaggagactcatctctgcctttgttattttgcatggtctgtgatagacattactgataaagttgaacgtgtccaggaaatgtgataaagtaagaaccctcaatgcaaagactttggtcatgctggcagctgttcctggggctaagaaaacaatattcatgcactgatctgctggttatatttcattataaataggggttagtggccctaaagagagggctttgatcacttgtaagagctcagtgatgatataacacttgaaaaaatcttcaccacattttattatttctttgccctcctctggtcacttcaagttagaaatacaaattataaaaaataagctattacattttcacagacgaactaatgaaaaaaggcttttagaaaatatttaaattatcccagataaactgtgttaatcctactgacagtctatttgtaatataagaataatgctgtcaatctcacaatttgaaatcggtcacaggctgattttttaaaaataccttacaaaatatcctacaaaatatctttaccttcccacaagtctcatccagagtcactccccgataaactgtaagacaagtctctcagtgtttatggatcaaatttccctccaagtctttcttcaacatttgctagatttgtcctgctttctacctcccagtaaacagtgtacagaggtcgggacagaagcatctctttcatccggcaaagagcttatggaacctcagccataggctcaggcattatcccagccttggaaatagagccaatatgtaggaaatacagacatatcagtcagtagatatatacacgagcttgcctatgacatgaaaatggactgttattggctattccatccctcttccattcaacttggattatagctttagcatataaaaccttttggtccttccaaaccatacggacttgagtgggtagataaaccacaagaggtttgatcatttgtcaatagttttatcaaaattaatatatatagtatttatagaacgctgtgattcaccaagggggtaaatagatcagtcaacagtgaatacagctgatttggcttggcttgttcttcctaaactacgttgctgtcttgtgggtatatgacaatcgaagtaacacagaaggtggcataagtagattagtacttgccagatggatgatattgatatgaatgatatgagtatagatgagggaaggaaaggaaagttttccatgagtagaatgtgaatatcggctaatgagtgattgtccctcagttcaaaatcctatgaaagcaagttgtgaagatgaagatttttctatccagagtgttttagaaaggaaggtgtaaggatttgatctaaaattactttccttttgttctcaactctcttacccaggcttcattctactttttctttgtcttcacgatcaaaaatcagtgagtacagaacttgtattttcatcctttgttagataaaaatccacattttgtttgagagatgaagttaaattccttatggctacccctgggattaaaacacttaccctaaacttaaactggctaaaatgttttcaatagatcaaggaggtaaatacactcctgtaaagcagtagtgtatgttaataatatttttaaaaattaaccaaatcttataagccaattacttttaatgacagacaaagaagaactgtctttatggcttaaaaacattataaagaccaatttaacttatttaaaatgattttcgaaatggccatattttctgcaaaataattaagctgtcatacggacttctttataatcaaaattgaccattgccaatgttagttaccataaaggtatttaaatacaaaaataaaattgttttgagttataatcaatttttagtttattattctttattctcaggctttatacttaggaaatgttgaatatcctttgaccaaaagttttcaggtttaatttttcatctagttctccatcttgtctacatcatatctcttttatgggtctctattgctatcacacatgttctttaatttttatcaacaatggtgtgtttttgttttggattttgaaaatatttggtattttgtttaatgaaatggccattgagatacagccacaagaggagacagaggaaaggctcaggaataaaacaaagtttattatatttagaggtcatagagacagaaggcagggcacactacacagggccacaggggaaagaaactagattggttaggaaagagaagacaggagtgaaggggagggttagtctagagcctttactggtgtttctttgggaaaggcaaggcagggaagggtgaacagtgtagaattggctaggtataattttggtggactttgggctgtggggcggttcctgattttttggcatctgactttgggatgactaaggcagaggaatattgccttctggggtgtttgggccagacagaggaagtatggctttagattggttgatttgtacatcaacgcaatgttccaggcgaggtcctttgctctctctggagttgactagctcaaggaacagtaatttctcaccacccagaaaggcttttcaggatgtcaaaacaatataataaacaaagttaaaacacacaacagcgaaacttttttttttttctgaaaaaaggctactggctgttatttcttgccagaatcaataaaaattcctcctaaaagataattaaaaattatcttctctaatgtattgctgcaacctggccatcaaacagcactaaatgtaacttgtcttaatttttaccaaagaaaagttggtagcattacaatctgtctgtcttccttcgagagatagagatgtgaaatgcaaacactgaacataatgttctgtgtgagctctaaaaacaccaagaaatagatgtaggaagttacgtagaatggtggtctcaagtatcatccccaactgttgatacaaactaaacttgcagtcagggatgctatagcataaaatattcatgctgttattggtgctgaaggcgactgctgatttatttgcaattagtagtaaagaattcataacaatgctatgatgctcagccctcataaaccctgggaggcttctgtattttgcaggcttgcagttctgttgtcactgctatacttttttaaaaaagaaatgagctaaaccttgtcagagctgacggcactatcttttggagcttttcttctcccaattgaagataaaggcaaggaagctggcctgccacacagaggctggttcctggaccttctgggatctctcattccggtcagtttgctttatcgggcacctgcccaaggatgaagaaatcataactcataatgacttgtttgaaatattttagaccacgtgggtgagaagaacacactttaaaataaaaggaatgtgtagtcatccttccttacgtttgccttccacatatgtcctgctgatctagtattttgatgttctttagtgaaacaacatttatccagggaaattctaaggatataggaatccatcaacactagatttgtaagccaacaaggaaacaatagagggcaactaaatcaatcatttgtcataaatacaaatgtcactaatccaaagttggtggccacttttctgtttttacatcagagcctagagaatctattgtttactgatctgacactcttggtagctttttccagattccactttggtgctgatctacattccttttctcagtgataaatgccatttagagttgtattattaataggatttaattttgacagccagttttaccaaatttggcctataaaggcatacattcttcatatgcataggcatacattctttacttgatggctacatcattcaactattgtattattaagaaagccttgtatttacattggatgtcacagtttataaagaaaacatagatgtattttctcaagccatagaactgtgctttatagtgacaatttccatattatgggcccataatgtttagggttaattctgcattgtaatggctaacagaaggaatggtctggatcagtgcttctcaaattgaaatgtacttatgaagcccataaatatctttgtaaatgcagattctgactgagtagtctaggatgaggtctgagagtcaaaaacatgaatgtggggagcctacatgcattgtgctcaggagctgccttagagatttttgccttccatatctcccctttaaaattgcctctgacgtttgcttttgggctgctccctaaaataaccacctgccagtttatcatctcttgtcgcagaccctccatttccctagaatagtgttgctagatttaccaaataaaaatagatgacaccagttaaatttgaatttcagataaacaatgaatatgtttttaatataattgtgtctaaaatattgcatggtacacatttatactaaaaatgtattcattgtttacctgaaattcaaatttaactggatgacctgtattttatactgtaatcgtaccctggaaacaaatgccttggtgtgtattggtctaggtcaatctcaacactgttgacttggggtccagatacttgtatgttgtggtagaccatcttgtgcattataggaagtctagcagcatctatggcttccacttaccaaacacctattacaagcccgtcccttgttgtcacaactgaaagtgtctccagacattggcagtgtccctggagaaaaaagaaagcagccccagtttcgaactattggtctagagggaggagggtgtgtgtgtgtgtttctaaatatgtaggttgagaaaacaaaatattagtaaagttttcggcaaggtgcagtgcctcacacttgtaatcctagcactttgggaggctgaggtgggtagatcacttcagcccaggagttcgggaccatcctgggcaacatggtaagactgtctctataaaaaatacaaaaattagccaggcatggtggtgtgcacctttaatcccaggtactttggaggttgaggtgggaggatcacctgagccaggggaggttgaggcttcagtgagccaagatagcaccactgtactatagcctgggtgacagagtgagacaatataaaaaaaaaaattagtaaagttttggtaacgtgtctttctttgtcaaatatgataggagagatgtaatgggagtttctaagttaggttctgtggaagtcatgagattaaaaaaaattacaagcaaatattttgtcatattttatctacgtatgaatctgcttccctgtcccgtattctcctaaaacatgcaccaagtagcacttaaagctatattaatgataatgtaaagagtatactgtttcctgagtattttgttccatttctatacccatgaaataaacatatttcctgtgtgtctctggggctaaatataaactctcttccccagcattcatgatctttcactggcttcctcctccctccccaaaactcccctccccactttggggtttcctccatatttcctaacgttcctctctcatctgcttcatcaggccatgtaaaccaaactgacacagttcacacttaactgtgaattccaagcaatttctgatcatgtgctttgctagtattgccctccattcacactgcctcatagccatcctcaaatacattctataaaacctaactttcaagaaaccctactttatttccccaacccataagaatcactctcttttctggcactgtccataacacaactcactttctcccttggataagaaacagttactaacaagttatctcccatactaaccttgaaagactttagagtaggttttgggactgcattagtgttacattgtccaaatcaccacctacatgcagtccccaaggtatcctcatatttagcttatgcacatgcgtttaattctgcttagaatgttttaaccccgtagccttttctgacctccccatttaaaattattatgactctgagacaacacacactaaaccacctttcctaatttatttttccccatgaagtcattattttctctcacatgttatttttacttatttgtttattatctgattctccctgagagtatataatttttactaggacgggtcacttgtgtctctttccctagtgactggagtagtttctggcacagagtaggtgttcaataaacaattgttgaaaaagtaattaatgtgctgggatatctgaaggtatttcaaaaggtgttggtctcaaatatatttgatacttgagaatatcagtagaataattttgaagggacaaaacttccatgggtgtagaacttctaaaacacacccgggcacaaagttatcactttataatcctatcttgaggttatttcacacagaaggcttagagagaaaaagctgaaaagttgtattgattgcaattttgggggaagtgtactaaaaagactcccatgcttaaactgctctaataccaggtgcaggaaataccacaattgctgatagaacaaatactatattacttgttactggctgagtagatttagaaatcaaattggacctaaaggaaagtgaaagaaagctctttcataaacctttgcttctttttcctttcctcttttttattgtcttcataaaagtttcatttgagggaataaagtgccccctggggctgtgtctacatgaaaccttaaggtattaagcattcatttttgtgcagttgatcacacaagtcaatcatgccaaattgggaagttattctcccaatatgttaaccaactatacatgaaatttctagcccatatgttgtttggctttttttttttttttttttttttttttttgagatggagtttcactctgccgcccaggctggagtgcagtggcacgatctcggctcactgcaacctccacctcctgggttcaagcgattcttctgcctcagcctcctcagagctggtagagctggtattacaagcatgtgccattatgcccaggtaattgttttacttttagtagagacgggatttcaccatattggccaggatggtctccaactcctgacctcatggtctgctcacctcagcctctcaaagtgctgggactacaggcttgagccaccatgcccagccatgttgtttggtctttgtcaggactactgtcgcagctcaagagcagccatagacaataggtaaacaaatgggcataactgtgtcccaattactctttgttttatgatattgaaattaaatttcatatatgcttcacatgtcaggaaatatttttcattttaaatttttgtgggtacatagtaggtgtatatatttatggggtgcatgaggtgttttgatacaggcatgtggtatgtaataattatgtcatggaaaatgggatattcatcccatcaaagatttttcctttgtgttacaaacaatccagttacatatttttagttatttttaaatgtactatcagattattattgattatagtcactccgttgtgctatcaaatactaggtcttattcattcttttttttttctttctttttgagacagggtttcactctgtcacccaggctggagtgcagtggtgcatttcagcttcagctcactgcaacttctgcctcctgtgttcaagcaattcttgtgtctcagcctctggagtaactggaattatagccattcactaccacacccagctatttgtgtgtgtatgtgtgtatttttagtagagatgtggtttcaccatgttggccaggttggtctggaactcctggcctcaaatgagtttgcctgcctcagcctcccaaagtgttaggattacaggcgttagccaccttgcccggccttattcattctttctaattatgttttgtatcccgtaaccatccccacttccccctgaaacccctactacctttcccagcctctggtaaccatccttctaatctatttcctgaggtcaattgttttgatattttagctcctacaaataatttagaatatgtgaagtttgtatttctgtgtctgagttatttcacttaacataatgacctccacctccatcagtgttgttgaaaatgattaactctcattcttttttatggctgaatagtactccattatgcatatgtaccacattctctttattcattcatctgttcttggacactcaagttgcttccaaatcttggctgttgtgaacagtgctacaacaaacatgagagtgcagacatctctttgttatattgatttcctttttttaggtatatatgcagtagtgggattactggattatatgatagttctatttttagttttttgaggaacccacaaactgttctccataggggttgtctaatttactttcccaccaacactgtagaagggctcccttttctccacatcctctccagcatttttattacctgtctttgggataaaagccattttaactgaggagagatgatatctcattgtagctttgatttgcatttttctgatgatcgatgatgttgagcactttttcatatgcctctttgccattttattatcttctgagaaatgtttattcaaatcttttgaccatttaaaaacattggattagactttttcctataagatgtttaagctccttatatattctggttactagtcccttgtcagatgggtagtttgcaaatattttcttccaatctgtgggtttccttttcatgttgactgttctttgccaagcagaagctgtataacttgatgtgacccagtttatctaattttgctttggttgcctatgcttatgggatgttactcaagaaatttttgcacagaccaaggttctagagagttccccaaaagttttactgtagtagtttcatagattgaagtcttacatttaagtctttaatccattttgatttttgtatatggcaagagataagtgtcacatttcattcttctgcctatgaatatccagtttcccaccaccgttcattgttgaaaatgatttactgtaagtatatggatttattgctgggttctgtattctgttccattggtctatgtgtctggatttatgccagtaccatgctgtgttggttactatagctctgtagtataatttgaagtcaggtaatgtgattattttagtttttttctttttgctcaggacagatttggctatttggggtcttctgtggttccatataaattttaggaatttttaatatttctgtgaagaatgccatttgtgctttgatagggattacattgaatctttagattgctttgagtagtgtggaaattttaaaaatactgattcttccaatccatgaacatgaaatatctttctatttttgtatgtcttctttaatttctttcattagtttttaatagttttcattttgagatctttcacttctttggttaacttcaaagtatttaatattatgtgtggctatggtaaatgggattactttttatttctttttcagattgttcagtgtaggtatatagaaatgttaatgatttgtatgttgattttatatcctgcaactttactgaatgtgtttatcagttctaatagttgttttagggatcctttaggtttttacaaatataagattatttcatctagaaacaattttgggttcgacttgccctttcttttttagttctttatagggatcctttaggtttttacaaatataagatcatttcatctggaaacaattttggtttggacttgccttttcttttttagttctttaagatgcattattaggttatttgaagtttttgtttctttttgatgtagacacttataactatgaatttccctcttggtggtgcttttactgtatctcacacgttttggaatgttgtgtttccattactgtttgtttcaacaaatttttcaattttcttcttgattcaggagcatactgtttaatttccatgtgtttgtatagtttccaaaatgcctctggttattgatttctagtttgattacactggggtcagaaaagatgcatgatattagtttcattttttgaaatgttttaaaacttgtgacctaacctatggtctatccttgagaatggttcatgtcctgaggagaagaatttgtattctgcaatcattggatgaaatgtactgtaaatagctattaggcttacttggtctctaacacagactaaatctgatgtttctttgttgattttctgtgtggaggatccgtccaatgctgaaagtggggtgttgtccagctgttatcatattggtgtctatctcttcctttagcgctaacagtatttgctttatatgtctgggtgctcccacattagatgtgtgtatattttcagttgatgtatcctctgctgaattgactccttatcattatataatagacttgtttctctcctgttacagttttggtctttaagtgtattttgtctaatacaagtatagctacttctgctctttttttgtcttcattggcatggggtatttttttctatctttttgttttcagtccatgtgcatctttacaggtgagatgtggttcttgtgggcaacagatcattgggtctcatgttttaatctattaagacattctatggctttggattggagattttagaccacttacattcaatgttatgattgataagtaaggacttattcctgtcactttgttatttgttttctgttttatttttattttattttttatttatttatttatttatttatgtgtgtgtgtgtgtgtgtgtgtgtgtgtgtgtgtgtgtgtgagatctctttctgtcttccttttagtgaaggtgattttctctagtgatatattttctttctttttattttttgtgtttccactgtatatttttcaatttgaggttaccatgaggcttgcaaagactatcttataactcactcttttaaattgatggcaacctaatactgattgcataaacaaacaagcaaaatgctaataaaactctacactttgtctccttgctttttaattttttgttgtttctctgtgacttattgtacttattgtactcttgaaaagttgtggtagttactgcttttgagttgttcattgttaagtctttctacttaagagtagtagtttatagattacaattacagcgttataatatcctgtgtttttctgtgtgctattatcagtgagatttgtaccttcagatcatttcatattgcttattaacatctttttctttcaagttgaagaaattcctttagcatttcttgtaggacatatctggtgttgatgaaatcccctaagttttgtgtatctaggatgggctttatttctccttcttgcttgaaatatattttcactggatatatcattctagggtaaaagttattttccttcagcactttaagtatatcatgccactctctcctggcctgtaaggttcccaccgaaaactctgctgccagacatattggagcttcattgtatgttatttgtttcttttctcttactgcttttatgatcctttctttatccttgatctttgggagtttgcttccttgaggtagtcttcttcaggttaaatctccttggtgctcaataaaccttcttgtgcttgaatattgatatatttatctaggttttggaacttctctgatagtatccctttaaataaactttctgttcctatctttttctctacttcctcttgaagaccattgaaatatttgccttttaagtctattttctagatcttgtaagtgtgcttcattgttttttattccttttttttttatttcctccatgtattttcaaatagcctgccttcaagttcactaattctttcttctgctcaatcagttttgctattaagggactctgatgcattcttcaatatatcaattgcatttttcatttccagaatttctgcttgattctgtcttgttattttaatctctttgtgaaatttctgatagaattctgaatttctttgcggtgttatctttaattttgttgagtttcttcaaaacaactattttgaattctctgtctgaaaggtcacatatctctgtttctgcagaattgatccctggtgccttatttagttcatttggtaaagtcatgttttcctcgatggtcctgatgattacagatgttcatcaatatctgggcattgaagagttaggcatttattttagtcttcacagtctgggcttgtttgtgcctgttctccttgggaaggctttccaggtatttgaaggaacttgggtacaaagcctaataatgcagtggttcttgcagactcatagaggtaccactatggtggccttagatttaatctgaaaaacttctctgggttaccatgcagaaactctcattcattttccttactttgtctcaaacgaaatttctctttctgtgcagagtcacctggaactggggttgggggcacacaagcactcctgtggctaccaccactaggaatgtgctggttcagatctgaagcaaacacaacactgggtcttgtctatggcctgctgtaaccactacctggctaccacctatgttcactcaaggatgtaggattctatgatcagcaagtgggcaagccagtcatgtttgttctcctcccttcagagtggcaacttccctcaggccctgggtaggtccagggatgctgtctaggaaccaggggttgaagtcaaaaaccttagaaatttacttgatgttctcttctactatggttaagctggcactcaaaccacaaaagagtcattcccactcttccctcccctgtccatagacagaggagcctctccctgtggccaccactaccaccagcccacacgggattcttccaggccaccactgatattcacttaaagcccaaaggctcttctgtcagcttttggtaaatgctgtcaggcctgagacccacacttcagggcagtgggttcccgtctggacaatggcaggtccagacatgctatccaagattatatgcctggactcagtgactccaagtgtccacttggtgctttaccccactgtggccaaagctggtacctaaagtgcaagacaaagtcccctttacttttccctctgctttcctcaaacagaaggagtctttcatcatagccaccacagctgggaatgtgctggatcacatctgaagccacaacatctcagggctctaggtccttggcatactaacttgacatcactgttggttattaagggcttaagggctctttagtcagcaggtgatgagccctgctatgactggattcttcctgtctaggcagcagttccctcttggaccatggtgtgtctaaaatgtcatttttgagataggccccagaatgtggccttacaactctgcccagtgcccttttctactgtggttgagctgatatccaagatgcaagacaaagtcctctttcctcttctctctcctcacctcaagcagaaggaaggagtcatttttgttgctgcaagctgcactgcctggggttgggagaagagggccgcaagcactcctttagcctccccatctggtatctccctaggtcacatgccatccgaatctactggctctaagcccagcccaggactaggaattgcctaggaattgaagtctttgtgtcctacagtgccttttgagtttacttagaaccccagagcgctttggaccatggtggcaaggcctgccaagaaacttgagctctgactgctagaataggtgattcccctctggctaggctcgtccaaattctctgtccatgaatgggcaccagctgagtccagcagggcttagctgtgcactgtgacagggcagcactgagttcaatgtaaagtcccccagtcgctgtgctgtctgtcccacaattgcacagactctctctgtgtgcatcttgcattacctggcaggctaagagctccccttctaatgtcacttgcctaagacaaggtcccatagctgtagcgtattcgttgtcttttttcctgtctattggaggaggggggtcagacaaaacctctgtttcctctgctgggaaaagggggagggatggtgttgatgattcaagactatctcctaccctcttcagagtctctttagcgatatgaagttaaaaccatgcactgtgagtgcccacctgatttttggttcttctgatggtgctttttggtgcatagttggttgttaaaatttggtgtgtgtcagcggggatggcaaatgtagccttctattcagccatcttactctgctctcctcttcctttaaaaattattttgcttagctgtttttgcttgtaggtcccacaaaaacaggcattggactagattttgccctttagctatagtttgctgccttctgccactgactgcttcaagatgatagcagtgccctcctaggctcttctagggtaatctgagcaggagcagactggagtggagtagccatggtaaatgcatatgagaacacgggcatgttgaatgaaaggcaagatttcaagtcagacagaagcttgaaacagtattgcaaactcagtgctgaatttgatcactaattaagaccttgtagattctttgtgcttttatctaaatcctgttatcactctgcaacttttaggactaattaatgcaggctcatctatccttgtactacctcttctagcatttagaaacaatcatcaatggttttttttttttaaactatcatcaacatgtatttgcagaaatggagagccaaacatattattttctatcctttgtgctgcctaatgctttatattaggtttattccatctgtgtcatcttagctgcaaaaggtagttccagcaaaaggtgaaggtgttcagagattgatactatgcaattaagacttaaggatactaatcttaaacttttatttttagatcttgtccacgatgatagaatcgagggtcacttcccctcttattcattaacgaatgttttaaaaagttgcttacaaattatataatctttaatgcttttataatacaatccctgtggataccagagaatatcatttccaagtcacaattttaggcaattgtttatctcaacttctagatattttttccctcaaaatgtcaaaatttggaatatccagtttcatagtatagcttatccaacttttaatagtaattattaatgtcatgattttttaaatccaatttttctcagaattagtttgcagcctctgtatcagcccaaaccatctgctcttagatctgttggtttttccaagtaggagacctttcttatggttttcactgaagtaatacagcactttcattttggcagggggaaactgggtttagcctttgaaagaaagtctcttaagacactgaaaatgcactttcaattagtaaaattagcctttatcacttaataaatgaagtgagtctctttatccattttatatcacaaagaattaaaatctcctgtcctttgttttaattggtgattgaaaatactttttcatctaaatgtattagcactgagcatgccctcccctgttgtgcttcctgtttgaaaagctaattaaatggtctcattgctgattggctggaagcctatacaacttcctggctgcaggccattaacaccctggccagaagtgctgacaaaaagatgaagagatttacaccctctgatttctgtattaacaacaaggacaaaacagtatgtggtcttctcagtggataatacaatttaaagataggatttctttttccacaggtgcatttgtctctgaaaattagcagttcagcttggtgtgaataataaggcatcttctctgatgagtttgaatcatattaaaaaatctgttatggacaagttcaaggtttataagactattaccatttctctaaatgaaagaacccaagtcagcttatttctagatctatgttctgattacttaaaaaaagtactggaaataacaagtatgaaaagtgttctattctataaaggcaaaatacatacatatatataaatattgcaaaaaacatttttcttaattatgtcagttatttaacataaaattactttttaacaacaaaaaacaatgccctgtgataagattgcttttcccaatgaattcaccactggttttaatagtttaccatatattttagcaagaaaacatgtgaagcaaatgtgtatgtgtatatacagaagcccacataaaaatagagggatatatgtatatatttgactagacttttgcatatataagtatacatatacacacacccctctttacacagatatctatatatacacacacatatatatacatacaagcacatgtatgaatattaatcatgcacataaatacacatataaacatgtcacaatataatacataatataaccaatttaattggcttttcaaacaggaagctcaacaggggagggaatgctcagcactaatgcatttagatggaaatgtgttttcaatcatcaattaaagattagatgtggagaacctctaatatataagatatggaactaggaattggagatggggtaaaaatctttactttttcatattcattatgtattctttcataaaaggaaatgattgaatatatttgatcagtaaggccctttctagctttaaagtgataaatctaagatttgtatatattcagatccctttcattaaaccactagggagttctgaaaatgatagtagatgagtatggaaggacagaaagaagtaacgaatgaaatatcaggctttcaataattaatcagccaatagccattgaccacatactactctaaatgtgctgtgctgggctgagactacaaaacaactgaagtctcattcttacttgtgagaagcttatagaatgattttggacagatatgtagctattgacatgaaagccatcaaggtaaagcagggattgagaagtggggtagaaaatttataattgggttctacgtttcagaaacagaagtcactttacaaaatatagagtgtactgtaaatcttgtttgtacagttaattgcttacaaaacatttattagttgtttcaaagagaatccaaccctttagggttgaaattattataagttttaaattctgaattaccataatgaatttttcataaattgaggtcatcaccaaaatattctgcaatgaaaaggaccagtcatcagaactttaagatgaagtcattcaattgaagcagaatattttagagttatcttaatagatggtcctttgcctaaatgcacaaaacaaaaataattcttactgtgatcagacttaaaacaaggagagtgttaattggtgtttttactatgcaagacagtgtgaatatccaaagaaatatagagtactatatctgaccttcagcaagctaaaatttaattggatgaaaatatggtatctgtaccaataaatagctgctgatttccaaatgagtgtcaatgaaactaagatctatgcaatatcaacaaagaaaatagaaaaatagatttgatttggttttaggagtttgagttaaattccgatattttagctgtgcattcaacaaatatttactgagtgtctgctgtgtaccaggcaaagaggatgcaatgttgagcaattccaaccaaggcttaacccttatgagttgggaaagagcaaactaattgaacacagggttggagccagagggaggcatagctggtgaggtatacaggaaaatataaagtcatgcttaggagctcaatgagaagactagtggggatagaacatatggttactgataaagaaatataggaaacaagaattcctagtaaatgatttcataaaaccgcctaaaacagctcactatggtacatatcaggtaagaaatttggaaaatattgatgtgttatgatattcccagatttaagcttaaagttaggttaacactttgtaaatttactagtgagagattaccttgaagacatacctcacatatcactcataggtggccccagattgatgaactctgttggtatcttaatagatagttctatatctaagactcagttccatagcaattttccaaaaggacaaactacaattacaataaaatatcgatatgtgtctcaaatactgttctgatgtagaagtatctatgcgtcactttaaatatcatctcaaatccccaaattctgaggctaagagaagagtaaaatatatgaaaagagtttgcctcaaaggacacaaactttgattcaaagcaaagtcatagaacctggcaaaatttaacataaattcagctgttttaaatgtatgttcttgatcttctcttccttgaaaagcggaatgactttaaaatagcaatatttagacaacctttgggaaccagagttctatctacaaaaccaattaaatcagtgtaaatggtgtaaaattaataagaaggctcaataaatgacaagatagcttagttataagcaaaggaaataataatttcatgttcaaattaatgctcaaattaacttgagtcggtcagatttctgtaatattggggttttcattgacttctctcttaccataagtccctaggcttgtttttaagctcctctattaagaaccctgatgataaatgttgcctggtgaactctgcattttctactagacaggcagctcccttagggcaatgatggggaatgtttataatttgcttcagtagcttcagtgtctggtgtgtctattacattagttttgttaaattatgtcctgaatgattgacataaattatgtcatgaatgaatgacatggatgaatgtaaagtctgaccacatattaggttgtttaaacatagaatcacaaagtaatgtatttttataaatgatagaaaccttgggggtcaacctctctaacctttttcatttttgagattcagagattgacattgaataattagcctcttactcctgtttaatttttaaccatatctcttgctcacatgtattatattttttgctatcttccataccactgcatttttatacctacataacctaagcaaaatcacagcctaaatattttacttggaaactgaggtttgttcttgacccatcccttttcctcataaacatattcaacattcaataggttctgttcattatacatcaaaatatagctagactttctcctttcttccatcccactattaccttacttgtctatttccttttgccttgactgctgttaagtttctctctgagattcctgcttccactcttgtattcaccaccaccacctcaaactattctctatacagcagccagaatgatcttccagatatgtaaatctgatcacgtcatttccttgcttaaaatcccttaataacatctcagtgtggttgaaataaaatgcagacttactaaagtggtggatgacatctgaattatccaccctgcttacagccccaggttaatcttttgccatgttcctcttggcccactgagcttcaaagcccatgtcctattgaaccacgcatcttttaaataaatacttcttgatgctttaatacttctttttaagttcatggatattaccatcaggaaaggtcataaacaagcttggaagcaatgttgttgctgattctataaaaactgcataagtaccctgacacttgaggtttaaagctgttctgaagggataatttacttcctaccacacatacctgcagccagatagtggccccaaagaagcagggtagaaatatatctgacttcccaggtgtgtcctttccccatctttcttctcagactaggtgtcatgtgatataactggacccaggagaatgaccccacaactgaaagatttttatgaaggatgatttactattctccaacgtactgacatttttctacagcccaatcattgctggggagtaagtacagaacaaaatgtgttgagataaaagatcatttcaggcttttgtggtgagctttgattctggtgagtttgagacacatttcagactataaactttagcgtcaaacattgtcattttcccttcgagtggctattatatcatgttattctgggtcaggttatcaaaaatttggtaattcttaaacaagttttgattttttcagagtctcagtagagaaggttgaaaatcacacaagttacatagttaagcagaaatattttggttttccattttcattgtgcaaatgcatgcacagtatgaaaatgcattttattagctccaattttcccccagtaggtacttccaaattgaaattaaaattatatagatttaccagaagtctttaatctaaattattatttctgttgggatttctggcttcttattttacaaaatggattttatggggaggaaaaatatattaaaattataagaggaaaaaattgactccttttggtatatttgatgtgaatcttagctattaccaaattaactttaatgaattatataatacggaataaaggctttgggcagactactctctctactgcatctttgtattgaaaacttgtttcatttaggcttctccttttttttgtctctctctaaagattttgaatatagcactcaggcacatgtctttggcaggaaaaaaaatcacttatattgagaagagggtagtcctatgaaacaaatgtagagtaaaaagtattgccagagaatctcagcagggccatttacagccatatgaaggcaaaagcttatattaataaacctaatacagtgcctggtatgtattcaatgactgccactgggaagaagaaaaataggaacttgggttaatagacggtcagatagaagatcatttaatcctttgggtaacatgctcaattaaaagtttgaaacaattataacccaataaattcttgtttcaatgacctttgaaatgaatagggaaatgtcttgccaagtttctttgtttatgaaaatccttgttagggttttgtaatgtttccttcagaaaatatgctggatgtgaattctgtattcctaccttggaattctgaaatccagaagattgaatcattttctgaacagtaacaggacttaactataacatagcacaagttgttacataacatgatataacatgttaatataccggaaacatatgttactatctgttaattaatttgggtattagtcaatatttattgagtgctactgtgtacctagggaataataccaaaacacaggagtcatagattcccccctcatgaagatcacagtacttctgtagtcaaaacacacaaggcttataatacaatttaaaaaaaacagtatcaggctctcttatgaaggagaaaaaacataagttttcgaactcactgcttcccattatttactgacttacttgccatctctaaaaacatgtgcagtctttagattcactgttttttctttacacatgttgcttctctgtctagaatgtccttttgtatcttgggcatctggtgaactcccattctttattccagacccagccatagtccaccatttctgaagctcttttctgattattgatttcccaataggcatcactgaggattacgctatctttgctccaccagcatctttcatttttgtcacagtgcgctatgctatatatttgcctttcctactagactatgaactctttgaggaaagaaactggtactgttcatcactgtattcctcaggcaattaggatgatccctggcacatattagatgtccaataaatgctgactgactctggattccccagaaacaggacacatacacacacacacacacacacacatgcatacacacaatataagtatgtatttatattatttttatatattaatatatgtttatgtgatatataaatattttatataatatataggatctatccatctatttagaaagataaatagagacagagaaagagattgatcacaaggaattggctcacatggttctggaggcttagaagtcctagtatctataattggcaagctggagacccaggagacatgatggtatagttccagttagaatctgaaggcctcagaaccaggagacttgatggtgaaagttccagttcaagtctcagttcaaaggcaagagaagactaatgtcccagctcaagcagtcaggcagaagatgaattttcttttattctgcttcttgttctatttgggcctttaacggattggataaagcccacccacactggggaagacattgttttattcagtctattgatttaaattttaattttatctagaaacacccttatagacacatccaaaataatgtttggccaaaaggctgggtgccccacggcccagtcaaggtgacacgtagaattagtcaccacactgactgactgactgaatgagtgggtgatctgggaattctcattaagtaatgcagtcagtgcaggtaggggtgcatggaagaagaaccttgataaaatagggaaagggtggtgacagtgatgtgatgaaaaacagaagatcataccaacttaaagagtttgcttttctgcttttgaaggatttgcctatcctgaattgtgcatacttccaagtaggcccaacaaatatcagccgtattcacaatcaacttttatgagcattgcaaccattcattagccatgtgtaatgagatttttagcttaatagaaagcctcagcctgaattctgtaaaactattcattactattgattataaaccaatctcaggtttttgtattaagaattttacatgcagaagaattaaaattattgtcaaagcttgtagaggtaaacatgtcttcatgaaatcaatatgctcgtgaagagttgcttgcaaatttcactgaatataatgcactgaatagagtattagaaacattaggaaagtttccttttgtatttttaaagatatgcttgttttagaaaaaaatgagcaatataattttcgctcatttaaaaaaagtttattaacataattttctatggatgtataatgttatgtacagtggatatactataatttgcttaaccaattaccaattgtgcaattagcccattttatattttttactattttaaataacaatattgaatacatatgtaacttttctttttgtatacttatgtatggattcctagaagaaaaattgagttaaattggtttttttgtttgttttgggacagactgttgctgtgttgcccaggctggagtgcagtggcgcaatcttggcttatggcaatctcggcctcctgggctcaagtgattctcatgcctcagcctcccgagtagctggaattaaaggcgcacacaaccacacttggctcatttttgtacttttagttgagtcgaggtttcaccttgttggccaggctggtctcaaactcttgacctcaggtgattcgcctgcttaggcctcccaaagtgctaggattacaggtgtgagccactgcacccagccgtggttaaattgctatgatgcaaatttcaaatcactttactgaggtggtgtatcaattcacactttcacagtattgttaattatcattttaagaggttttttgcaacactgataggctaaggtcctatctcatttttgttatattttcagttttaattactagtgaatatttgtccacattagaaatttaaagaatttctatagaaaatcttacattaaagtaaaacaagcaaataataaactcctagctgatctacacattaagtatgagtctgcatttggcttaatgcatactcacagttaagcgacctctttcagtcaccaaagatgacagcagagctaagatgaaagatagttgccactattcattatttgctatctagtaccttctgtaagaaggacttcattctaactttcacatacataaatggcattgatgttcagtataatttgattagattttaagaagaatctagaaagacaacaccatgtgagtttgaggaagaggtggtaaaactattatttaaccttgtgctcagaatagatattataatatagcttgactggaggaaataaagttattaaaatgctacctagaacaatgcttcccaaaactgcctctgttggccctataattaatcaaagatattgatgggacaagccagctcacgcttgtctgattgttgatactgaaatcaagaggagcaggactgttaggacacgttgtagttcatgtctgatcaccacctccaggggaaagctgggtaggggctgaaatccagttctggatttactgggttgattctgtgcagtgcctttataaaattcattccctcagagacagtatcctttcctaattatacaatggggcaaagtatgaaccaccaggggtcctgaggatattactaagaaggatgattccggagaatcctgaattactccatggctttgaaggccagctaagaaataacctagcaatgctcttaggtgagattatgatagaccaggctttaaactgactcttggtcatggggattataggagtccccaaatggccgtctgtttctgggtctcatgtatagtcaggctttcattgcttcaaggatctggaacagtaccaacactacagaggatgttatattggacaaaccccaaagatgattctgagaaagacttagttgatggccttactccttgcctatttttggcctagggcaagaggtcattgtgtgctgctaagcttgcagagctggacaaactccaggtaatctcattattccaaactgctacagactatgttggaaagtgacagagccaaagctcaaatccaactttcaaaatttggatgtctgcaatactctattcaaacatttagagtcacatagaacctcaaccaatatttgtgtatttttttctttctgtaaatatttgatatacttcacagaaataaaatacagaaaacatccacaggaatgtagaaatacttttcaagcttttatttatccacttaactttttaatagtatctgcctatagtatctgggtaatctgcctatactgtttttctttccctttgacatcctttagaggttcattcatttggtcatgtgattgcttcttataagatcacatagggtgaacatcgctggcacttaccagacatgcttaccaggacttcctttgcaatgtccaccatagagcaattgctcttcagccaaccacctgggagtctgtaattttgccagtggaaatgaagcaaaaataaaaaggagtgggagaataaaaaaagggaaatgatagcttgcagagggatgtggcaagtacaggccaaaatgagcttctaccaaatgccctgcatatcttttattggccttctggctgctttttgaaaaggactaattctagagaatgtctctttggcttgcctctattctctgccttttggctaatttgagaatttaaaagggcaaaggaggtctggctttgaagggatgtaaccttcaggctttaatttggagcaaacaaagcatttacagccgctctcctctggcagttgcagagtattaccacactgctgaatatttaaaagcaaggcgtgtttccaaccccaaggtctgtcccccaattgataagtctctttttattaaatgaactttaattacttaataattagaccttccacaggagaagatgtggatcctgatagtctgccaagaaggctagagggcaaatcggaagaatgtgccattttcagattagaatttaaaagaaggaacaggcccattctgggggtgtgtgggtggaggagagacctccctagaggcggcaagtcttggcataaacctggactgtgaaatgctttatttccacttttgcttgaaaactaaagtactttagaattaaatgaatgagagtacatgtcgaaaatattcaaactttctgactgtctggatctgatggaaagatttcttgtcgtctatgcagtgtgtgtatgcttgggtggaagggtagggagagactattgttctccttattttgattctgagagcctaacacttttgatgtccctacagatttagcagctttccattcattgccatggtgattttttacctcatttttttttttttagcatcacaaaggaaaagcccaaatgaaaaatgtttgcttcttttgctattaacatttctactgcctggtgacagcaaatatttgggttgtgcctagcttctgaggaaatatgtattggtctgaggagattgatggccacagccattgcccaggctgtcccagctgggtgaggggctggccctgagaccactgataactttgttcctggggacagtgatgtgaagggaggatgaggaaatcccattcaaaacgtctactgatttacaattgaactgtttgtggcttagataatattttcacaaatgccttatggatagcctctccacacctcaccacctctacaccaacccatctcttcaaatgaaaggatttattagtctcagctcttttctgctttcctgaaaaaaatcactgcttttcccttctcctattttattatttatttattttttaaagacaggatctctctctgccacccaggctggagtgcagaagtgtgatcatagcttactgcagcctggaactcctgggctcaagtgatcctgccacctcagcttcctgagtagctgggactacaggtgtgcacctccagacctggctaattaaaacaattgtttttctttctttcctttttttttttttttttttttttttttgagacagagtttcacttttgttgcccaggctggagtgcaatggcaccatgtcggctcacagcaacttccacctcctgggttcaagtgattctcctgcctcagcctcccaagtagctggggttacagacatgtaccaccacgcccatctaattttttgtatttttgatagagacggggtttctccatgttggtcaggctggtctcgaactccggaactcaggtgatccgcccgcctcagcctcacaaagtgctgggattacgggcatgagccaccgtgcccggccttaaaaacaactttttttttttatagagacagaatctctctatcgtgaccaagttggtctcaaactcctgtccttcagtgatcctcccaccttggactgccaaagtgttgggattataggcataagctaccactccaaggctcctctaactaattctttatgctttcctagttattgcttgtgtttcctaaactttccaatatttagggtctgaaacatttgcttaaactgattatcttaacaatgatatatatttttcattcaacatacgtttgatggccaagtatttgccatacaccatgctaagtgcttacagtatagaataacatagactcggctctgatttgtggaatttacagattagtctggacgatggctagcaaataaattccacagttaatcacaattgaagtaagtgctggagataaaacctgtaggacaactggttctatccggacttggggaaagctactatgaggaagtgagaattctgttactgcattgaactattaagtctcaggtattcaaacacactgttactgaagagctgcaaatagggtaaaacctttactcttccttgcatgggtagttaataaatgttctaggaacaaattggggttacggctgcttaacaggcattgagcaacacttaacaaagtaacatataagtagactcctaatgaatccttttaatgttaaaattagtgttacagaacaatggaagatccttttcaggactcaaaataacaaggtgagacccatttctctatggcagtctcataatggctctatatctcttgctaatagcacccaatgcttactgtacaactataattagaattgttgacatcaatataatttttgatgctgaagcccaggcacttttactttgtattaatcacttataaaatttgaattaaaactgtctttatcatttctaagaagattaaacagagcttccatatgtgtctgacttttccatatgtaaaacaaatgttctttcctttttatagtttctcactaataagttctgatctttgttaatgcatggagatacagataatgtggaaatctgtaagttggcttgtgtgggacacttccaacaacaccaggtgttcctgtatttaaagctgccatagcatcttgggccagtctaggtgtgaaggtaggaactttgaaattcattctgggaatcaaggttttcctaggctaacaatgtaagccctgcaaaatcaccaaaaattgtttgtctgctatttttaatagttaagtacttcaggctgaaatttgtctataggaattcaatgtaaggcagaaagtacttactaaacaacaaagtgtattgagtacagtactgctacttgagggtttgaggagtgaagagtattcacatataaacgaacgtctttttgaaatatttttgtttatgtcagggaaataaggtattttaagaagtataataattcagtactaaacctttaaaaataaccatcatgggctgtgtacagtgactcacgcctgtgatcctagcacttcaggatgccaaggcaggtggatcatttgaagtcaggagtttgagacaagcctggccaacatggtgaaaccctgtctctactgaaaatacaaaaattagctgggcatggtggcatgcacctgtgatcctagctacatgggagactgaggtaggagaatcgcttgaaccaggagacaggttgctatgagctgagatcgtgccaacacactccatcctgggcgatagtgtataagactcgggctcaaaataaataaataaataaataaataaaaataacaatcatactataaacatttgaaagagtttggtaccagttccatctagaaagtggagataataatacttcctaaaagagccattatgaagattaaataaggtcatttataaaagtgtttataatggcataaatgataaaacaatccgttcccaaagtcctctagcttgttaaataatgaagcggggaagtgactccaggtaatctcattattccaaactgctacacagtatgctggaaagtgacagagccaaagctcaaatccaactttcaaaatttggatgtctgcaatactctatttaaacatttagagtcacatagaacctcagccaatgttttgtatcttttttctttcagtaaatatttgatttacttcacagaaataaaatacagaaaacatccacatgaatgtagaaatacttttcaagcttttatttatacacttaactttttatagtatctgcaaattgtgagtactataaaaatttaaaaggtggagtgatgatttccagtaagtacgactaggaaaaagggagagatttttgattgagtacctaaaacatgactagagatttgataggtagatgttagcagagagcgtgttccttttcagaggaagttccataagaaatacagccaagaggaaaccatgtttaggacatctacaagttcaatagatctgagaattgttttgcagaagttgtggaaaatgaacctgaaagggacatagtgctagatacctgggcacatattaaacaaaaaactctttgcctggttttggggcaaaagacaatgccagaacattttgggaacttcaagatttcctgagtgaagcaaaacctttagtgatgtaggagcactgatattttgactatgtttggaatgcattcgagtgaggaaaacagagagataggaagaccattgctgctatcattacaacggatcagatgtggcctaatgagtctgaaccaggctttttccatgaatgggctgtggttgagcaggtaactatttttcacaaggatctagtgaaaattatacctgtatctctctctggatgaagcttgggaatcatttgtattgcattagaacattagatgacttttacgaaaatatagtatttcatacgtatgcgttatagtgagtttattgttcattactagatattcatgcacataccttgaaactatagtactaagttgatagtctataatttcttcttcttttaagactgttgctgggttgttacaccaccatgagatgtaactgctaaaatttagcacaatattgggagcattcagtcaagccttatagagccttataaacttagaattgcttttgaatgtgtagagtttcccatttagagacaaaaagaaaagactatgcatcatgtttataatttctcactatgacaaataatcaactctgtgaaattttcaaacattgcattgttaacttttaaacaggatgcagttctggccctggcttgttaagatctgaaatcatcacagagtgcatgcaattctattagccaattctgttaagtctaattatattaatatgcaatcccagcctttgtatcgaattcttccaagtagatgaagtttacataggaaaccaattgttgagtatcagtttgaattactatttcattttacatattccaggctctagaacctacttgcaaatacatttttgaatgcaaaagacattcggatgtaaaatagatgtttaattttctgttttattatttctttttttgagacaggttctcactctcttgcccaggctacagtgcagtggcacagtcttagctcactgcaacctctgcctctgggctcaagtgatcctcccacctcagcctcccgagtagctgggaccacaggtgtgtgccaccacacctgggtaatttttaaaaatttcttgtagcgacagcgtttcatcatgttgcccaggctggtctcaaactcctgtgctcaagtgattctctcacctttgcctcctaaaatgctgggattacaggtgtgaaccaccatggataaatggtttaaatgctttaaatttatccaatgtgtatgacttctaaagagccataaatctgaatatataaatgtccagattattaaaatcaacttaaaattttattctcacctacatatattaaatacataacttgtgtatattggaaaattattcctgactatatttccttaactacaaaataaaatactagggatgacaaccaagaagaaaactattaaataaaaatcaaatttgtgcgaaactcattgccctacataagcctcatatctgtcactactcattgcagctttgctttgtgtggtagacacagatcatgctctgtttaagtacatgccttaaatccatacctgagccaatctgtagtagattaacgtacttctttggaatagacacaagactgtataatgcagacagtctggaaactggattttgagcaataagcctgggtacaaggtaactaattcctttcgttcttcacccagtggtagatgcagcacagacacagattagttctaactgaaaaagaataaaattagccaagtggctggcgccccctgtaggcaatctgtagtgtttatccaggcatccccatggatccagatttcagagccttagtttaagaatcagatgagtaattttagaatatatatgtgagggataaattaatatttgcatcaatattaaggtttttgcatggtatagcattaatctttcttacaaagaacaatcttaatattgcatctctaggattgcaggtctatttctgtggatgtagctataatgagtgatatccttcagcagcttgtacctaacccacatataattttggtctaattttatatttcatagattcagttattttgtggtccaaaactctaatccctaaaagagacgtaaaatttcaccttcacttagggagggaaagtgaaatagcatcgcttattgtctctcatattaaattatgatttgacccaggtcattttacctttgcccttttggccacagcaaaatttgtatcaggttgtggggaaaattaggatcatgaaaattaatagacccaaattaaaactaagggtaattaaaactgaacacagtagaattttgtttactgaagattaatgagacaatcaagctttctggacaaaatttaaacctggacctggggaatgttgacttaaatctataaaataaaaatcacagtaacataaaatatgattagtaaaacttgacatgaaccccagactgatgaatggatcaaagtttattgtgacatgtgcataaaattaaaacaattctggaatgagtcaaatgaaaatagaaatatcagaatttaactgggatgaatagcaaacataaataattattaaaatttagttgaattttctctaagaatttgccagtggtctttcattgatggcacaattgataccaatagatttctttgtaataatttaaaaaaacacaagaatttcatggtcaaaacttaggatcacaaatatccacttgttcatatcagggggtttgagatggcaaggtgaaaacacctacccctctcatgtacaacgtcatggcagagaagccttctctctcaccatgcttatgcttgtatgcatggtgatgcatacaagcatgtatatgcatgcttatgcttgtatgtaatggccagtttatttgttttattttttcatgcatgcttatgcttgtatgtaatggccagtttatttcttttattttttccttatattggtcattcatatgaatgaatcattttcacatgttatttcatatgaacattgaagtgactatgtgaattagatattaccccatttcatggcccaaagaaatgaaacaagtttccaaagtattcatatgtaataggtggctcaactagtctagaaacacaagctatcctaattccagcttttaaatcttttcactacaccacagccatacctggcaaatgtggatgaacatttaccttaagcagtaaaccctaaaagacaatcctttgttactataattggtggttcctatcatccctctttcttgaagctgctctaggtcatgccgtatgacgagtccttcatgaatcttcatgacttcataatcctttgtccaaagtggggtaacaggaattctgtccataggaccaggattcggaagaacaagttgctgtctgtaggactgtcatctaaaaactgaactccaatgtgggatttcacttctctgaacctcaatttccttatctataaaattaggctaatcttatctactttgtttattttacagggctgttttatttaccaataaataagcttctagagatgaatgacaacatcttcattactttttagcctctgagcatactgtagtgccagacagaaaatgtggtaaagtgtgaagagcaaatgagacgatatttgagaaaacagcttgtaaaatataattttctacaaagaatacaaagtgattatttttattggcgattattgtgctttatttggaagacttattcttccttctttgtttttctcctaggaccactgaggttcctttcacagacagaatctgtcacagccttcatgggagacacagtgctactcaagtgtgaagtcattggggagcccatgccaacaatccactggcagaagaaccaacaagacctgactccaatcccaggtgactcccgagtggtggtcttgccctctggagcattgcagatcagccgactccaaccgggggacattggaatttaccgatgctcagctcgaaatccagccagctcaagaacaggaaatgaagcagaagtcagaattttatcaggtattgcaatgctctttgttgccttcagaatgatattctctggaataagttgaaaaacaatttttttctttaacagatatttgtaattgttataagttctgtattgttcattgcgttttgtttattatttctttcttccttgccgaagcattcaatcaggttgtaccaaaagctgttcttttttttttttttcatgtcttgttgaagtttctggaaaaacagttatctctcctttattcattcacttgttctattaatatttagtgagtatttctttgtgcaaggcccattgataagcatttctcacatattatttcattttcctctgataacagtctaagaggtagttttgattcatttcaaaggatgaaggtgaaaatttgcaacgttaagaacattccctaagttagtattgaactatagatatatgatacatatagatatatatatgtatcatatatcatatatctatagttcaatattaaaattaggctgatcttatctactttgtttattttacagggctgtttttttttaccaataaataagcatctagagatgaatggcaacatcttcattactatttaggctctgagcatactgtagtgccagacagaaaatgtggtaaagtgtgaagagttctcttttgtatattctgtactccattagtcacagggatactgacttaaatgtatcaataaccagtgacaacacttacatttcatctaccaggcaataacagaagcaaagctagcatttattcccagcacatacatgcatctatttacatttccattacatacacaaaattttaaatatatcatacatatatcatatatatcatatatacatgatatgtattatatatataccctatatacatgatatatatcatatatacttgatagatatcatatatacatgatatgtcatggatatatacatgatatgtcatggatatatacatatggatatatacatatgtatatgtatatatccatatggatatatacatatatcatgtatatatgaatgatatatatcatatatgcatgatatatgtcatgtatatatacatcatatcattcatatatacatattttttttagactagggtcttactctgttgcccaggctgaatgcagtggtgcgatcacagctcactgctgcctcaacttcccagtctcaggtgttcctcccacctcagcctcagtagctgggaccacagaattgtggcaccacacccggctaattttttgtatttttttgtaaagaagaggtttcatcctattgcccaggctggtctcaaactcctgggctccagcaatctgcctgcctcagcctccgcctcccaaattgctgggattacaggcgtgagccactgtgcccagcctgaacaatcacttacttgtccattcacatgcttatttctgagaagcactgtgctaagtactaggaatccggcagtggcaaagactgtcccagagcctggcccattagagttctgggtggatgcacacatgtaagtaattacaatagggtgtgattgatatgatgattttaaaaaagtcatttctctccaactcttattttactttctcttctctgggaaatccctaagacactggcctcattttgcgattctaattagttagaatctcatgtaatgcctactttctcttttagccgaacttgtaagactgacttagacgctcttgtgagaatcccaaaaaaggcacacactggagaaattggaactgactacatctcaaagtatggatgttggcttcggtctctgcgctcttaactgtgtatagttatcacaagtacttcagctatgcagagagtagcattcttgtaattctaaaagcaaactggcaattcaattgaaagtttccaggtgctttaatgaggacatctctaaaacctctcttttgcagattctctactccattagtcacagggatactgacttaaatgtatcaataaccattggtaacacttacatttcatccgctaggcaatgacagaagcaaagctagcatttattcccaaaacatacatgcatctatttacgtatccattacatacacaaagttttaaatatttatattcacatattattaataatgcatctgttgagtatatcagatgggaagccaaggtaagctgcatggaaaattggcaagcatatgtttatcttaatatgacaggaaaatctgttttccagtggtattaaggaatcaagttgaactaatgaaatattaaatttgaaatgcagttttaaaagacacagagacattataatcaaatccccatttacctttgtttcttcaccttgcaacagccatttgcattgtaaaccatggagatttattttaagccaaattttgttttcttaatttgcctaaaatagagaacatgttgtacttttgagatgtgtgagcatttcttagctgaattgaaactgatatttttgtaaaggcatcacatcaaatgagggtttttatctaaattatatgaattcaaatataaactttagaaaaaattgagttaagatagtacatgcacgtgtgtacacatgcatgcgcacacacacacaggttattgtcatacttggctaagcctgtctcgtatgctagctgccaaataaagaacctgctaaaggagaatgcttttaacacattctcgagtttgcaagttggtttagaggtcaaattcacagatgcgcaataagtacaagattgagtgagtgcatgaatgaatgaatgaatgaatgaatggcaaatctctgcttctcttagttgccacttagcgttctctcatttcaaaaatcatcgtaatcctttatgaatcaattttcactctctgtaagtaccaatgtgaggcagtaataaattacatatataatacatatgtgtgtatacatgttaatacatacatgcacatatacaaacatcatattattggcatgacttaggactattcaacatggtaccagaatggttagaactcttgaaaggtatatcttttcctggagtcactaaattaccatgttgactgatgaagtaatttatatcttgctttagtttgagatgtagatgttaatgagaaattttgcaactttccccaacattaatttttaccatagttcataagaagtgtttgaatttatgtgtgtttatagttatataattctaaataatatttaatgtaatatacttattcaagtctatgtgaaacttatttcaggttgcctcttttatatatcaggtgtcttctatcaccaagtaactgaggtctattaaattcagagtttaacaaacagtggttttaaagtgctgtctttcagcgaccagtttcactttattcattacgtaaatactttattcaattaacttttgaatgaatcttacatacctgacatcttgatgtttgctaggaatgaaatgttggaataccatgccctacaaaagcttatagtccaatgggagaaatagacaaagcaagtaggctgtgctgtgagagaagaaaacacagagcaccattaccctcataagagcaataccaacaagtactagctaggcaaagagaagtatacaccatggaaaaagagcagcacgtgaaaagcataaagaaaatagagatcaaaagcttttcaggcgaactgtatatattctgtttgactggctcataggcaggaagcgataaaggggaagaagctggaaagaagggagttaaatggtaaggaggatgaggtggaatgctacagcgctcatcctggagagaattgaccaaaagcagctactaaggcaacatcagagaagatccagaaatgatgtttggtttggtcctggaaacatatcacatgtggcttatgggtgaagggatggaatccagactctgacagaagctggttagtagcatttttcattgagactggaagtgggagagtagtgttactgtgtttaaaacaaattatagattttttagaagatattttcccataaagttttatctcttccagattaagataattatttgtttcattaaaggtaggaaaattagtacctagtttcatttgttgattaatgttttaagacaaattgaatttttgctatggaaattatacatatgtaacagaatcagtaatacattgtgctaaagcattttttaaaatatcaataacaaaacactaagagttgagatgttttacaatgtctgattgtgtgtgatggcgaacatgtgatgaatggaagcagccattgtggttgtcaagttcactttattcatgtcgcatcatgtctgagtgccaagcaggacattgaattgcacaattataaatctgctttgggcactagactgactacaattactggcctatacaatggaattctttagtttgcctaatggcctaattgaattgatcaattggtaattcaatctattatttgtttaactacagttagatgactctgagtcctgtatagaccttaactaaatatttatctaattagagaccttggcttttaaagaaataaattggactaaaatatacatgatttttgtctatatttttattaaaataaatattagcagaaaccattctaaaatccatcttatttgaaaggaaaatcctgtcttcagttttaaaacaaatagttttagatttttcttcatcactaagaacttattactcaatggcacattaaacttttcagttttgctaaatattacttacatttcaaaactaatctattttctatgttttctataaaaatagaatgtagttacattatagaaaatagattccatttctatggaataatgatctgtgtaacaaagaggacactttcttcacttttaaaatgtattaagccaggtagttaattcgcgtagccctatgactaacataaggcagagaagggcaaattcaggtacacaattctagttctaaatgaacatagacaaggaactagttgggaaatttggaaggtttgcatagattattacttttataggtcataagggaagaactgtctgtacaatgattccagtagatgataaatgcagaatgagaaattgagctcactttatttataagataaatattcagattaagtaacatgccctaaattgtacaattaccaggtggtgaaaccaagatttgtacttaatcattctgtgtcagaccccatgatattaactacttattataacagttcaagtagggaatttatgcctaggaatttagacttgattcaattaactttgttgatgattgggcattgctgaaggtttttgagcaatgaatacactgacataaacatacacccaaaaaacggaagtgaacagcacattaggttaatgcattacctgatatttttgtctcatatttaacatttttttttttgctgcattgtaggagtttctcatactgtgttttcttttaaaaatctagtttgaagaaaactttctcttataccagggtataaacagggtgcacttagcctttcatagatttaagatggataaaatgatttcttgtgctcctctcatatatactggaaaaaaatgaagtatatgatcttattgtatttaagccagatgaagtccatgttttctagatatatcagatttaattcagatggcatgaaaaggtctgcatatggactctcacagtctatttccatggattctgctaacattgacttaacattgaccagttaataaatattaaaagttcccaacttgaactgttatagtaagtggttaatatcatggggtctgacacagaatgattaagtacaaatcttggtttcaccacctggtaattgtacaatttagggcatgttacttaatctgaatctttatttatcttataaaatgtcgcaagtaataccacatatttcatagggtggttgtgaggcttgagtttgacaagacaagcacaatgcctgtaacttcaaagtcctcagtagctattataattatcttagcattttagagtttccagttttaaataattctattttcatgtcaagataatttctctggtaataaattacctgattttggattctgggtctcataagtattaatttgtctactggtagttcattacacatgctttaagctatttatctgtagtcctagcacatttctgcattttattttcacatctaagagaagtcagagtttcctgcatcttcttcctctctagtaacttattgctacatgattttacctttctttacctctccagtaacattattttcctttgctgtatgatatggtataagaggaactggtttagaaataggagtcaggagataaataagcttgatagtgtttgatcttcattacccatgaacaattctaatcctctcaaacccttagtttccttatctgttaagagaaaagggtggacgacatcagcgtcttcaaatcttttcactataaaggatctcatttattatttcactccatactcaccctcaactctgcctttataatcctagacttcaacaattcaggttagcaagacaaaatctaatccttaaaagctgcaaggccatgctataacacaataattaatggtcaaaaatcaattttatgaaatatgagattgttctatttttagattaataaaaaatagttttaagtcagtttatgctgtcacacaaatcacaccaaaagaagataggataccttttattgtgtacaactaagttccacgtcattctgtgcccctctccacaccagatgataactttagcctgccctccttggtaactagggctaggcagagcacaggagtaaattgacaatcctattgtagtggaattagttatagtaggtcaggtcatttaaccaatgtgcaataaccaaggtaaccagtctttcacatggagctgatgacattccattcagatgtaacaaagcctaatatgttgataagcctaacctgacttactgtggatacatagaccatttctgtttgattctgaattaaaacgtaattatttatttcccaatgctatttggacggacatcaacaaggctcaggattccaagctgaacctttaaaaacttggggactgattacatttttctagtcatgtctatcattctaaaattagtgatctccccctcagcaaatcaaccagtttttttttctatttttattgttgaccttgagtgatgttagatatggattatattatattctcttagctactattccctgaaaagttactatttcctgtaagttcaaaagcaaaaacaatgtatttgagattgtcctccacgtaaaggaatgaatatgtcttggaaaggagagaacctgttttttcccaagagtctcatgaggccaaaatatggtcatttctgcatttacttatgaatgtgatatttaacagccctaggtgggtcatcttaagggtcaggcaatcatccgtgactctcacatgaacaagaaaacctccctgagggtgtgtaggatccagacttataacccatgaagcaaaagtcacaaaaaaatagtgaaaagacctgtagagcttgcttccttctttggcctcatttgccatctatttattcctggaacataaaaaaagacaaatttagtcataaattataggcacacctttattgattcaacactgacaaaatgggaaatagtccaaatgctttggttcattatcaaacaacaagagccaaaatcacaaacccattgcttttctggaaagtttttaatgctgctttatgcatgtatctatacatcatgaagatttttggattctccaaactaactttgacacatcataatggcaacatttgttttctgggattctactgtcagctgcaaaattaaaaaaaaaatctaaaaataaaaaaaaatcacttccttcagacttgctacaaaatgaatctgatagacttaaaatttgctgtgagacacaaggggtagaagccatacgccagtgataagaatagatgatttcctttcttccgccagactctaactagaaatagcaatatgtatgtgtacatagagaaagaaagaggaaatatgaacagatgtaggaatatttacagagagggaatgtcatttttagtactgaattggtgtaaatgaggaaggaaaataatagaatcctagagtggtgaataatagctccggagaaatggcttctttctccctccatgtccaaaagctccttggcttacagccagatggaagttttcatttttttattaaataaattctggttcccgtgatcagtttggattaggctggtttttcaataaagaatattctaaacacagagttaggagtttcatggaatttttcactcagagcacatagtagagtacctactggtgtttgaaggctcacggtacctgctgaatattctaaaacagaactagatgcgggatggctaagcagccagcaggtgaacagtaggttagcttgaaattgaggatgcagacagagcaaactagctctctgaagttaaattaatttgtaactcttatgcctgggaagaaatcaaagaaaataccccacagtagcctgcagtgccctttcatttccatttggaaatgtgtttgatattccatggaggcaggaatttaataaagaaaaccgaggagtacacaatgaggaaaaaaggcttttgcattcagaaagcataaaaattaaaagcaactactggttattttgaggaagacagttattaagttgtgaaaactggtatttttttcttgccaacgcagatgtcaacagtccataatttaatttctctgtgtctcagttattctttagattcagtgccgtaaatttcatgttgaggttcctaaataactgtttagggaaatggccctgttaaaggaaagccgtagtcatcactgcattagcataaattcttgtttactcaggatacatttgatcacatccagtgtcctaaaataattgtaaggagtgtttagggtcccaggttggataatttatatgaccaacctagtcatctaccatgagggaagataaaatagtgtggccccaaagacatttgggaaaatctgtgaatatggacagtgaatatgcccctcagtatgtcacacacactcaattaatttgaccattgtaatgttttaaccttttttaaaacaattctttaaaaaggaaatattctcttcctttaatacatcttcccttctttagggcatggggcctgatgatagttgactttttgtttctgaatatattaagtgtaaataaatgtgtcaggttatatgatccatgatgctatttgacttttaacaaattattgctgaaatatagtaattgaacatatttaattttgcactatcttctcaaaggcaaaataagaggggcaagagaggcagaaaagaggaaggaaggaaaaggggactgaaagagggaaaaagaagaaatatatttatcaatttctatttgagagatacaaaaccatttctatgttgaaggaaaatgggcttcttgagtatttcagaaacatgattaattttatgagactgtgtctgcatttgttctcaaagtatggtagatacctagaactttggaatttcttgagatgctttcaggggatctgcgaggtcaaagatttattttaataataatatatatcttttgagttttttaccatgttggcttaagaatgtccatgaaaaagcagtgaaaattattaattttattgtctcgatccttaaagtacacatctttttagtattccacatgtgtcaacataggaaaatacatacgcaaaaataaaagtataatgggttttgcatggtaaacacttctgaggtcatttgtgtttcaagctgaattagctaccttttttttttttttcttcatgaaacaccatttttacttgaaaggacagtcaatagaaaaacttgctgttcacacttggatacttgttacacatttctcaaaaatgaacaaagtgagccagctacttcaaggaaaataatatttacttccaagaatgaaattcaagtttttaagttagaaatttgcaaaacatgtatctgccactgggagcttgacagcttcccaacattcaagcacctttctgatgggattggtggtgagagtagcaaatgagactttttgctaatctataaatgtttcaacatttggaagatgtgtctaatacaatgtaccaatccaaataaccagtgattgatgtgacagaatcatgcatgggtaaaagatctattcaaaataccagctagatcagtagatttttacataacatagcacaaaacgtttataaatatggtgctagatttcacattacaactaattttcaaaaccctgcttattgagttttgctgaagtgttcaaggatatctctacaattatgtgaaaaggctatcaaagtacacctcccttttccaactacatgtttgtttgagatcagattgtttctatgtaattcgaccaaaacaacataacagaacaatgtcaatgcagaaagtatttttaaattaaaccaataatttttaagatttataaaaatggaaagaactaccactatactcaataataattttgttttggccgacataggtgtttttttaaaaatattatttttgatggggtaaaaataaatatttaatagactgggcacagtggctcatgcccataatcccagcaacttgggaggctgagacaggcagattgcttgagctcaagagtttgagaccagcctgggcagtctggtgaaaccccgtctcaaaaaaaaaaaaaaagaaaacaaaaaaaaaaaaacaagaaaaaaataaaaaatattggctggacgtagtgacatgtgcctgtagtcccagctatttgggaggctgaggtggaagatggcttgagccagggaggtggaggttgcagtgagctgagatcatgccactgcaacccagcctgggcaacagagcgagacagactctgtttcaaaaagaatcaatatttaatgaacaaatattttaaaaatctgttttgatttttagtatggaatgtatttgttgctatatcctgtataatcaaaagctaaagagcttcaaggggatattcaataattttcaaaagcacaaaagttcctgagacccaacagtttgggattcactgtctgcatcgttattctttgttgtaatgattgtagactggtcatcctcaactcaggtaacagattaagctaaagtaggtcaatatttctatttagaaaaaagtgaagaggaaagagagaaaggaaaggatagcaaaggcaacgtattgccatagggtggttccacattttaaggcaccctgtgtagcctgagatcagtatcactgtaatgactgttttctctttatttccataccaccctcttgctgtctgggaggattatctgtactgccaccaggataacaaacagaccagttcaaagaatcaggttaacattttctccccaatagggaaatgctaaactaggcttgagttcaagtaaagcattactgcttttaatcgatttagaaaaatagttacataactttgtacatttacgttcatgagcatcacattaaagaggtatgcttttgtagattttaataccaaaatttgacattagaaaaaaatccatttttttctgctggcttgaataaaactattgtcaaatatgttttctaggacccacgcttatatttttctctcagttttattttaaaatatgccatagatacatataagtacatgaaatatatgtatatcttagagaataaaatggaaaatgaccatgtatgtgtcaaccaatttatgaaatagaacattacaaatttgcattctgataccctctcctgtaattgaactatgttcattaatttactggaaaagtctttatattctattagctgaataattgcatttggatatgaatagtggtgcccatataacgagaacacaaatgatttttaatcagtaattactaatttcatcatggttccattaaaatcaatttagtcaacaagactcacaacctagaattttaagttcacatctcccagggccttttaatctattcttaccgagcttagaggaaaaattttcctttgctcttaaatatgtgcctcgaatgttagtcattaacttttataattgtttgctcctggtacaatttctacacactttgcaatactagagtttaagataactctgtactctaagaatactacatgttattttaaaacctttagaaaatacgcaagaatccaaagatgaaaaaaccacccataattccatcacacaacattaaccttgaaaattgcatctttatcctcctcatttaaaaatataaatatactttcttaatcctcctctctaaaactcatattgtaaataaaggagaaaaataaggcagatatctagtttaataatatttctgtagaacatttcagcagtgcaaaaacaaactaaaaatcaaactgaaataacaaagttatttggtattttaagtttctgagatcttggtttcatttttatgtatatatttcagttattttttgcagcataataaactaaaaaatttaatgactcaaaacagtaatgatttatgatttcttatgattctatagtttatatgaacagtttctctgctggttacacttggcctcacttatgtgcatttggctgagagagaggtttcaagatggcctcactcacatgcccgacagctagtgctggctgttgactgagtgcctcagttattctccacgtgactttctgtcttccatttggctagacttacatggtagtgtcagagacagcaatggcaaaagctgtaaggccttttgagaccgtggctgcagagctcatgcagcgtgactttcaccataatctaccagtcaaagcaagatacaaggccaggccttatttacaacaagagtaaaaggcatcccttttggattagagaatattaaaaaattttttgatcattaatctagcacaaagttgtaaaatgtatgaactacttactattaatgaaaaattgtgttccttttgggggaactttcttactatttgaacttatcaaatgatataaagaaataccaaacttattggggaaataagatcatgtttttctggcaaaagctgacattttcatatgaatgtatgtacaaattccaatgcctatgaagctacgatggtaacaaacatcactgaaatgagccaagtcaagattggagtaatctggaccatatatgctctatctgaaaatggaaaagtcgatggttctttttttttttggctgaataagtccagtgatgcctggaccactgatattttaaaacaaagattaaatattggtaagtaattttgttaaacaacatgaatctaaaagttacatggaaagacaagagacccagaatagagagcacaatactgaataagaagaacaaagtcaaaggatggacaccacctgacttcaagacttactataaagttacaacagtcaagatagtgtggtattggcaaaataatagatccatggaacagaggagagctccctaaaatagacccagacaaatacagtcaactgatctttgagcaaaatcaagtcagtggagaaaaaaatcgccttttcaacaagtggtactggaacaatagaatgtccatatacaaaaaaaaaaaaaaaaagaatccagacatacctttcacaaagattaactcaaaatggaccgtaaacctaaattcaaacacaaaattatgaaacttctagaggataatgtaggaaaaaatataggtaagcaaatttggcaatgcatttctaggtataacgtctaaataatcatgaaaggagaagttgataagttggactttattaaaattaaaaacttatcttctacaaaagatacttttaaaagagtaaaaaacaacccacagattgaaaaaaaatttgcaaaacacacttgtgatcaagggcttcaatccgaaacacacaacaaattattaaaaggaaagaaataaatttaaaaatagataaaagatctgaacagacacctcaccaaggaatatataaaaatggagagtaaacataagaatatgtttaacatatgtcattaggcaattgcaacttaaaacatctattatataccattacacgtgtattagaatggctaaaatacaaaaaaaataatggcaatagcaaatgctgacaaggatgtagaactttttttgctggtggcaatgaaaaattgtacagccacttcagaggacagtttggcagtttctcacaaagctaaacagttttaccatacaatctagctattgcactccaatatatttaattgagttgaaaatttatgtcctgataaaaatgtatgcttgaatgtttatagcagatttgtttataatcaccaaaaactggaagccaccaaggtattcttcaatagacgaatggataaactggtacatctagacaatggattattacccagcaataaaaataagtaacctatcaagccatgaaaatgcatgaaggaatcttaaatgtatattgctgtgagaaaaaagccagtctgaaaaggctatgtactttatgattctagtgatatgacatcctggaaaaggtacaactatagaaatagtaaaatgatcagtggttgcctggagtttggtagggatggcaggagtgtaatgaataggtgaagctcagggatttttaggatgctgagattattccaaatgatatggtaatacatatatatgacatgcatttgtcaaacccataggattatgaaaagtaaagggtgtaaataatgtcagctatggacttcagttaatgataatgtatcaatattggttcatgaattaaaacaactataccacattagtgtaagatgtttgtaataggagaaactgcattgcaagggatggggacctgatatatgaggatactctgaactatctatctgttcaactgttttgtaaataaaaaattttaaataaaatattaaataaccattttgtgttgcatgattttgttttctgataaaatagtttgagtggaaaacctcagctgggcttggtggctcacgcctgtaatcccagcactttgggaggcttaggtgggcagatcacctgagatgaggagttcgagaccagcctggccaacatggtgaaactccatctctactaaaaataccaaaatgagccaggtgtggtggtacatgactgtaatcccagctatttgagaggctgaggcaggagaatccgttgaacccaggaggtggaggttgcagtgagctgagatggcgccactgcactccagcctgggtgacagagaggctccatctcaaaaataaaaataataataataataataatatatataaatgaaaggaaaaagtgtcccttccatgggtaaattagtagcatcgttgataggtcctaggtaatttttttttcttttttagctagaagattaagtagatcttgatgtttttcacaggggatattgtagaacggtattgtatagtgtaagttgtagaaacatttctaccgaggagcagatggtaaaagtaaaatattcaaatgcataggcctctaatatcaaggcaactatttgtaaatatatattttgggaactttcgtgttcaggaaatttattattaagcagtattgtctttcaaaccatatttgcgagatttgaaaagtcactttgaagaaaggaaatgaagcataccatcagcaattttcaaaagttctgagacatttttctacagtattgatataataaagatgaacacatttggaaaatgttctcaatattttcattgtgaagagtatttatttttgttgctggaacaaccagaagcaaatgtgggaagactgagaaagtgtgaaattttatttctccacgcaaagaatactttagataacaattactgtctcaactactagcttgagaactggtgtcctttttattacactgtgatatacctgtgtggagttgggtcaggctaatgaagactaaagataatgtcaaatatgtcctatgtcccctcccactttatattctctttgaccaccagcagctcatgctatgacccgattgggtctgtcctcactcagcgattctcctcaccccgatcctagtttaaaagatttcattgcctcattttctttgcatccagattttgctttgagtctgcaaaatgacagattattggctaatcccactgaatgaatttggttgaagatgacttcaattaagtcttcctcaggagatgtggattttcatgggtacttgaaaacacagcatcttgtctcaaataaactttgagtgacataattttagtcaacaggtctggtcagaggatgttgccatgggtagaacaccctcctccaaggactggttttggtgtgtccccaggcattatcagtagagcttatataggaaggtaaatagaagctcttaactgtccgcaagcctacttgagcattgcatttggggcttagaactttgtgaattttttgcttattccacctgatataatcttagcaactttggatgaaatgcatttaaggattgaatcaaaagacttcctaagtcgcataaagactgtttcagttatctgctagtaaaagtgaatagtgttccatatatagaactagtaaatgcatcagatgaagtagaaggatgcagagaccttcactgacccagggtttcagctctaggggcaaactcactctttgaaatgttgttaaaattaaaaataaaaagccagacacagactagttataaaataaaccaacttcagttatataaatctgacttccttttctaagaaagcagttattttctcagcacctgtgtattctactcttcagtacctgtacgctatttaatacaatttgaatatgtcaaattctaatatatttgtttctcttattttccaagccacagaagcaataaacaatgtagaagaaagtagaatagatattggtggtaggcaaactgaacatatcaataagttttggacaataacatttagaaaagctattgacatttttctgttctctaatgctgataagtaaacaattcctgcttacttatgggtagcctcagatacatgaatagcctcaagctgatgccctataccatgatgtcatcaacagctaagaatatttcaatatcataatcctatacacttgggatgaaaaaaactattttaggagtttacaaatttcattggcatcttttcatttttctttccatcttttgttaggaaaaaaatcaaaatatatcatttatctttgcaatgtttttcatatatcatatgatactgtgttttcccctcatagatccaggactgcatagacagctgtattttctgcaaagaccatccaatgtagtagccattgaaggaaaagatgctgtcctggaatgttgtgtttctggctatcctccaccaagttttacctggttacgaggcgaggaagtcatccaactcaggtatttcacatttaagacttttttgtaaagtgtacttttgtatggtatatgctgctatttatatttctctaatttgatataagtacctacagtactagggtttttcataataattgaatatttttccacatttcttggcatgatacagttatatgaaagatatttagccactgggatgagaagatgaggaaaagatcaaaatccatgggatcaattctgaaaggaaactgaggaagtcagggctgcctttgagatggtcctgtccaaagagtcttcagcagagaaattttggtggattccattataagaaagtggtatatagagaggtttgatccttaatattctgtgtcacacacaaaagataactatgtgaagtgatatgatcatcagttcaactgtgataatcatttcacaatgtatacatataccaaaacattacagtctacactgttattatatgcaatttttgtcaactgtacttcaataaagctaaggggaaaaatgaaactaaatttttctgaattcaaatatgtagcatgtcattatagagtttgagcaattttttttagcttcaactatatcgctcatattcccagctataacaaatatttaagggaagacagaataacttggctggctttgaattgctggaatattaatattaagatacagttagaaaataaactctcaatagaatggaatacttagtctttctgatgaaatggatcttacttaatttcattgatttttgaggactggtattctcctttttaacatatttatttttatagagaaggtaagtccatcaatcataaattaatctttaaatttcatttaccttaaatatttagataacaacaaggcatggcatatgatattacagtatttttgagaacattagaacacacaagaaatccagttaccatttcagcacatcaaggtgtgttctctgcgtatagccaagcactcttagtgcagtatcaaatatggttttgtacaaaggttactaaattggatttcaggacacaggacattgattttcacttcagagtaccacttctctagacctcgaggttctcaaatccaaaatgagagatttggactagattatctatcattttttttttagcactaaagttacttccaagtttaatctgcttcatttatttgatcgctacacacaatcttccaatgggagtagtttaccttgagtgaatttttggatcaataagtgagactttaatcaagcccttatgatacacagtttctttcaagtgtcttaatttgagctttggtggaggtcatttaaagctctgagtatcttgcttaatatatacatatgttaatttactctgcaccttccctatgtcttgcaggtctaaaaagtattctttattgggtggaagcaacttgcttatctccaatgtgacagatgatgacagtggaatgtatacctgtgttgtcacatataaaaatgagaatattagtgcctctgcagagctcacagtcttgggtaagttagtggctggagatgagtttatattgtacctttcaaagtatatcaccgcgacattttaatgctcatcactgaattgattcctatgtttattagtgtgaaattgcaaagtcccaatactccacacatgtccttgctttgctctgattaattgcataggggttatatgcaatgtttgaatacttattaattaaaatccagatatattatgctttagtctaattattccagtgatacagctgaaaagtaccaaaaattattaatggcagatgtgttgaataataaatatgatattacaaaatatctgggaaaataaatgaaggaaaattgtacaaaatatttatccttgaggggaaaaaggcagatgttatttgagatgacagggtttctgacattaaattcagtatgttggtaagatttttttattaacatgggaatactgtgagtgttgaaagtgaaccattaaaataaagtatatgtaaggaaaagttgcatagcaagaatataatttaaacagatttaaggaggattgaggggttcattatattccaaaaggcagggttacccatgtgtcattgcaaacaaataattcttctacatggcagttattcaaacaaacacatatttttatcacttactccagatttattttaaccagttttatttgaattatgtagtttggagaaagtgccttaacatttggatttcagttgctttttttctgtaacaacaaccaaacattgaatcttaggaatttttcctctggaataaatctttttgccttttaaagaatctcagaaaaatcatagtctatttaaaagttattaagtaaaaatgaaaatatatcatatgctgattatatttgctaagttataccatgatattattccatccattttgctttttgtcttcaaaggttattcagaaaacactttcatctgtggacatggtaataatgtatatcatgggttagataatgacgttgcttgttctttgatcaaatcataaacattaaaccaggaatgggcaaaagacttaaaccctggatttagaggtagtattatactaactaaaatattagctgcctttaaaatggcacagtttaattgagtcatatttcatattttggtgaaacaaagaatagagaactttcacatttgtagtatcaaaattcagtaacacaaaatggttatgatggaaattgtattgtgctgtatattactgattataaggcagatttggttatggaatacgctagaatttacactggtcataggtaaagcattacttgcatgaggtcaaattttatttcaaattaatgcacattattttgacatgtaatggttcgttgatatctgagataaacatatgcaaatactgatttctggggataaactaaattagtctctatatatatacacacacacatatacatatgtgtgtgtatatatacatatacatacacacacacacatatacgtgtgtgtgtatatatacatatacatatatacacacacatacatatgtgtgtatatatacgtatacatatatatgtatatataaacgtatatgatatatacactatatatggatatatatacatatatatggatatatattttgtaatttacacaattcacaaagaaaaaatgccagtatgagtatgccaatacatatatatacacatatatacacacatatatgtgtatatacacgtatatacgtgtatatacacgtatatacgtgtatatacacgtatatacgtgtatatatgtgtatatatacgtatatatgtgtatatatgtgtatatatacgtatatataggtgtatatgtacatatacacatatatgcacatatatacttatatgtacatatacacatatatgcacatatatacttatatgtgtgtatatatgtattggcatactcatactggcattttttctttgtgaattgtgtaaattacaaaatagatgctgtttgatacatataaaactatccaaagatgcacaagaaaatatttaataattatttccactacaggcagtgcatttctatacctctgaagtgaatacttttggtatcttggcatgttttattccataaacttctcatatttcattgatgcacatatgcccacataaagtttggtagtggtatgacacttggatgcttctttgatttttccttaggccagatgattagtctctattacaatacctctagtgaaccttgactagtgttattatgtaaaaaatattgaaaataagcatccaaaaaatgctccacattactaatcattagagaaatgtaaatgaaaaccacaatgagaaccaccatctcacaccagtcagaatgtctattactaaaaggtcaaaaaataacagatattgccggggttgtggagaaaagagaaagagaatgtttatacactgcttgtgggaatgtgacttagttcagccattgtggaaagcagtgtggtgattcctcaaataacttaaagtagaattactatttgacccaacaatcctgttattaggtatatactcaacggaatgtaaatcattctaccataaagatacatacatgcgtatgttcattgcagaactattcacaatagtaaaggtatggaatcaacctaaatgccaatcagtggtagactgaataaagaaaatatggtaaatatacaccatggaatactatgcagccagataaataacaagatcatggcctttgctgcaacatggatggagccattatcttaagtaaactaatacaggagcagatcaaatatggcattttcctatttataagtggaagctaaacattgagtacacatggacacaaagatgcaaagtgtgtccttaggtacttgatgtttagtttccaatgtgggacactggggcctactgagagtggagggtgggagaaggaagagaaccaaaaaactatcgagcactatgcttattacctggatgacaaaataatctgtacaccaagccccagtgagatgcaacttatctatataacaaacctgtacttgtacccctgaatctaaaataaaagtttaaaaaattgacaacataaattaacgtaatataatacagttaatatgcattagtaatttaatctatgtgtacacatgtatgtaaaacatgtacatatgcacacatgtgcgtgcatatttatatgtgtatatatgtacatatatgtggatagatatacacatagatatattagaaacagcatttactgagttcaaaccatgtgagacatttatttgttacagtatcctctgtgggaagtacgtaggtcgagcccattagataacaaccctcttgccttctgtgcttctgtaccaagtgagaaacaagaacagcagtaaggcatagggtaagtcaaacatcaccttaatttgttgaagaagctgccgttgaccatggtttgcatctgcatgggaggcacatgcccatctggacatgggcagtgtctatattggcaggatgtcactcaggtgtcagcttgtcccactgcttggtggctggtggcaatggagagcacttgctctctttggtcaggcctgttcccaagagagaattgtaggtgaaaggagtctcttcaaacttccaggctcattaagttatctgtcatgtatcctgatccaggctcccctcaaaccaagaaaaagtgggtactggggagtggtgaggtcagaagtcattccctcgaggagctgcctctctagggaagaaaatatcagtattgaggcagaagtattcaacatccacaccccaaccttaggtgctacttttaatcccgttttacaaacgaaggcattttagcacagaaagataagtggctatcccaaggggggatccagatccaaatccaggcatccgaccaaagagtcttaggcatatgctttactgtctgccctgtctgctccacacattcctattcatcgttttttattatttatttttaatcttactgaaacagctataaaaaaaagcaggtttatgtgatgtaaataagaacaattttaaattttagtttggttaataattagtcacttacataaaataaaatacgtgaccgtaatgtaatgatcttgacaaagcagaaaggctgacaggggagcagggaagaaaggaatacaagctgttctttgaaaatgaggttaaaacaactgccatacttcgaatctgtagacacagaggcaggtgaaaagtgtactcaatatcgggtattgcttattttttttactgtaacttcttgtttattcaaagtggtgtgccgtttgtataatcagaaaaataaatgtggaggtataaaagttgacatgtttatggtttaaaaatgagataaataaaaatgttaaaactcagaaaatattgagattatgctaacatacacataatccaaagacctggactttgcaaacacacacacacacacacacacacacacacacacacacacacacactcacgtttgttttctccatataagtgaaatgtatgctatattgtatcctcattttcacttcaggataaatcatggcatctttctttgtgtgtgcctgtgcacatgtctatcttctccagttctaatttttttttctttttgagacagggtcttgctctgttgtggccttgagttcgtggtgtcagatgatcctccattctcagcctcccaagtatcttggaccaaatttggctatttattttttctttcttttctttttcttttctttttttcttcttttttgtagagacagggtctggttatattgcccaggctgatctcaaactcctgggctgaagtgatcctgccaccttggcctcccaaggttctgggattacaggcatgagccatcgcacccaaccttcagctttatattgtggaacattatcatgtttcttagttttaattaagcgaggtgtggtggcttgcacctgtagtcccagctactcaggaatctgaaggaaaggatcttttgagcctaggagctctagtccatcctggggaacatagcaagatcctgtatctacaaaaacaaaaacaacccactaagttaattatccttaagtatctttgtcatttatttgctcatatctgaaggaaaagtatcccagaaatacttaaaccctcactggcagagcaaaactttgcctcccttcagagtgcattttcccccacaattttgaatatctaaacattttataaaatggagtctccttgtaagtatttatattcctattaaattaagatttcattttatagttttcttggacatttgcattttacattttgtgaatttgctgtcttttttgaccttcatacatttattgaaacatttatccttattttattgattacagaaactctttatgtaagaataatattgactatgttgtgtatgcctttgcatttttacattttgcatatggcaccaaatctttttcttcatggttgctagcattgtcattagacttacatttttattctatgaaccatgctatctctaaaaatctggttatggattacatgttgaatgtttaaattagaagcatgattaatttctaaaaaatagtgatatgtttatattttgagttttcatggtcttggttctttttgtctgtttttaagggattttttttggtaattggacatattttaaaggtctctcatggactttatatcatttataactactctagaaggcataatttacttcaggatttggttgatatgctgttttaattattctaaaaggctccaaaaatgaatatttgtataatgtttgaaataatctttgactactctgatataaagttaggattatcctgcaggactgagtttatatgaaaaattgaatttattgccttcttaaaatggatgataagaaaagaactttattatcaatgttatttaaatttacttttcataatttttaagaatttaatcatatttgtattcttcataagataaaatcccacaagaaatccaagcttctgcttataaaactttaatcacgcattttattagactcttgttttgcctttcaacttgcagtcctttcttgtacttaactgtctgtgaatgtgaaccttcatgaactaacagacttttcaagtagaatatcattttatagactagaagaaaagacattttgttgccctcctcagtaattttacagagtgaatatacattaaatataatttgaagcttagcattttgtttccttcttataaaataaaaatggaaaattccataatcattaagctttttggagatatctttattagacaagattaatgacaaccttatttacaataaataaaatataaataagttcataggtattttctttatcatagccatttatggtagcatttctgacttacagtaatcatcgataaagtattggtggacaccttttgggtacaaggattgcactaggttctgggaagactacagaaacatctgaaacctggcttcagtgggcttcgtataattacaattcgtaaaatcagttggcctaatactgtctgaataaacttttatttaaaaaaagaaaaaacgaaaatgttatatgtaaacagggactctgggaagatatgaagagttggtagtctccactctcatagaaaacaaagcccgaagaggcaggggtgggaggagtcctaaagaagaaaatgtggaaggaggctcttggaatattgttgtcaactttttaatttaattttagccatgactacttgtattatttattttaaaacctaacttttataaaagaagtcaaaagtggtatttttccattcttatgttcaatacgtccagctttctggctcaaggattttaatctgactataattgtgaacatatccttttctgtatctgcccatccccaacttttacccagctccacacaggaagaaagacagtcctccataaatgttctagagatttgccactgctttgggtctagattgatcccatgtctgaatcagtgcagaaatgcataatttaaaaagtgatttgatcttttacaaagtgccaggctttggacaaaccttgtgtactgtccttacacacacaggtggagatgagtgggaactttactgaggatggtctcttcagtaggagccattaagttgaacatcagtgagaaaataaaaatatctttgaactttccagaaatggttctagaattccctttaaagcagttgtgtagcaacacaaaaaacttgtaattgccctctaggaatgtgttaagtagagttctctctatagagctgagcatgtccaccttacacagatgtgttcaataagcctgaagatgatagactcagaatatttatatatagatatagatatacatacacacgtatatttttgtatatgtgcatacatatacataaacatagtatatacatatatatgcaatacatgcacttactctctatttctaaagtttccctttaaacttattattttctttcaaatgcatatgattatctcaaccattaaatgaggttctgattctgcaaatagataatagactaagctattcagaaaggtctagaaaaatcatcttaaaagtgatttaagaagaggccaaataaagatatatgggtgaagttaaatacccctgttaaacattattgttttgtaagatagctggaaaagttcaccttaatagctcattgctcaaaatgctttggaaattttgaaacatatggctggatatacggtgagctaatgaatatagtttctagtcctagatatgcagctgaaccacagtgtgagtagaaaactagcaaccaactgttgagtgcctcttgtgtactaagcattccgccaagtagtctttgggcataagaagatatgacacagatccaagcctcaaggataggtagggaaaaagacaagaagcaggcaattgctaacaaggccgaagagctgttgagaaagaggaagacaagggaccctgaataaagaatgcaacaaagatgagagaatgggggagggagtggtgaggggagagtatgagaatgggggagggagtgttgaggggagagtatctgacaggaggtagtaaatgtgcaaaggtctggaaataagcgggatggggaacgggaagtgaattatgtgactaaagattgtgggtacaaaggaatctgatgctggatgggagaatccatataggtcttgagtattttgctcatgtggttagatttatcttaagggcagtggaaacatatggaaagatttctgattgtggcttgtgagctatttaattttagccagctatgtaaacctctaatcttcaattccttcattattttcttcatatttgtagagctttaggagctacaagtgcagttttgttacctggatatttcccatcatggtgaagtctgggcttttagtataacatcacctggatagtgtacatcgcacctattaagtaatttcttattcgtttgtaaaacaatgataattactttatcataggatttggtgtccgtttgagtgtgaaaagtagaggagagagattccagaataatcaggcacagctttgggtgttctgggaaataaagtaatataagatcccctcctagccttcatgagaagcctaaagccagttggaaagattaagctagctaaacaaaccaagacatcccaaatgtcacaaatattaaaatattctatgtactttttcatatccaattatcattatctataaaatgtacataacagcaactagtccctacgtagttctcatgaattatggcgcgattgatataacaatatctagtgatcaatataacagtatctagtgatcaatataacaatatctagtgatcaatataacaatatctagtgatacattgaaatttctttggcagtaatctctagaaacatagacatccctctgtgggaaaaagatgatgtccatttgtgatgtgttttatgtatttcacttttttctgtgcttctacaccttgctgttcatgctttcttcacagctagatagggagaaacttaaaaacagaagccatgtcttctacattttgatcactcaaacccttagatttttatctatgttatctgagttttaagcataagaaatgcaattgaatgtgcataaaatataaattatctaacttcctatcgaaatgttttgtaagctttccattgagattcatgattttttcattgaccactgcaatggacagaattatgtcctttcgaaattcatatgttgaaatcctaacccccaatgtgactgtatttggagaaaggcctttctttaaatgagtaactaaaattaaatgatgtcataatgaggggatgcctatccaataggaataatgcccttttaagaagaagagttactggagcactctctccacccttgcacagagagaaaaggccatgtgagaacagagaaggtgttgtctggaagccagggagaggacccttactagaagccaactttgctggtaccttgatcttgaacttcctaatctccagagctataagaaagtacatttgtgtgtctaagccacccagtctgttgtattttgttatggcagtctaagaagactaacacaactacagaaaaggtagatgctgtatgcgttacagaacaatcactaaaaatagaacaactgctaaaaagattctttggtcttttttatcaaaagtgagcaacaatgaagacttatattatcaacattgcttacatattggtagcacaaataatcttagatttctaggagtgtaaaaaattcccatttacaatagcagtggatcaaaaataattgctcatttacataataggtcttgtgtagttcttagatccttataaatttgatgtcctttcatcttatttttgttcgctatcatccctttatttaataattactaagtgtaaggtatgatatatattttaggtcttatatttataaatgacctatatcaatttaatagtaaatatatcattaactgtgatgaaattgtattcttttttaaatcaattctcagatatgctctatgaattcaatttactacaaacaagcatgtatatcttcacacaccatcaattcagatttgtttggaaatggaagaaaacatatacttcaaaattgatatggcttttttccttttattttttgcataggctttaattttattttttacggaacaatatgtgatattagctgctattttttgagcatgtattattggccaaattttacctatccatttgcttgaggttagtggttcatctacctcagacttgggtgttcagtctcttcctacttcagcttgctggtagatcaaccatgttgagttttaggtttaggctctttgccataaatgggaagtagttataataaaatatgttaagataatatttatctttttattgcaatgtgtaattcttattttgaatggagttcttttgaatttacaacatcattgcctctgcctacgtagcagtccttaaattttacatatatctgtaattgcccttattaacaggactcctcagtcatatacatttaatgataatagtcataaaagaagtgccttaggtacgtttgtattgattatcctctacaatgtaattaccaaatgaatcatactgaaatgagttaagagagtttttgtatgtagggttttgatcctaaatgtaggatacaggtgtgtaatataaggcagaattaaatcaagaaaactattaaatcccacctattaggtgcttcttcccattgctatgcagattacttatcttagttattttcctcagctgaaactctggttgtcaaaaggtatgcaaaattaagtgcaaaatatgtttaaaagattctgttgaatatttatatgaattagaagaagagacaatgtaagttcagactgtttgttggtagcaaaatgattcgttatttcagttgggagttagaactggtaatggaaatacaagttggattggtggtaggataggtttatttattacacaaatatttatttgagagtctactgtgtgctgggccctccctttcctttctcccttccactggagaaaataatgtgagcattgctttgcatatattattgagatgatgatgagtctaattttttctttcttggacaaatgaagtagaggcccccgagggaaaagcaaagtctatgtactaatacagaccattaaaaaggcaatctaagaatataattttaattatccctaacaatctaagcaaggtgaattgacaatctgtggctcacaaggaggagaactgctgacagtggtggaaagctgcccaagagggcattttatgctaaagttgccctgaagaaacggaagtagacatcatcccagaaggagtttgactctgtgataagactcaaaccacattagacagaaatgttttaaacaaagtcagcaagagttaggatcagttatggttgccaattttcaaagactagggagcaatatatgccatttcttcatacacttttaaataaatgtttttctgattttttattcaatatatcttggtgcaatcatttcagtaactttatgtagtaaggtatggactcatttttattttaagtatagtgtatttgagcagggaatcaccaaaggagtagaattgctggattaccaaacaatgcttggtaatttgaggaactaccagatggtgttttaaaccagtgacacaatttcacattccacccgtggtatatgagtgtttatatttctctgaggttacagtgagtcattatgtatatatgtgcaggcaggtagaatgcaaagagggagatttttcttatttttaaaacaataaaataatatatgacattcttgactcagaagaagatagcagtgaatgagtttttcttcttcctattaggttggtgcaaaagtaattgtggtttttgcccttaaaagcaatggcaaaaacacaattatttttgtaccaacctactacctcctcattcccttccatgtaaatggaggaacaattcagttcccattttccactgtaagcctttttgtttaatggacaatttatgcttatcagttatctcccctaaaatcaagagcatttgtatgattgtgactttatttggtgagacaaggtctctctgtttcccaggctgaggtgcagtggcgtgatctctgctcactgctatctccgcctcagtctctcaagtatctggggctacaggtgcacaccaccacacctggctaatttaaaaaaaatttttttgtagagttgaggtctcactatattgccgaggctggttttgaacccctggagtcagtaatcctcagccaggacaaagtgctgggattacaggcatgagttaccacacccagccaatgtgacttttgtcttaaattctatccatacctcttccttctgccacttgtgactttttttactcctccaacctactccagtgtacacttgagggtgttattgggtaagcggccatgacatatcattcggactctaaactttgtacagtgagcgagtgacacctaacctgcagagttgttaccaagattagacccggtgaaatagtccatgttcaaggcaactccagctcagtgcctagatacacaaatactttataagtggcatcataatcattgttttttaatacattgttatgacacgcattctccgtgattactcaaactcagaatagcaagtctcattcagatcatgtgtcataagtttgatgcttggctgaggtcagtgactcttcatatctgctaatattttagaaaaactcaaggtggaggaaaaaatctgtgataaagattcataccataggtattgtaattctaaagacagacattagaacttaattaagcaagacagtgagatttatcacagcatatgtgatcatgaaccaaactgtggaagtgggagtagagcaatagtagtgagagaagatgagtgatgtctggtagtggcaataagctgtacatcctagttgtttgggtttgaaccagggtctggaacatgtgaagcattctagaaatatacactattattatttaagaaaaataatttgagctaaaaatactacagactttcttgaggggagctcaagaatcatagtatcattatttataccttgccaaatactaagaaaaatatcaacattgtaagttattaagaaaataacccagaaaataagcattcacaattaagttagctttggataagaaggaatattaatcactcacatatataatacatatgaaaactgtcaaaataagtaaataggatttggtttaatgaatatggcctcagtgttgcaatatattaaacctagtcatcagccttaagccctctttttcttataccttacattaaatccataacagttcaatctccaaaatatatttcaaatctgtccacttgtcttcattctgacttcccccaccttatctcttcccccatccaactgctcttattcataacctggaccagtcctaaaacctcctaacttgtctctcttccattcttgcctttctataacccattttcatccagtatgatcttgtgaagaggttaatcatgggatgcaccttcgtagaaactctcaagggacttccacttttttcttagactaaactacaatctctctatcacatcctacaaaccactgtgggatttggtttgtcttcacctttctaacttcatcacattctaccattattcactaggatctatcaatatagctcctgctttccccttatatgcactaaacaattcccagtctcaggatatttgggaagctccccatatgtctagaattctcttctctcagctcttcttgtggctgactcttcgactggatcatagcccaaatgctacctttttatgggggttgtccttgtccattctgattaagaccatctctcatagttactgttatgcagttatttattttcctttgtataacttatcacagtctgttattatctacttgtttattaactgttgtttttttgtctccccagtgaaatataaaccccactggagtgaagtccttattttatgtactgttttacttactatgtccccaaaaacatataaataaataaactctgaatgatttgttaccatcatcatccacattgatgttttcataacagacatttattgggcacccattatgtgccaggcactttgcacaatgccttgatttctcttttcatagtctcaatatattatggagatactatttttaatatttatttttctctccactttaaagatgaagaaattgaggctcctcattatcatcattttcatcatcatcatcatcatgccagaaagtagaacttgaattgacattgttttcctttctcataccatggtcagaggaaagaatagggggcccttgggtgcagaaaagaataccaggataacccaaatgagctggtcaaacaagtagattatcagggattcttctgtcaaacaaaaaatagaacattgtgcaatttggtgtaatctttgtataatgtgtatttctcaatgtgtggtcttcagaccagcagcattgacatcatccatgagcctcttagaaatgaaaattcactggcctcacctcagcctgctgaaacagaacctgtagggttgggtcccaggaaactgtgccttagtaagtcttccaagtgattcttaaacactgctttgagaaaaggaagaccatctggtggtaagtaaaggaaatggaatgttaacaagagtaaggcaagacatttatattcagaaaccaaaccaacgaacaaaagtaggtttagtaggccttgtataaaatgatggatctcttattaaaattggagtataagggaggggcatcatgataaggaagaacagtcgaggcagagaccagagtaagaagtcagagtaggggtagatagccttcaggcagactagatcttcttgtctcgaccactttcactcaaattcttaaaatatcccttgtgtacataagattagtgacagaacatgaaattggactaagcccaaagtagaacaaaagtagctccaccatgattctatttacgctgattggtagaatgtgctcccctggaggatgggccattatgactgcactgagacagatctttaagtttgcagatgactctgaagctgttctagctggggagacaagaatatttggtaaagctgtgtgaatggggaaaataatagcagataaatttcagctgtggaaagtgtaatttaatatatctagggaaatataatacaaactatgctgatatgatgatgtactctttctgctatcacttatttctagaagaaaagatatcttaattgatgtcagctatcccttgaagacagtccaatggagtgtggcagttcaaaaggtcaatcaaatgccagagatcaccaggataaaactggaggaaagcagaattacaagatgttgtttatgtttgaacagagtagtattttagtacttggagtagagttcaaagttctactgagtacattctggtaaggtcataaggcagttggaaaggcctcaaaggttaactgaaatgatcaaaggaatgaaatattatagtaagaccagatgagaaattttcagcacagaaaaatgatgggtgaaaagggacacaatcaaattcctgaccatgaaggatattagtaactgaaacatggacttgttcaacaaattcaagaatactgtaggagaactctcctgaagcttgaaggtacttttaggacaaagaaaaaaagtttaagtctttttaatatagcctatagtaaatttactgatgctgttcccttctagagggttcatgaactggaaagataatcaggaacaaaaaaatatatatttatggaagatgagattccaaatggtttataaaagggaagctgtagattattatggatattttagtgtttaataaaggtagtactcagggcaatatgaaaaattatgcatctttataaaaaatgaagtccaggaattgatgactaataccgtattatagtttttaaatattctttaacatacatatatacatgtttgtgtgtgtgtgtgtgtatatatatatatacacacttgtatgcatatatgtaaaaatgcgctcatatacacacactatatatgcatatacatgtatacatttatatttgctttccttttaaaaggaaatattttgtcattaaagaaacatgtaagcattataggtaaatttgaaaatacagaaaagtagacaaaaattacatgtagcttcattcaccaaagagactactattaatatttcactgtactacttacatgtagtttatatatttcatattttctgatgtttatttttttattttatttttttcttttgagatggagtcttgctctgtcacccaggctggagtgcagtggtgtcatcttggctcactgcaatctctgcctgccaggttcaagcaattctcctgcctcagcctcccaagtagcttggattacaggcacctgccaccatgcccggctaatttttgtatttttagtagagacaaggtttcaccatgttagccagggtggtctagaacttcttacctcaggtggtgtgcccaccttggcttcccaaagtgctgggattacaagtgtgagccactgcgcctggcccattttctgatttttaaaagtaattactgcctgcaggattttgccactaattatgtagactgttggtttgagataggtattttttaatcaaaataatatgaaaatactaatataatgtaaaattcagtttatccatgtttagggtttttatatattaaaattaatttagtctatacatcttttgttttctgtcttaatctggtttaatattcaagtttgttcaactcatgaagtaaccacttttctaatacattatttctttaaatatcccattttatttccaatgccttttgttttatattttaatactatttagtatggaaagactgttttaggtgtgtcttttaatagcatgtgggtgcctcctatgtttgttcatatctaactattttcatgctgctgataaagacataatcggggctggaaagaaaaagaggtttaattggacttacagttccacatggctgggaaggctcagaatcatggtggggcaaaaggcacttcttacatggcagtggcaaaagagaaagagagatgcaaaagcacaaacccctgataaaaccatcagatcttgtaagacttattcactaccgtgaaaacagcatgggggaacctcctccatgattcaaattatctcccgccaggtccctcccacaacatgtaggaattatggaagtacaattcaacatgagatttgggtggggacacagagccaaaccatatcacttaccaatttgaaatattttgccttttccaaggagggtttggcttgttcatatttgttgtcacatacaaaataattatcatgagatatttgaagcaaacagggtctggctttgaatattgatactgtttattagctatattacaaagttgtatgaagattttaatttaatggtagatataaaatacttaataaaatgcctgccacagagtatgcattcaaattattgtgattatttcctctttgttatttatacctcttttgttttaataccattttgatgtttgtttgtatcttttactatatagtttttgttttaattttagtgcaactcagaagatagaagcactattataaattttacaagcaattaactttagactgatagaaataggtatttaaatgtatgaaaggctgatagagaatttagaatgccattatttctgctgcctctttctcctttggatttcattaataatagtactttcatgccaggtacattttctttatgtagaattgtttttgaaattttcctttgatttttcatcctatctgctgtaattactgtgcatatttaatcatgtccatataagcatgttaattgttcagtgacagaagtagaaggtgacatggcaagagaatgactgatgtttagtgaactatttgaagagtacatctgagagttcaagggtacaaacagtaaaaatgttttgtaatctctatatcgctgtgtttttttaattgatgcatgaaagcactttctgcatcatttacacaaggaccatatgtatttacagttaaaatttaaatattttaagacaagaatgaatgtttcacatttatttttattttctggcattcataaaaactgtagaggatattctgagtttatgttgtaaattgtaattttccaaaggactggcaatttatggtttttttttttgtttgttttgttttgtttgagatggagtctcactctgtcacccagactgaagtgcagtggtgtgatcttggctcactgtagcttccgcctcctgggttcaagtgattctcctgcctcagcctcctgagcagctggggccgcaggtgcctgccacgacaaccggctaacgactttttttctgtatttttattagaggcagagttttgccatgttggccaaattggtctcgaactcctaacctcaagtgatctgccttcctcagcctctcaaagtgctaggattacaggcatcagccaccacctctggcttgacaactagtggttaatgaaaatatcaaagtttgacaactaacttgggttttaaatagtaaaataaaaaatcattctaataacatttctcagtctcactttacacaaggaataagaaaagtgatggaagaagagacgcttccctggtaatgtgatgcttaaaatccatgtttgcctattacgatgagaacaatattttggcaatctgagaagataacttaggatgttagatctgagggattgtctatactttgtaggaaatgatacttcgaattccagagttcagctaaggctgaaagttaaaggcaggatcactcaggacctggaactgcagcaccgtttctgcatccaaaactagctgtgcaattgctgcaaataaaatctgagcctaaaggcacaatatttgtccgaagaagccagagaagtcccagtttttctttaagagttttacaagcaaaagcatatagaaagccctgataagtgacaggagaaggagtgggaggtaaaaaatgtattaaaaagcaaaagaagtctatagcactggagctttaagagtagtctccagaccagaaacaggatcacatgggaaataggttagaaatgcaaaattttggatatcttcccccttctaccccagagctactgaaaataaactatacaggaagagaatcagcaatctgtttcatctgggtgattctgatacaggagaaccactggactgtagacttgatcaagggtcatttagtgtgtggatcaacaacttcatctcccactgaaggctctgttttattacatcataagttggtatttatgataagaaaagagtatccaaagttttagttgtctatttattttagtctgtttatgaaggcagataaatcatatatctcaaatagcttctcatcatctttcttgggggcatttgaagtggtaaccttgagctgtgaaatccacttgtgttctaaaatactcaatttctgcacaatatgggataaatatcatgttaccatattgtgacatgccatttataaatgaagaccagtcacacattcctgctagatttgacaattattctccaaagtaacctctaaaaataatttgacaattatgcccccaacctctgttgctggtgctattgtttcctttaaaaatatgaacttaggttttaacaagaaaaaatacctttctaagatttatatgaacaatgcttaagatagatgatctttatagaaaggtaaatgtgttatgtttcttctaaacacatttttctacactacacaaatttaatagtgaaaatatatgaacacagtctgctttctgaaagaatattataaattattcctagacttaaatttgcatagtcgttagaggaaataaatatgctatctggcatattagagaggatatctaaaattacagataactagaagttcatttctagggcattagacattttcattatttctattattgctttattattgttgctcttaagacatgaaatgaatttttagaaatgcccctaaatgcctttaatcaaattacaaaaaagagcaccaattcttctgagttgatgctggcactgccagtgtgcactggcttagagagctgagctgaaggctggatgtcagctccacttgtccctgggcagagacctctgtgcagtgcacaagctgacacagcctcccccaagctgtccactgcttgtcaaccatgggtcacaaactgacaacctaacgtccaaatgtagcctacaggctttgtttgttttggcctagtaagtagaaatagcttcaattcgtggccagtagttttgaattagaaaattttgcagaatcatctgaattcctctggaaaactagaagacatggcaacctggaacttccattcctgactagtaacaattggccggggctaaggggcaacttccctgctagaggaacatgtgctcttcaggtcacagttcccctgccttcctttgtattcatctggcctctgtgaacatctaggtttacaatttggtatgactcaatatagtcatcacctcttccatttttctctccaggtaggtttaacaacttttaaactctgtgtccactgaatcaagtacagatttacatagcagcatctgtaacaactaattgtacctctttgtttacagccttttccctacaagacagtaaacttctgatgaccagagatcagcctattaatccatctctgtaattccagtgcttattagattgagttgcatgataaacatttgttgataagtgaaatgaactgttttttagaaaaatgtatggtggaggtagagaagcatacttcctatttcccttctgtactacgtaggtattgccgcaataatactgtctaacacactacctaaaacttagcaacttaaaatgacattttttttttctcaagatgatgggtctttgggttggtggcagttcatctgggctatgggatttagatcgtagattgggttcaagtctgccctgtgtgcttcttctgggtcataggcagaagggactacagctacctgaggcattttctttccatggtgatagcagaaattcaagggagaaagctccacaatgcaaacacatttcagctcttcttacattccatctgcaaacatccaccttggccaagcccaaagtccaggggtggaaagtaacttccacccaccttgaaaacttggcaagaatgttaatgcagacatatgaagaattgtgatcaataatttaatccagggccaaaattagggtaaggcaggtgaggtgcaaaatttaagaggtgccaaaaatctcgtaataaagatacatattttaatacttaatttttgaaaagcaaaatcaacgcaaacatccataataaacaaaatatacaaatattaaacacagaatctgaccacccatctgcatggctcacctactcacctcacctgcttcattgccctgttgggtcttatctcaatatcgatcccatctaaaacactcctctgagtggcagttaacaaactgctcttgcttgtatcttgagtctctgcattggtgtgaatatttgtatcaaaacattaagaattcaagtttctgggagttttattaatatataattaagctatccctagaaaaacagggtttagggcaagtagtttttaacacaaaacatctttaatttgtaaaaactaaattatgtaaaaataacattccactagaagccttttagaaaagtttgcattttttcttatacaatgcaaactgtctatatatttgtactagtcaactccttatattgtccaaatcctgaatttcatcatctaagcaagaccagtttggcatcagatttaagcaagatatccatgactacgaaattccctatagttggacttgaggggtagtaggagagctgatatagcaagaactttccagtccacttgaggatgtttctataaactttttcaatgtaactgacctcattacactctgcgaaggtgtaactacacgtatcccactgcctcttgggtcagtcaggcaaatgaaaagcaatcatatcactctttaaatgttttagcattttccagcttggactttgggaagtgggatccagtctgctcatgggatatgtgttgactacctcttatggaaggggccgttccatgccatgcatgctgccagacagttgtgctactcctggctgcctgggttccttgaagtccattcccagtgcaggacaacctcacggcaacattgacattgcacgttcaagaatcttaaatgattcttactgaatttcaaaccttgaggagaggacactgtggtggtatcagtaaggatagctgggacatatttaagaaggactgagatgaagtaagacctgaaagacaagcgtccacaatttctacctctaaaaggtagaaaggcatctaaccatttaaaaaatacattatcatgaacaaaacacagaaagatgtatatctctgttggcgttctagctaaataaaataatagcagtatgaaaaatttttaaagggagatagtaactggaaaaatctaaaagaatgttgttactgattcaggatatatattttcagtgtgctgttccatgtgatatcatgggtattttatttttgtgtacaatagcttcatagggactctgcagaagttattcctgagtcctatcttttaccaatatcattatgtttaatgaaatcataagtttcttatccataattctatcacagtgttgatgtgtgtgtgtgtgtgtgtgtgtcttatttcccaaaattggaaaatataatgagacaagagcttctatcattatgaatgatattgaacaatgatattgaataatgatcaatatctttcaaagctatcatttattgaacattagctatataccggatactgtgcaatatatttcatgtgaatttatgcttctcttcattacaacccagtatacatctgtctccctattttacaaattagaagacttagattgagaaagggttaaatggcatgcctacatcactgatagatgtccaagttaggattcatgttcaccttctttcttctcctccaaaactgaatccctatggggcacccctgctttgccattcagccttgagactatgtttcagctgctgtgtagtttcccttctcatcacactaataaacactacattcatgaagggttgttttacagcagactttattcttaacatttacatatatcatttcctttaatcctcatatgtcatatgttgttgttgttcaccattctacctgtaagaaaactaagtctctgagagcttaagtgtgttgcttggtcacacagctagggaatggccaaatcaaggttcaaacccagatcagtgcaactctagatgtcatgcttgtaacccttatgcaaagctgtctccagtcatgccatgcttcctctgtgatacagcaggaaactcactgaattaatagtcacagatatcaggtttttatcccagatgtggctattgccaagtcctgtttctttatctgttaaactgtgattaatagtccctgccctgcacaagtcatatcattgctgtgagacttcaaccagaaacaaggacagggaagcttgaactgcaagctcttgttaaagtactgtcagcaacttgagaggctgagactgctgtaacaatttgctttgtatctcacataagcctagaagagttcttgactctgaagcttatcaggacccagccggaaagcaaatacacataaactgctggtaaaagaaaagtgaagggcatttcttggaaatgggaaaaggctcttcctccttcccctcctgcccctacttaggggcagaaccatcccaaaatgtaatcaagaagaacagtttgaatactcaaggttttatccttcctcattaatatgttttccattatttgtacttccattatttgttcagttctattttcccctaatttgttgcttcttggagtcagcagtgagtaggaaatgccaatggctgatgattcctcaaatagccctgaagatttaatcctaagttctgatgacccaagtatgtgtggtaaagagatgactgctttcctcttgccttcaaagtggttttcagcagtgctggtctcagctctcttgaacctgcaggacagacagtggcaacactcttgtcaaggagccagagtctcagattataacatcttggtgataatatattttgcctgttgccaaagcatttcatttaaaggtttgggcacatgtaaatatatttctggctttccttttctaagttccctcctctaacctctttagtctcaatttgagtttatttccatcatagaaaaaagaatgtagaaggctaaagccccattagtaatacagtagtcagggacatctcacctatttgacaattatttattgaggacctatgtacacaggcactctgctaggtaccaggggcatggttggcactggagacatggttggctgttttctgccatttagaagcttaaactttccatttctatattgtttgaaggctgtgattatcttcctgataatctacgtgctctttttatacttctctccatcaaatttttgtatctgtctcctgattcatcaagttatcccccagaataggggcttttagggaaattccacagaaacctgaatttcctactctctcttaattgaaaacaaactctaatttctggacttactctctctgtgtctatacaaacctgtccatggccattttcccatcctgggtgtgtcatgcagccaggctgactcatctttccttgtaataaatcaactctttaaaaaccatcaccacattataacacatctgagcatcagcactctgacaatagaatataatttgatagcagaaggctctaaacaaattcctttggacaagagagatatagattatataactcacacccaaagatatttaagtcaaatcaatgtggccaggccatttaactcaccaagagagaagggttacagtcggttacttaaaagcctccctatcttttaccttatggatatgggcatatcaagactgaatataggctgggcgtggtggctcacgcctgtaattccagcactttgggaggccgaggggggtggatcacgaggtcaggagatcgagaccatcctggctaacacggtgaaaccccgtctctactaaaaatagaaaaaaattagctgggcgtggtggcgggcgcctgtagtcccagctactcgggaggctgtggcaagagaatggcgtgaacccgggaggcggagcttgcagtgagccgagatcagatcgcgccactgcactctagcctgggcgacagagtgagactccgtctcaaaaaaaaaaaaaaaaaaaaaaaaaaaaaaaaaaaaaaaaaagtctgaatatatctctttagctatgaccaccttgaaatggataatcagcattttctcctaaaattccagatttttattccaaagcatctcctggcttgttgctcggtcctgcattgccagcaagctagaagccactgttcggtaatgtttcagttgagaatgcacggaccttgagggttagtttgccctcaatcacagtgggcaggagtggcactgacatgagaatctctattttcagagttctagtccagaatttctgttacactaacctgcctccatagggcatatgtactttacaaatctttttttttaactttaaaatctggaatgcatgtgcagaatgtgcaggtttgttacacaggtatacatgtgccacggtggtttgctgcacctatcaacccatcatctaggttttaagccctgcatgcattagatatttgtcctaatgctctccttccccttgcctcccaccccccgacaggtcccggtgtgtgatattctcctccctgtgtccctgtgttctcattgctcaactctcacttatgagtgagaacatgcggtgtttggttttctgttcctgtgttagtttgctgagaatgatggcttccagcttcatccatgtccctgcaaagggcatgaactcattcttttttatggctgcatacaagtcttttcaaaataaatttatatttggaaagcagtatgtagactcctatgggaaaagtatcatttcaacttgatgatagctaagtattctgaacatgttaattaatgttttattctccagatatgtagttagatctccaatagcattagggtcaacattgtgtcattttgcataaattgcaaacacattacaatttgtgttattattactaatagttggataggcacccatgcttatttccatgataaggagaatataggcaagtgtagaaatttgcagtgaattgttcaaggatgcccaactagtatgtatgatatggggcagtattttcaatgaagatgtgcacatttgctgggtctatagatgtagataaaattattgtgaggaagtttatatgattttgtattagggctaatctagctttgaaaaagatcaatctatatattatgatcacttcttctctaacctgacacactgttcataaaatgtgatctttcatattccaaatgaaatgcatttttttccctttctctatgccttaaattgtccgtgtccttattttccttattttaatgttttctttttctgaatattttctcaagtattttcaacttgaaaaggagtatatgaacactaaaaataacttcaaacagttcagcagtatctaaaatgaaatgtaaacatcccctctattaatgtcttcctctcatatgcacatcacatctttaagtgtttctcagatatttaacaatctacacttggaatctgcttgatcaagaaaaaatgtgtggagggagaagaccccaactattttcttatctacttatattccaggactgttgtgatgattacataaaatagggtatataaaagtgatgaggaagttagaaaggccataccaatttaagttactgcattcattgtatgaaaagctttctactcagctcaagtacccccttttgtctgtatagctttggcttttgtagtgcttagtgtcatttccataaacagagctaatttacttctttatatgttgacaatcatttaaatgatttctcacttatttaaatcctataataggctgggcatggttgttcgtgcctataatcccagtgctttgggagatcgaagtgggaagattgcttgaggccaggagttcaagactatcctcggcaacatagtgagatcctgtcttacaaatatttaaaaattagctgagcacagtcacacatgcctgtagtcccagctactcaagaggctgaggtgggagaattgattgatcccaggaagtcaaggctgcagttagctatgattgcactactgcactccagcctgggcaccacagtaagactctcctgtctcaaaaaaaaaaaaaaaaaaaaaaaaaaaactcataacattgcctttaatacctctctaatattccttacatcattctacggtatttttatctgttgtgaagtcaaatatgtctctggctcaatccccaagcagtaaccaacatcccttttcaaagaagatatgcttatcaaatatttacgttttaaatgaattaataaacaggtgagttacagaaatatttcaaagtcattgtgaactttcattctcagtgcttagataacaagtcttaccaagacatacagaagtgtccatacatcctcaccccttctctatggttgccccaccgctgttagagcagtcccaaacatgagacaacaatgcacagcctcgactgatgtcttctccagggctttccgcctctgtgacccagtccaaattctcccacaggatatattgggtgattcctgctgagttcaacctgtatctgcctgatccatttgctagtggagtcctttggaccttccagaacagtggcctgtccctacccactgagtcattctaatgtagcactaaggcaagaacatgcagcttatctatttgtatcagtgactttcaaagctgcctgaacaaatggttctggctggatttatttcaaagcattgactacggcaggcagaaagcttcctgccaggcggttatatttaccacacaaatttgtcagcttaaccaaacatttcagtgtgttaggagcaggaatttgaattgattgatctaaagggctcaaacactatgaaagagatgaaggtgcatcagctgacattacagtgtctgcacgagtccaaaatgatcactaaataaatgttacttttcagaaagattgtgctgttatcttatctccctcccatactgggtttgcaaaagcaatcggagtttcatgagtgttggaatgtttaggctaaaacaccatggtgatgttagcaacaattttgaggtgccctgatatgtttaaattatatagcaaaaatactattataaactctgagcaaaattgtgggacacagggatctttgaattcttactacagctttcacatcacctccatttatatgtacctgtgttcaacttccctttcattaaaataggaattattcattttcatcgtattgctggcatactctcttcataatccaaccttaggcttgcaataaaaatcttcacaacccaaataccatgagaatacttgtggttaagcctagaaaatattaactgatcactcaagaatatatataacaattttcagtatactagaaaaatatcactagtttttttttcagtattttttggagatgaaataatcatactgtttgtaattgtcttaactattaccagctttatgtaatttgtcattttactatattctacatatgtactctaatttagtctgacttattttattctgccaatagtcatttggggaaaaattacagtagtaagacagaattttctgaacatttaagatcacattcaagcaagaaacaacatattttgcaaatgggtcttaggaataccctcagagaagcgtagggaaatatttgagaaaggtcttatggttctgcaaggatcttggaatctacaaggcagattaatagcccaattatttccacaaagctattgccaaatttcttacaactgattatttaagaagcaatttttaaaagccacattatttatattaattgaataacaatataaatggagcaaatggagttgattcgttcctcagtctcttgtaagtctattgtggtaaattcattatagagaggagttgtataaatattctaatttcaatttctctaagtcataactgaataccagcttaagttatgtctgtatgctttaaatattttttaaggtggtaaactttacgaacaggtttaggttcacagcacagttgagcagaaagtacggagttctcataacattccctattttcatacatgcacatccttcctcactatgaccatcccacgcctcaatgatgcattcgtgataatcaataaacctatattgagacatgattatcacccaaggtccataatttacactaggtttcacccttggtgttgtacatttgtgttatatgggttttggcaaagatataatgacaagtatccattatagcatcatgcatgatagtttcattgtctaaagaatcctttgtgctctccctattcatcccttcctgcatgctgtgccctggcaaccactcatctttttactgtctccgtaattttacctttttcagagtaccatgtagttcacatcatacagtatgtagccttttaaaattggcttctttcacttagtaatatgcatttaagttgctgtatgagtttagtagaccttttttttttggcaccaaataatattccactgtcaagatttaccagttgatttattcatttacctatcgaggggcatcttggttgtttccaaattttggcaattgtgaatagagtttctataaacaactatgtgtagatttttgtgggcatacattgtcagttaagttgggtaaatatcaaagagcataattgctggatcatatgtgaagagtatgtttggttttgtaaaaatctgccaaactgtccttcaaagtggttgcaccattttgcattcccaccaataatgaataagagttcctcttgctccacaacctggccagcatttgatattgtcagtgtttgggattttggctattccaataggtttgtaatggtaccacattttttgtttttatttttaattctcaaataacataacatatgatactgaatgcatgttattaatgtatacttgcttgccatctgtatatttatcttctgtgatgaggtgactgtttatgtctgttgcccattttaaaaatcaggttgcttgttattgttgagtttttaaaagctttttgcatatttgggctatcattttttttttttaaatcagttgcatgtcttacaaaggttttctcccagtcagtgacttgtcttattctctaatcttgtctttcacagaacagaggtttttaattttaacgaagtccaacttatcaatgatctctttcatggattttgcctttagtgttgtatctaaaaaatcaaaaaaacctaagtcatttaggttttctcctgtgttatcttccaggagttttatagtttagcattttaaatttagatctatgatctattttgagttaattcttgggaagagtataaggtctgtgtctagatttttttttacatgtagatatccagttgtttcagtatcgtttgttgaaaagactgtctttgctccattttattgcctttgctaatttgtcaatgatcaattgactacatttattaactatatttgaaaatagctttctatttctgagctctctgtcctgttccattgatctatttatttattcttttaccaataccatactgtcttgattactataaccttatttagttatagatttatagtagtaaatcttgaaattgaacagtgtcagtcctccagctttgttcttacccttaaatattaggtttgctattctgggtcttttgcctttccatataaactttagactaagtttgttgatagccacaaagtaacttactgaaattttgattcagattcacatggactctatagatcaagttggggagaaattacgtcttcacacaatcagtcatatcaatgaccatggaatatttctcaatttatttagtttttctttaatatctttcatcagattttaactacattttcatgcttaatggattaaaatttgtaaacatgttttaattaagaggaaatatttttctctataaagctcaaatttgattttaaaatgaccaaagttagaatggacttcaatgaaacaggcaggtacactttttccagttgagttcaatttgtcaatagcaaggccgaaaacacgcatattgctttgaatctcttgcaacttcagtgccctaggattgatgtaaatacttaattatttctgagtacagcagacaattctctcaacactaggatagactatttcctgaaacttcgatagaaagaacaatcaaatggtgaagatatgtgaaaggatatgttgttcaaattaaaaggtttgctagttcagtaaaattgaaaaaatgtaatatttatgatcatttatgatctttatggaaccttaatgacctatcatttggagttttctagccattagtttatatattcattcattagaagtgtatggaaaactcataaaatacaaccaatatagtagattataactttgctggaaaaatagacatttataaataattataatataagggaactgaaagtagagcaatcgatatttcaaaaataagtgataatttgagctagttcttaaaatattagtagaatttttttcagcagaacaaaggaactaaagagatgcaagagaagagtgtttttaacaagtatttgtagaacatctgctaaataccatccacataattaatattaataggaccattatctcctgcattttatagacatattttcttttgatcacatatctcacaaatattgtaaatgtgattttaagagaagactataaagtatgtgtgaacagaggaaggctctctcactccactgtgggttttcaggaaggaccatgagaaattagtgtccagggcaagatctgtgggaatagcaagaacaaaggccaggaggtatagagagtaccttgtgctccatgtgcgaagaactcaataggatgtgagagtggtaaatgatagaaaatgaggtttaagaggcaagcaagaacacacccacagagccttgcaaactaccttaagaacaccaagatgtcatggatagttattatcaaggaagtaatatgttcagatgagcattttacatgactgtgcctgctttagcacagattgggagaagaggcaatgttagaagctggaacaccaataaggctattgcattgattcaagatactataatctcctgaattagaacagtggtatggaaaatgaagtgcagcaggaaagcacacaaaaaaaatggagtggcacatgctctggagtgaggaagctttgtttatttctttgtcaaatcagcttgttcttttttcatattgttctttctttttaaattatagtttctatttcttctatccttttattattttgtatgatttattttatagcatcttttagtttttttataatctgcatttttttgtggtaacaatctatcaaaaatagataatctatcaaaaaatagatttagaaatctatccaaaaatgtattcaatacttgtaacctgtaattattaataatattgatctgtgaatggtgtaagttggaaatttgtacttggatatgagagagaagcctaaagtggggaaattatcctcataaagcagaataaaaaatagcttttaataattccatattttcaaaagataattttcaagggtggttaagacacaggttggtattaggatacaagagacaggaaaagaagtgaggaaatatttcaaaactctaggaatcagcagttgatgacctaaactggggcacggacaatgaaaatggagacacggaaacacatcagagacagaaagatcaggacttggtggccataggcatttaggataaagaaggatgtaaatttaaagataactcacctgagtgacagatgaggaggtgatatactcagctggagaatattgaaggaggagagacatgttgtcgggaggggtcaggaatgagttcatttgtggatactctgcttgaagtggctcaaggaagctctgaaagtggttgaagctagaagtaaggatttagagcaagcttgtccaacccacagcccgcgggccatatgcagcccaggatggctttgaatgtggcccagcacaaatttataaacgttcttaaaacactgaaattttttgtaattttgttttttagctcatcagctatcattagtgttagtgtattttttgtgtggccgaagacagttcttctaatgtggcccagggaagccaaaggactggacacctctgatttagaggtcatcaatttggtttagtttttgtgaataaataacatttcaggggggtgagggaagaaactataattgtaaataggtcaagaattgaatcgtgtgaatgaaagagagtaaaaacagagttttaaatgagttcagttggctggatttgcactgataaaacatgaggaagtaactaggtagaaactggtttgcttttcagagcattcatgtttaagccagtcccagaaaattgttcatgttaactcaaatttataagtgatggaagactacttaaaaccaactgattcactagctgtgtggtcttggatgagttattgaaccctctaaacgcaggcatatacacttctgattcaggagctacatttgtatgtttgttacatggatatattgtgtgatgctgaggtttgggcttcgatggaacccgtcacccagatagtgtgacgggtttgctcccctcccttcctccccactttttgagttcccagtgtctgtcattcccaaacttaagtttatttaaattttaagtattgaaaataaaattttgtctataattttatcaagcactagatgcagttttttaaatcatcacacatgggaggcacacaataaataatatttattcataatggttccaatgataaaatgactgccaagcagaccaagatatatctgctgtttttgctatgcatctggtttacaaaataagtcaatatactattcaaagaatttcatgggatactagtatgttttcagagtctgctggtgagcactgagtgacagaaaggttagctgggggaattaggcagtgattctgtatcataattgtagctctgaaccttcttcgaaactttgattttttatgtgtatacattcctgagccctactgacttcatgctagacactgaaattaccagaaaacaacagcaaaatgaaaaggtatagtttctactaacatggactttaagtaggcttggagatacacgcacccacgcatgcatgcacacacgcacacacacaatatagctactcaaaattttcctggagctcgaaatttccctgggtttcaaaactatagattttaaaaaatttctaggttttgtgtatattacaaaccttgtagtgttagagaatgacagattaaggagggaaaacttttatcaagtaaatatccctgaaggattttcctgtaattaaaattttttaacatttgtgataaattacataaatcactacactttacattgccagcagaaatcaggttagacttttacatctttcaacttctgggtctgtcactcatttcttttaatgtctacatttttaatgttgctttaggcctgctgtctctactttactaattgacatactttctttttctttttattctacccatttgggaaactcatttatttttcttcaatcatctttaaaaaattgaccatggttcatcacagtttattacccagtgactccaaaatcaagatgacatatttgatataaatgtgatcatgttcagccaccattgcacaacattgatagaggatcaaagcgtacccaacattatgatatttccttgtactctttactgacttcattagcaaactgagctttgtaatttggcttcctctccctctttaatccctccaacacggttactctcataaaacaagtcaaattcactttctgtgaactccaagggattgttcaaaatcaagaccttattgatggattgatgtttgaagtaagtaaataacaggattaaaaatatttttgccatatagtgatattattttatatttatatttttgtagtaagactaaagtaggtcacacgctgaattttgatggctctttagagagccgtacaatttcattgcttcctataatcaggaccaatagtacccataaacacatgcttatgttaattgagggaacttaacgatttttaaaaactctatgatacagcatttactaaatatttgaaattctatgttgtatgctaagaagttatttctaaagaaaggcccggtgtgggggcctgttgtgcggtggggagagggaggagggatagcattaggagatatacctaatgttaaatgaagagttaatgggtgcagcacaccaacatgacacatgtatacatatgtaacaaacctgcacgttgtgcacatgtaccctaaaacttaaagtataataaaaatataaaataaaaataaaatgcataggacattgtgcactaagacacaatgatagcactgattctgagatctggcaaaactttgtcatgacctattactggatgaaacagcaacgatgatctatctttatatgaaaagttcagtgctacctttctgtaccacaataatggatattggggtccttgtctgacagtttatttcagaactgagccaggaagagggtatacacttccctgatcactgctgaaggaaagcaaaggctcatgctgaaagccaccatctgcatgataccaaacaccacaaagttggctatgcctccctgcacaaatacattgatgcatttgtatggcttaagtcatcgagttagtttcaaaaatgtttgtaaaatttgtttgacttttgacttcaaactatactacaaggctacagtaaccaaaacagcatggtactggtaccagaacacagatatagatcaatggaacagaacagagccctcagaaataatgccgcatatctacaaccatctgatctttgacaaacctgagaaaaacaagcaatggggaaaggattccctatttaataaatggtgctgggaaaactggctagccatatgtagaaagctgaaactggatcccttccttacagcttatacaaacattaattcaagatggattaaagacttaaatgttagacctaaaaccataaaaaccctagaagaaaccctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcacaacctacttatctgacaaagggctagtatccagaatctacaatgaactcaaacaaatttacaagaaaaaaacaaccccatcaaaaagtgggcaaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccaatgtggaattcagtgtggcgattcctcagggatctagaactagaaataccatttgacccagccatcccattactgggtatatacccaaaggactataaatcatgctgctataaagacacatgcacatgtatgtttattgcggcactattcacagtagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattttcagcaaactatcgcaaggacaaaaaaccaaacactgcatgttctcactcataggtaggaattgaacaatgagaacacatggacacaggaaggggaacatcacactctagggactgttgtggggtggggggaggggggaaggatagcatttggagatatacctaatgctaaatgacgagttgatgggtgcagcacaccaacatggcacatgtatacatatgtaacctgcacatcgtgcacttgtaccctaaaacttaaattataattataataaaattaaaaaaataaaaaaaagtgaattaagactccagtaaaaatttggagccaatttgagtagacagctctcaattccatttttaaaatatcaagggatatagatttttttaaaaatttttatctaaagatctttaagtatttttatttctttatatcttattttccataataagcatgcctacatgatttatgtggaaaaaaaaaggcccggtgtgaaaaatgttttctaggagaatgatattaaattgatatataaatatatattatgtataccttaccaagtgagcacatatttccttaatgataaatgatacttctaaagcagaaagcaagactgtgaagcaaagacctgcaaatggatgcaatttagtgaacaaaagagggatgcgactgcctgaacatgcacaggagtctgaagtggtcaggtctggggcacactgagcatgtgtcctgggaaatagtgaagcaggatgaaggtggagggcatttttgagtgggaaggtgttgtggaggccaggttaaagggaaagtatggaaatgcacagggaaaaataccttgaattcttaaccgtttggcccagggtgaacacttggtgcaaagagaattctaacacttccaggaatgttttaaacaatgctgtttttgctttggagcagttacttatattatctggcataccttgttcaatattgaaagctatttctgattatctctagttttttttttttttatccaaactctcagagcatcatcaagtgtattatagtcttagcctttgtaagaattggtaagttcacaaaacattttatttagtgcttaccttgcacaaggcttgagagattttaaaaaggtgcataaggaaaattcctaacctcaaaacatgcatattacaatcactagactttaatggatagagacagccttgtaaataaataattctcttgatatgatatgataagtacagttagagacaggcatattcagaggctacagagcatagagagaataaatagctagtttcatcaatagtaaatttcactctgctctttttaaggaacttacctaaggagacttggaaagaagacaaaaactgtcttttaatctgttatgattgtaatttaattcagaaaaatgctcattccaaaaagggaaattctgaaatagtttaccaacattatagttcagaaaaagacatttaatgatgttgaatctaaagactaacttttcaaattgtccattatttgttaataaaaaacatgaaatgatataaattccaaaggaaaagataaggcatttttattaattcatccatgagggagcctgagagaaactttgtgattgtggcttttttaatctcaattttttttaaagaatcatggattagggctatagttgggtttattgccatgtacgtcaatcgatcgtaattgatttagtagtgtttgagggactgtgggtactattttctagtttaaaaagtctctataactttctgtcacaggatctgaaatcaccagagatttcttaaatgtttaggtcattccagaagtccctacttaaaatttgcttagaatgtctactagtttcctattactgctgttttaaaaaaattaccacaaatgtagtggctgaaaacaatgtaaatatattatttcacaatcctggaggccagaagttggaaatcagtttcaatttgcagaaatcagcgcgttggcaaggctgcagtcttctaggtgctctaggggaaaatccattttttgcttttttcagtttccagaggctgcctaaattccttgattaatggcctattatgccatcttccaagccaacagcctagcatcatctttcctctctgatccctgcttctgtttctacttcttcactctctgatcttacccttttgcatctctcttttgaggatccttgtgtttacattgaggccacccagataatccaggatattctactcatctcaagatccttaacttcacagctacaaagttcctttcaccaggtaaggtaatatatgtgcagattccagggattaagatgaggatatcttttgagggtcattattcaggctatcataaaggtaatactttaaatgttgctgtgatccataaatattatctcagagaagactgtaaggacaaggttcttgaagaaacagactaagtactagaagtcaaggctagattgacaaaacaggctagaaaggacatgcttgattttttttttcttaaaaggaaaactaccacaaaagggtaaaaggaagattcctcctcctccaaactatactgtgtaattttttaaagtacaaatttctaagcaatgagaaggtcataattttatccacttttctttagctgatgctattgccatgcaccttatatatttaatgaccttgcaaatgtgaattccaaaaatagggttaaaactatggcagagaaaagtaataataatttttgtgtttttttctttctgcattgcttgttcttcagaaaggtatttggttatttcaataaatgactttagaatttaaagcttaatttttttaagttattctgaaaaggacactggaaataaactatcccacacacacatttttactgagaaagtacagtgtgtcataagtaatttatatttgtggtctaagatcatacttggtggcaaacccaaacctggtacacaggtttcctgtcttccaaatgagttctctttccactggatccattagctcaatgatttgcacttgagttaaatctcagtgcaatatacaaactacccatgggcatcttcctttcataaacccattaatatgagagccaggaaacattttctcagtacattcaataaactccactgatgtacttggctctgtggggacccataaaggaatatcatgcttgtcttccagaagtgcttctctccattgctaagaacttgaaaatacctgagatagactgctaggaattcttcccaaaaaaatccatagatcatttcccatagtaaacaagcaatcctatctaacctttttcccttgctattttgaagccaagatttaccctgaagcaaaaagttgtttgagcagggggttatggcatggtcatgaataaagagacattgcttataaactctgctaacttgaatgattcactttccaaaaatgagcagcataaggagagtacttatttatttatgctttataatatccaagcaaacaaaaataatttttgtactgtttttgaattgcgcaggcattccatacacttttgagagctaataccctgaacaatctcaatttttttctgtataccctccacccctaaaccctactttgtccatctctgctgtgcagtatcccccaggagactgacacaggctcttgggacagctggcttctggtggagggacagctggcttccagtggattgcccaatcggaggcaccaacaggagaaaatagataggacagtgaaaagcaagggttcaaaagcaaggattcttgggggcttttctccattctgtattggtctgtaccctccttgagtacagctatgttaggcgacagctcttccatggctcctactgtttgtgatctcacgatgggaatcactgtttctccctttgccccttcaggcctatcagtggtcatgactttctctgtttcaaatctctgggtgtatcccttaatccagcccactcatctgtaaccagtctgtttattaagctttgccttaattaatatgaaccacttgaattgaattttgctttgtaataggcttaagtcgttgacatgcgtctttcctgctatgtaagaggaaactcaacagcgatttgaacgtctttggagcccctgtgctctgttttctgcctattctactcctccctctggttggctcaccctatactaatggtgaggcagggaaaggtgctcagaagcagcatgcttaaatccctctgaaatgaattgacacatttccttttcccagtccagtatcccatgtttctgtgggtcttaagccctggtaagtagaatagcccagaaaatgtggataaaaaaccacacaatttattactttggctgtcctggccttgttttaaccattttatatataagtcctattgttttacttcatggcctcattctttttcatggagcaaatccaacccaaacgcctctgtagaccttctcccaaggtagagttaactgagtatggttggcctgcctagcaatactatttatttgatttgcaggtctctttcttaatgacaatgtaattactcaaatgtcaaaagttctctgccaaggcaaccaagtgtataatatgtactgtatagttttgaccaggaccttgaattcaagtgggtcattttatttctgtattcttggtaataatgcttgtgctaataggaatttgcaccattctaagactttgtcttttgaaatttttctttcctgttttgtgtctctctttctacagtgtctgtctctctcttcaagttctggttaatctatactttcttctagatttaccaccttaattttctgttgctttctcctcttctgatatattagatctctctctagatgagctttcacattcaatatgtttgcctcctgataacttcaaaaatatattcggtatatttatttagggaaaataaaaatgtaacccgtatgtaacaatagaaaatgaaatacagggacaggattttttggcaatataattgtggcactttatgcaagtaaaaattagataatgttgtatggataatggatgatgtaatatatgcctatgtagttatttaatgcatcttaacttgagattttagacgcattaaaatacacacattttactttgttcaatggtcatcagatttttgaaatttctctctttgtagttgttagagccaacagaataaagggatcttggaaaggtgtatattattcttctagcatttattaaccatctatactggtccaagaattagaatagattttggtattacgaaatttaataacgcaaagttccatcctccagctaccctctgaggagtcagagatttttaatggatcacgagatggagtttatagcatcttggtagacgttgttagggtaacagagggaaagagttaataactctgaggagggtgaccaggcacattttctactaatagtgagggtgttgaaggatgaattgcaatgcatcaggcagggactaaggaaaagtattatatagaggagagctccatgtgtgacaagacatacagacaggaaagaggcttgtcacagggcttggtggtgggtgggtgcagagggagcagctgtgtcccttattcagcatcccaccctctcttgttatcttggctctatcctttccctctgttactagttcaggaggctcggagtctcactctagctattgccctacattgccctcttcatatcacagcacagacctcaagataatgtttggaatttacctcttaaccatccactcatcagcaatggaaactagattcaaacaaccagtaaaattattctgtaaataatggccaataaaggttgtgcttacagacgcagtggaatctttttagttctcatgtaatttagctagggataccagataaatacaaaataatttgcatcttaaatggtaaatttaaatttaattagtaaaatctaaatttccaataaaatagctactttttagtgtaagcagtttttgtgatatactaaaaaatatttgctgtttatctgaaattctaatttagttaggagtcctgtatttttccacattaaatcaggcaaccctaaatttcccccttcggatgagactctgtgaacctctcacattctctctcccttagcctgtaagttgcattaaaaaacaacaacaacaaaaaaaaacggttctcctggtctcacttttcttcttcctctagtagcccatctctagttattcttgttctctagggctctgctctttgttcatttctttatgccaacatgcttttcctggacaatttaattccctttcttggtttttactgctattcacctatgacttccaaatctctcccaccatccaatatcttgcctttgacttccagacctgtctatccagtgcctactggatgttttcctctggttgtcctatgggcatctaaagcaccaaatagctgaaatgaacaaacaatctttgtctccaaattgcctctcccttgaattccttatattagcaaataacactaccaccaaccaaattaccgaagtagaaacctgggtaacgtctcagtgtcattctttcccctcacttccattgaccattgcctcaatcagccaacaatgattctttataatcctcctttacaaaatgctataaattccctagaacctacttagttgacttacttatctcaaccagattagcctctaatgcaatttccttatttgccccgccccccactctctctctctctctctctctctctctctctctctctttctgtgactctctgtgtctctctctctctttctcatcagtcctctccaacattctaaagcttctaatttgaatatatttcttaattgcttatgttttcataaagtatatttttcaggataggctgaaaagtttaaattagatgaattatattctccacaatcagatccctgccagccttcctagccttatctctgaggattaaagaagacatatgactggtttcattgtttcttgccttgtgtgtagcaggtattcaataagtatttgttgtacgaatgagagaatgatagagatcatttttacagagtgaaagctgtttgcaatgttgtcagagaagagaacattcaaagtacaatgataagagttcttacatttggaagacttgatttgacacataatatttaaaaaattacttaataaagaattatgattttatgggatttctgtatgaatgtcatacatagaaatatttagatacatataaatcttaaatgctcctaggaagatatatatttacatacctacttaaatacactgaatctgttttactattaggaatagccaataaatattgacattctgattgtttaaatcttctgaataattaatcactatttttctaacatttagaatatattaaaatacaatccacactgtaattataggtggcataattaaacctttgtcacatgtaaagatagttcagaagactgtaacatttaatttatctgttataatcattttgatttatgagaaagtggagaagcctattttcagatgatatgtatttttcagttttccaaaactcaaaattatcacataatatataaaatgatttctaagtatgtatatatatcaacattactctccagtgattttaagtaatggagatttttctaagtgtaaacctaaagacatattgtttagaatatggtataaataaatgtgtcttttaaagtttaaagactactcaaagcattgttatctactaaataagtgtgggaaatttaatttaaccttccagataatgtgtgtgaatgaaaagaaattataaatatagcatggggtggggaggtacttgccattcataaaataattccctttggtatgccatagactaagcattgggagaattcatgatgaataacacaattccatttgaagcctctgtagaattatttctatgtagttagtaacaagtggagcttggggtattattaggcaaaattacaacagcagcacaccgctgtgcagagaaagatcagggcatttcgtctaagcagcatcttcataactctggctcctaaaactaatgttgtgaagcttcagttcttttgaattgaaactctggggaataagagagggtcataattattagctaggaattgatgctaaatttgtttattcactgatttttccaccactttctatagtatgtaaatgagatttttacttagaaaaaacattctgactctgagacagatgacagctgttcaaccccaggggcagaaaaaaaacacagctttttccttggccttttctttttcgttagtgcagcttctagagcctcattgaattttcccagaattccctgtgcaggagctttcaaattctgattgattagtcatcatatcagagcttaccactttgtagctcccctgctaccaattgaacattatgaacagggcccagaaaattagcttgctcagcaccattgggattgtggcctgtttagcaatggatgtataattccctatgactctagttagtagaattggcatcagagtggtatgaatagaatgtcttcagaaaggagtctgaacatcttttgcaagttgacaatatcgccttgagatacagggagaggtgtgcgtgtgtgtgtgcgcgcacacacacacacacacgcacgcacacacacaaacatatcttcccagacctcttggcagaggagattatagactgaagtagggaatgacagaagcaagaaaaaggaactcattctggtgggagatgggggagaggtggttttcaatggttaattcttctacctctaccacttttagcctgttacagtctgcaatatccccttagaaatgactcagtgatcacattattggatctcactcttgtgaaaacctcctaaggcagagagaagtcaagttgtgcagaaagttatcacctggcactgatgattgatcttaggtgtgacattttgttcctcttttcttatccctggatctctttcctgctatgtagtctccatacacaacaaactttaacagcacattgaggcatgaattcatcaagcatcctgtgctccctcacggcatcagaacaccacttcccctctgtctcctgacagtgagctcagaaattaactcacaataaggtgctgatggctaatttgaagttaatatgtaacctctctcaaaatgatgtggatttgaagcagagatgtgaagagaaaggcaatatatgaacatgaaagaaacaaatcacctccactggtcaaatatcctggtagatgtctggagacaaaccgtagggcagaggatatatttatatttccttcaaattctaaacataggctggtcctagtgagagtaaacaaaaacacatttatcatacttatcaattgagttattattttaaaatatgccttccacaattaagttgccttgggtggatttgtgtaacatgccactaaaaataccatgaaataaacataaataagctaaaattttcttagccttaaattgctgttctgttttagaataatatgggcagataagctccacagcctccaaatcaggaattagatgtgttaacagctgtttttaaaatatttttatgttaagggaaatacacgtaagtgtacatgaaaatttcttgcttttttttttttttttactctcgctataggttttactccatgtacatatcaagatggatatgtctatgtaataaaatatatcatatatttacatatatgaatacatgtatactgggccaaaagcaatgcaaaactaaggaattaaagtctgccttatctacactttcctcttctttgctatgttagcacaaatgtacttctcatttgagggaacatggtagaggagctgccatcccatcttaatggtacttgatgatgccattgaagagaagacatactatttatttggtgcttagcatttagctttcttgatatccatcactgctttacattaccctcagagacacatcactgaatacagttttgaatggttccatgctatgcatgatttttatgggggtgcactgagctgtgcagtctgcagccactgcattccaaacaaaagaagtaatcatctagacacagagaaatgggttcattgccaacatggaacaggaaagattcaatattcatgtttcgacagaccacttaaccagtgttttcctgataacacggtgctagaacctagtagatattcaatcaatgtttgttgaatggataaatgagtgattgaatagatgcattaggtatcttcaattgggtctttctttatctagatctttaatataatgcagtctatggaagatggggttatagcaatgtatttttaaattgacaagtattcatgtttaataactttagttaaaggaatcataaaatcctcaaatttatacaaatgataaagtttttttaacttatacctagtgtgaatttttaaatcacttaataaactgtaaaagtttattaagttgtactaaataatacgatgctcattttatagatttttcaaattgcggcatgtacaaatactggttacataacttgcttacccactggccaagtaggtttttgctctccctttctcatatttctgctccctaagtaaaatgttacatccttgcatctttcatttccagagctccaactctctgcctccttatttctgattagactagcatgagatttcctttcttcccatattttgtgttccatgcattcacagagagacagatcttagcacctgaagagaccttagtgatctgcagactgacttgcttcttgtggtgagaaaggtaccatctttactatgttacagaagaaattcccaagaggcctagagtatgtaggattcacatgctggtgtgaatagagaagaggatgctagaccttcaggatacttttttcttcttttcttaaccaacacattttcactggaggcttatttatctttcatttctataggagtgataaaactgaatgttttacaatttcattcggtagatcaaagaagattcattgaatgttttctcctgtgctttgggcacactcatgtcctgttgtatgtgtggcggaggtgtgtgtgtttaaataacagatgaccctttataatgggtacagaagatagataaaaattgttagtgtattagaactttttatgccaatgcttatttttaattgaaaaaaatacagtgaagaatatattatacatgtatataatattggttttatttttatgataaagcaagaaatgtagatactaaggtgtgttcaattaaggacaggccagatacaaattttcctgcagcttgaaaatcttgtctacatatcctaagaaagcatcttctgatattgttcacgtaggtagcataatgtcctgaaagtcaagatgcctgggtcttttatctggtgctagtattgccgggtgggagattgaggcatgaaataggttgtcattaaggtccattccagctttaacaagctattaatgaaatgttgattgtcaaacagaaaatgtgcattttgttggttgacggagccacatttgcataaggctgccccaaaccactctgactgttaataaatgccagaggacttgcagcaaatcaaaacacaagtgctgataaaatgaatttataaaaaaagagtgattattttgcttgaaaagccacagggtggcctgtagaatctaatgcagggaggctctgagaatatatgagaataaatagtaacagtgttttctgagcccacgttgtaaggagaatctaaatgatccagtatgttaccctgtcattttccacttgcaatgtagacagctaatttttatttttcagttttcattttaaaacaaaaccaagagatgatgactgcagtgtaagacttactttcctgttgggaggaaattgcactgtgggcatgatgtctttaactttaacctttaaaaggtataattgacttgtagtaattttaggttaaattatattgtgctgtgagttaggtcacatacaaaacactccagacatttattacggatatgttaaaagtttgttagattttatttccagaggatttcatttaacagatttctactctatattatactcgatctcctgaacaatattagaaacagaggacggaccttgtttctcttttgaattttctgcttccttcaagccatcattgttgaccctaaagaaaaaagtccacttcatattagccttcttggtctaccacaatagaacatcacaaactagtaacctcgaccacatataattatctttttacagttctgcaggctagagatccaagatcaaggtgctggcaaggttggtcttggttggggctttcttcttggcttgcagatggctgccttctcactgtgtcttcacagggaagagagagagagctctggtgtttctttcttttcttataaggatacagtcctgttgaattaggactctactctttttttaacttttattctaagttcaggggtactcgtgcgggtttgttgcataggtaaacttgtgtcatggggggttgttgtactgattatttcatcacagctattaagactgatacccattagttgcttttcctgatcctctccctcctcccaccttccaccctctgataggccccagtgtgtgttttccctttgatgtgtctgtgtgttctcataatttagctcccacttataggtgacaacatgtggtatttggttttctgttcctgtgttagtttgctaaggataatggcttccaaatccatccatgttcgtgcaaaggatatgatctcattcatttatggctgcatagtattccgtggtatatatgtaccacatgttctttatccagtctatcattgatggacatttaggttgattccatgtgtttgctattatgaatagtgctgcaataaacacatttgtgcatgtgtctttataatataatgatttttatttctttgggtatatacgcagtagtaggattgctgggtcaaatggtatttctgctcttgggtctttaaggaatcaccacgctgtccttcacaatggctgaactaatttacactcccaccaacagtgtgtaaacattcctttttctctacaaccttgccagctcctgttattttttgacttttcactagtagccattctgattgttattgaatggtatatcattgttgttttgatttccatttctctaatgatcagtggtgagccttttatcatatgattgttggctgcatgtatatcttcttttgaaaagtgttcatgtcctttgctcacatttttatagggtcatgttttttttttgtaaatttgtttttctttatagatgctggatattagacctctgtcagatgcatcatttgcacaagttttctcccattctgtaggttgtctgtttgctctgttgatagtttcttttgctgtgtagaacttctttggtttaatttgatcctacttgtcaatttttgcttttgttgcaattgcttctggtgtctttgtcatgaaatattttcctgtatctgtgtcttgaatggtattgcctaggttgtaggaccccactcgttatccttcatttaaccttagctagctactgaaaggctctatccacaaatgcaatcatatatgaggttaagacttcaatatatgaactttgcaagatgacacaattccatccatgacaacatttaaagctcatttacaaatgtaatctctccctttcacaaatatcttaattcaaaagctgaagataacttcacattttattttccagtctgactccagttgtaaaataaaacattagcccaatggtttcttccccctgaggatattctattctgatatctaacttttaaatatatgttcacttcttaaagtagagggataatagccaccatctgttttcactatcttacatatgcaaacacagagagcttacctctgcatctatttgtgaagggtacacagttcttcaaatgaaacctgtaaaatgagatataatgttttacattattctggaatgtcctcttaagtttgtaaaccttaactcattaattcatgcgataaattgttaataaacacttactctgtgtcaatcactattctaggcattggtgtgacaatggagaacaaagtttctccctcaaggtgctcaaaatgccctagtctaggtaataaaatacatggtcacacttctcgtgcagaaaaatctccttttctgtgtttattgttttatgtcatctttttttttcttacccctcataactaagctcagtcatttttgctgggaaaaatattgagaggaaaatgaaatgaagtgtcttataatgtgctcatctgtaaactgatggatagactagaacagtggtcttcagtcctagctatccattagaattacctggggagctctaaaaatataccctacctgggccccagggattctgatttatttggtctgtgacatgtcctgcccatgaggacatttaaaaagatcccagggtgatgccaatgcacagcctgaattgagacatggaatgaggtgatcaccaagattcttcattgatctcagtgtgtgaattctttggttttctgcccagatgtaaaattatgttctagaataagttggaaaagtcattcttgttcctctgtatgtgtgtatcctaggggctattagtgatgctttcaagaaaagcatatctgggccgggcgcagtggctcatgcctgtagtcccagcactttgggaggccgaggcgggtggatcatgaggtcaggagattgagaccatcctggctaacatggtgaaaccccgtcactactaaaaatacaaaaaattagccggacgtggtggcaggcacctgtagtcccagctactcgtgaggctgacgcaggagaatggcatgaacccaggaggcagagcttgcagtgagccaagatcacaccactgcactccagcctgggcgacagagcaagactccatctcaaaaaaaaaaagaaaagaaaaaagaaaaagaaaaaaaaagcatatctgcttggctctaatttaggacaactcttttgtcttttgatttaaataaaaatcacaaagatcaaatcaaattaaatttgtataaaattcaagtagtttacatgtagcatgaagtgaggggagtgcagagaagggtgggggtggcatgatactgaactgtacagctaaagaggcgcttgtatatcactctaagtgcttccgagtttatcttaatgatgatggttttgccattgaaaaagtattaagaagtggaaaacataaagagatctatgttttggaaatatcacacgagaaagacagtggaaaattgctggaagaggggcaaaaccaaagacaaatagagttcaggagagaggcaatgctagagccttagtttaaggaaagtaaagaaaaaaaataaaaaataaagcaaacagagaagtgggcaacaccttgaacaaactgacactctgcaggtcaatggagaagagaatttcaacaagaaagaggtggtcggcagcatcaaactgcatagaggccgagtaaaaattgctacatgtattgagtaccgaacaattttctaattgctttatgtgtattaagtcacttaatttgtataagaactctggaaggtagctgttattatcaactcattttatacaggaggaaaccaaagtacaggtggtattgtgccaaagaccacacagttcgtaaatagcacagtgagagtgtgaatctgcaggactcaattccagaagccatgcccttaatgacctgcgaaatgcctgttaggacaaagaacgaggactatatccacccttcccgctttacagtctcctatccattgtatcactctgtatgcctttgcatacccatggcttatttctcaaagtgagaacatacggtatttgattttccatttttgacttatttcacttagagtaatgacttccagctctatgcaatttgctgcaaaagacatttcattcttttttatggctgagtagtattctatggtgtatatgtaccacatttttaaaaatccactccatgggtcgataggcatttaggttggttccatatctttgcaattgtgaattgtgctgtaataacatgcaggtacctttttgataggacttttggaaatgtgcttttttaaaaaatatctcatgtgtgaaggaagggtacacaataaggtggtacttgagggtgacttagcataaaagtataattatatttgaagttggaagagatggaacacacttatagtctgttaaaaaatagccaagaggaatgcaaaagatggaggtacaggagattagtcattaaggtagtttcctatgaagacggaggagaggggaaggaatcagtttgactatctcttcctgggagataggaggaaaggaagggaggtgggaaataacagcatttaggagtcagaaagctgtgaaggagcatttacccaagaccactttcattcctccctatgaaatgagtggtgcagggcctgcccagaggatgggttagccttccagtcatatacatgacactgatccaactttctcaaaaggcatggatgttgctaactcactcaggttgcagctgtctttctcagtcagagtattcttcaagttgtattcgtcaaattcagttaatattccctctcccaagtaaggagaaagtaggttccaagcaaaaacacccctcagtcaaagaatagcaaataacaaccttttgcatagcttgtgttcagagttacccatgaggagtctgagattgatttgccattcactgctacctctcagtgtactgaatgagaagagcaccaatgggtaacatatccagtcagattggcagtgatcagcctgtctgtggaaaggatgtgaactgaattaataatactttgaactaaagcataaagaactttggagggaagatgtcttcaaatgaaatcccaagtgtacactttctccacctcttacttaacaggcggagtggttgcaaagggcaacttcaacaactttccacagcagcccagttactgtcagtgttacttgaaaaggagaggggatgtgagttctacagacagcacttatcccctgagacataggcacggctttcgtgttcaatcactgtatttaattcaattatctgcccccgccacccccaactgtctgccttacaggggaggttgggaggagagtgatgcttgatgcttctgcaagtcccaaaagatatgcattctttattagggaattcaatgaaggatgagctcttactcacccagctgcttcctctgggaagtcgtcatgcggctccagctgcctgcagcaggaggatgacatggtctgtgcaatgcattgaattttattttatttttttttagattgaattcaggtagttgtttgttttaaagagggcttattttaattcatctttaaatatcatatttttgaaggtgaaaaccatcacaaagtcctgttcacctctagaaatttcagggtccggttatctagacagttatagtcaggtctaatgattttccctcttttctttctttgttttatctattcatttgttggctcgtttcaagggatgattaggactacttctatacaacaattgaggtagagaagaaatagattacagttcaactaactatgttaattttatttttagcaataattctaataaaataatgcaatttttaaaattgtgacattttcatagcaaaaaattttataacataaaataagtactaaatattatgaaaacttatattttcttaaactaataaatgctcactctgtcaataaaaatgagtcattcagtggttaaagttctcttaaataatcaaaacttgttggttggtgaagaaaattatctaatttatctcaagaaatagttaattcataaagtgaaagaaaagaataggccatatcagagaacttcaattgaagaaatctaggctaatctgattttttcattaataagtcacaaaccttctaattgtttcagaaaacaaacatactgctatttttttttttttttactaaatacaacaataatgccaggaaggtatattataagccggtattttccaaatttgagcctatacatttttctttaagaaaagaaattcccagacccagtaatatacactctctggattttgagaaatactggctaagactttcaaacattccttgaaaatatcttttagcttcagataatcacaacaaaatataaaatttatctttatatggtcaaaattattttatattctgattttggtaaaagctaagaggcaaaaaaccaaaacctgtagaacttgtggacctatgagtttatacccatagactcagtttgaaaaacactacttgatggctatttaaccaacactagaactttttgacagttcttttctttttcatacatgtgttaaattgcctctctctgagccttatatttaattcagttcctgcatcctcctctcaagttttcttcacccttgtagaatctgaacaataatgaaaggattgatgacaatgagtatcttctgaaactctttacctaagggattggcaggcctgttttcttttccattctgattggaaaaaaaaaaattgtcctttgaaaattggtctcattaggagcttatttaatcacagatatgtctctataggtgttgccaacaatatatatttattgagcatcagttaaatgtgagattggtacaattaatgttctacgcaatcaataatattttttgattagaagtagtatacatctttatgtataactcactataagtttactgaagaggacatttaaaacatgtaaatttacatttttcttggcatgttgagtatgttgatggaaagattaggatgattcacatcaaaagataattatcaatacaagtaaatgagtaatgaaaaataaacagttatagatgaataatggagagaagagtttggggaagtgaaatttaagcaggatcttgaaagaaaaatagaattaggatagaagaaatcgaggcaagaaggcattccaggcaggaaacccaaagagttagagatgggaaattttatttggaggacagaggttagaacagaaggctgaaaccagatgcttacataaagagctttctaagatagcttcaaagacactgattgctaaggactttggactcagttgctggaggtgttgagcaggggaccaaaatgaagaaagccatgcttctagatgattaaatttacagagggaggatagaggggcaggattttaaaaagtatggaacttgaaaacttaattcagggtattgcttatttttgttgtctacagtggtatactcacaagagggtatagacagagttgtttttcatttcgagccatttccccagtgacaagtaatgagggcaatgcagcagatgacaaattgaggatggttatgacactaagagtttctcttctaaggcctgcttctcccacaggactgcagagttgagccagggaagctaaacactgtatatcttctctacctttgttcattgcccttcttgcctgctccttatgtctcctgcttagggcagcatttctcagactcagcaatagtaacatttgggcctggataattctttgttctgggaggtgtactgtgcatgggagtatgtttagaatcacccctgcctctacctactagatgccactagcatcctccttaccttcccaagttgtaacagccaaacatgttttgagatattgccagatgtccccaagagcaccaaatcaccctctgtagagaaccactaggttcttatagattatcctgttgaatgttaagcatttgtgatagaagagggataatttcccttcttgatggtaggatcatgactaggctttcagctttatgaggactgtaggcatcggagaaccacaaatgtcaaacatgcagtttcagatgctttctccaatgacacatccaactttcaccctcttcttctccattattgtattgcctgataataatgtcaactctccagttaactaataatggatcatcagtatctcctggtttgcctgggagagtgctggtttacatctgttttccccatttctatcttgttagtaactccttttactctataaagtgtctggggttggaaggtaaattatatgatgattctaatatgggaaatcactagaatcatgagaaggcaacaagtgaatattaggaaagtaagaggtgaaggggcaatttgccctctagcttccccgggtaatttttcctagaggagacaccagagttaagacttgaaagcaacattaggagttaaccaggaaaaggggcaaagacatttacaagacaaagggaacattggatgctttgcagggtgagacacagaagtggacaaattgaagaggcagaccaacatgctaatataaaaatccaaaagttgtttttgcaaactttacttcaatttttaatctacctatcaaatttttatcctatctgggaaaatgggcagtgacatttttaggctataaattctaaatgtgaataacatttatcttttgtaaaagaaataggattgattgctataaattgtccaaaagagaagagggtcagttccctagctttgggtttgtgtatgtggtgatattgaaatgcacccgtcaccttcttttccttttatctgaatgtttgtaactaagacgtaactagagaagatccagcataccattacacatatagatttcaaagacttgggaagaaatcttatttcagcatctgtagctggttttattaaaagcagtttaaattcctctgcctagagcagtctggaattatagagatgggctgcagaaatttacattttaattgaggcagaagacaaaatagggcacggtgcagcattcacacattacaaggaagaataaataagatatgtatcagctgggagaaaaaaatgactggtcgtttttcattgcctcctgcacttatttttttcatatggcactgagctgagttaggcctgctaagcaaagacgatttttccagtcaaaatgtttactatttcagaaagtccttgtgttgaaatattttcacactatggaacaaatacacaaatactcaaatgggcctgcatttggttgtcaaagtgtgtatggcactgtttataatgtctcaaatgtctataaatataaataacatgtcccaatgagctatatagaaaatgatttaaagtatgaggtataacagaatgattgatagacataatctatctgttaaacactgtaatttgagctattttatagtttcatagaaatagaataaaattttatagaaatagaatttttctctatagataaatttcatcctttgattagtgtggaagtccctccaaagagtgggaggacttaggttttcaaacttgaggatttacctgtgtttggtaatcactttgagaaaccactcattggatttttcttttctattttttgttatatgtttgatcattaatagaaaattaagttgaaaattcatttcctcataagggaaaaataataaacataaaaagtgtatcatgataatggcttttaaaagtaagtctttgtattagtgtaaatatgttttgtagaaatccactgtaattaagtgtgtttatccatttatttaagccttcaacttttattatatcttctttcagctgtacgtgtatttttacattcatacatgctctttgccaatcataattattttgttagattaattatagaatttaaaaccaataaacaacacattactatagtatgattatccaattatgattccctccagagctaagtactataattggacccatagtaagaaaatgtaattctttttccccaagtatgtgcctctcaagcatgacggtcaaatagattatctacttttagccaccaaaacatatcttaattttctttattatttgactatgactttccattttgctttttctagaattttaaaatgacattttattgtctttaaaaaataataacatgcctttaccttatcactaagattacatatttcttaatcacttaatcaccacttaatgtcctattattaaagtgaaaatacatttttcttaaatatcattttttcccttggagctctctggttctaattcgtgttgttgattgttcggctctaccacgtaactgtcatttcaggatatttttcctttttactcctagtccattcttgttaggctatgcttactgtttttctctctgtctgcttcctccatgcttgggtttcctttttggtttttgtctttcatttttgatattcataagcaatgtttcagaaaggtatttgaaaaaatgtttgagtccttgtaaatatcaagcatcattattttcatcatacttacttaatagtacagctgaaagttcaaaataattttccctcagaactctgaagacattgctttattgtcctatagcattcaatactgctgatgagaaagatagtggcaatttaattctccttcctttgtagataggcaatgtttcattttggaagcttttacgatattctaggaatctttggagacctgatattatcggtaggtatgggtcttgctggccacttaaccgcataacaaccactgtattctaatgagtgccgtcaatttttcagtcacagggtatcttttaactcatttttttcttttacttttttcagccatcttatttactatgtctttttttttcccttaaaaccattattagatagatgttggcatcctggattaattctctatgtctgttaatcttttcttattgtttctatttatttatcttttggctcaatgcaaaatgagattcttcaactatttaagcttttctactagtttcttactgatttttaagcttcaagaaccctttcttcttggacttctccctaaaactctgttctggttttatagttacagcagtttcttaaatcatcaatgggactattataagcttctttcctgttccttgcattatcttaatgccttttagggttggctgttctcttgggttaccttagttcctttggcctttgttattttctcaaggtttttagtaatcattgatagttcattcatatgtatgaaataggatgttaagtaatgtctctgtcaccatggaaaattttatccccaaatttctctctgctccaaagtggggctgaccaactaggttggtgacctggctgctttcactatggagttctaggaggactagcagtatgttggaagcttacagaatgagaatgacttaagtctcattcctacctgcgaaaatcattaagtttctttagagagtagtatcataattttaggaattaggagaaatcttattggtaatgatgcttcagcagggaccagacagtagtgggcagcgaatggcccagatatttcttagacagactttcctattttcctgcctcactttctatatttactttaaatctctgagtcttagtcataaagagtagctcccacctcctaagaggctttgtcctctgaaagttttaagtcttagtttcgcctgctttgtttaaaacagaaatatgttcctcttcttcttctctcttccatatatctatccaaaaagctgctccattgaggcctagttatcttctcaacccagtcttttttcagaactgttataagtttattggtttttatttttctcttctaatttcagtaggatttttagaagaaggcaaaaaaaaatcctgtctgatattttgtagcagaagctatatatatacacacacacatatatatacacacacacgtgtagtatatatatacacatacatatgcatatatatacacacacgtgtagtatatatatacacacacacacatatacatacacacacacacacacacacacaaacagacatatatatgcgcagtggtgtgatctcagctcactgcaacctccgcctcccaggctcaagtgattttcctgcctcagcctcccaagtagctgggattacaggcgcacaccactaacacctggctattttttgtatcttcagtagagaaggcttcaccatgttggccaggctggccttgaactcctgacctcaaatgatccactggcctcggcctcccaaaatgctgggattacaggcgtgagactccgcgcctggcccagaagcaataattttaagattaaaaacaaaacccaaatatggtttcctccccctttctatctatactcacactctgggtaagaagtagcaaaagcaatcaggttttcaccagacaaggagctctgtgattctcagctctgtcccaacagcccatgcacaatggctaccaaaaacaaaaacaaacaaacaaacaaaaaaccccaacaacaaaacacagataagacaaaatgccaaaatgcaaagcactgcagatttccaagaaactctttggtttgcaggcctagtatgagcaaattttttttacaacgtaagaccatccccttgtgacttcatcatttgttgaccacacaactgctgccaaaccctaactcaaatattctccaaggtaaaacttggaaaaatacttgggttttggtccatgattaatcttcatctatttctatataggttatctcattatatcaccattaatataaagcaggtgggttacatatctgaggaaatgggcagggggacccaaatggttgagttgcaacagagcccaccactgtagttattcacttcatctgtgtatgtagcttaccacattcctgggaccacaagcatggaaacttagagcaatggtcattgacttttttctcctctattattctcagtgttgctcctgaattctctggcttaccacactgtgtttcaactcacataacacaaaaattatttccaaactgtctgcacaaatgtatttcatatacttattccttaacctaatgcatttcattctactgaaataatagttttcccttcttatcaatattgcccagcaagaaactcaagctatttaaacagcaaagctgccaatatttacaaccttttaagtcagtaaaggaatttaggtaatttgtattttagtgtttactggttggttaatgaatattgtgcttggggttttatttatttatacagcacctcattccaaaaataaataatctgaaatgtcttggatattacagaatatagtatgcaaggaattagaatctgaatattgtgtgtttagcacatttttagcaaattagcttgccaggttggaaaacatcagaggtttatctgatgtaagcatattttaaatttctgggtgtttctgtaaaaaaaaaaaatcagtctttcctcttactttatacaattattaaacagagataaaacaaagtccatgtactgcagacctttctattttatactgaaacatccaaatgattgacaggttttaaaattctatttataaaaggattgctcctctgtagacataagaaaaatcatttcaaagagagatgctctataagagaaattcttaacatatttaaaaaatgagagactcctctattgtgtaccttaatctggctcttattcagttttctattgttatacattctgttataaaatctataataaattaagactccattgttttaaaaaaacatggtaatataagcattgtagataaggcattttgctctcaaatatttgtttctattagtttattttacttctgtttatgtgttgtgcatataaaactttaatctttctattaagaaggaaaaagatgtgacttatgtatgatgaaatttgctgtaacctttatatatgttcttgaaggagccttggttgaaaaaaatcacacacatgtaattttttgtgggctatgcaccatccttatacatactaaatattgcattgcaatatttactattagctatgaattgacttgtaaatggcaaaacactccaggttttttacatggtattattttgaaaaatccaagcgatatccctttatcattactacaatgttctaactttgacaacctagaaaatagatttttttttcaaaagatacataacagagaacatcccttctatttgaaatctctttaaatgttgtggttttaaattcttataaatatttttctttaattacagtgagtggagggatagagagaatagtttaattcatacaatatccacctcccaaaataataatacttcagattatagttttttaatcttcagaattttgaccacaattttatttattaaaaaatatattttataagattgtttccttggctgggtgtggtggctcacacctgtaatcccagcactttgggaggcccaggcgggtggttcacttgaggtcaggagttcaagaccagtctggtcaacatggtgaaaccctgtctctactaaaaatataaaaattagccgggcatggtagcaggtgcctttaatcctagctactcaggagatggaggcaggagaatcacttgaacctgggaggtggtcgttgcagtgaaccgagatcacaccatggcactacagcctgggcgacaagagggagactccgtctcaaagaaaaaaaattgtttccttgctgtgattttggtgaagttagtcactgaacattggaaataaattgcaccttgcctcattttcttttcttgaaaatagaataaatatagataagatatgaatctagagaacacacacatgtactcacacaacaacacaccatttctcccttccctggcaagtcaggtttcttttacaggaatggtaaaagttataatgacataatgggaattctccatcagttaataaattagatgatgaaactaattctgactgctactaggactggagtagcagaaagcaatttcaatctatcaaagccatgtagggaccagagatgggggctatggctacagctccagtacccacatgtccactcactgcacaggtagagacagaggtctgcagccacttgtctatatcaggcagcatctgagatgtaaaaagatactgcctcgattttggttaataccactttggaatatgaaataattactggatctccagcacatgtcttctgggtaagaaggaaagacactatattctctcattttacagtgacaaaattaaagctgagatgttaccttattctttcaagcaaccatagtaagttggtggtatacgccagagtagaacccagagatgctaattcctaagcagtgatcttttctcaatactagattattctcttgtatcctagataagatagttaacatttaaaaaataagcaaagcgggcaggcgcagtggctcacgcctgtaatcccagcactttgggaggcagaggcaggcagatcacctgaggtcaggagtttgagatcagcctgaccaacatgcagaaaccccgtctctactaaaaatacaaagtcagccagttgtggtggtccatgcctgtaatcccagctacttgggaggctgaggcaggagaattgcttgtacctgggaaccgggggttatggtgaaccgagattgcaacattgcactccaccctgggcaacaagagcaaaactccatcccaaaaaaaaaaaaaaaaaaaaaaaaaagcaaagctccttttttgccacaattacaaaaatgatcaaagagattgtataaataaattatcagttttttcttgcacacaattctcttacccacatgcaatacctagtttctatccaatccccctaagcatgtattgatattttgaagatcacaactggaagaatagcttatttgtgttaaattgtgtaaaagaaacaatttttatagaaatacacatagaataaagatgaaacagaccacagtgtgccagattcatagcaaaatattattttaagccaatagaagaaataatagtaggtttaacgaacatctttacatatttcagtgtgccatgcatgagccaatcaattaatttaatccttatgaaaactcttgataagtattaattttcctagtttattgacgagggcattgagccaagacaggttacataaatcgcctaagttcatacagctagtaagcggaggagacacaattcaagcccaaggatttacattagtgcagataaaatttgtcaaagcttacctacatatggctcgattgtggacccatctcattcataacaccttatcgatgtatcagatccacactattctgttgtttctgttgcaattgtagaacctgtggcatatagcagcacagtttaaactcacaatcatgcaattggtctacctagtctaatttttttaaatttatctttttttgttttaagtaagtgtcatctatttagcagtctgcaaactttttagaagtatagatcttatttttctttgatacagcataaaatccaagttatgttggacagagaatagatattaccacacacttattggcagattgaagggcgtattaggagagtaaataaagtgtgagtaatagcagatttggttgaataaggctgtacattctggctttctctctaagtggtttattctgccaaccccaatgtctcagctcttaggctgaacttctgccctttcctctgtgaatccctcttcagtttctctctctacatgatttcacccattccctctttgtgaaaacttctaaaacttgtcatcccatcttattccctcatttaccctctcgattggtactgcaggatgcttcctgcttaaactgatcatatctaaagtgcactagttattttatctttatggtaacattcctgcttctaatctacaatgctattcagtctaacatcaccatttgtgagaatcctggatgagtggtcatttggatgaattcagcagatctttatgaacatttatggtatgccaggaactgtagtaagtgttcagtacaaaagggacaatatgttaccatttcttctatagctagcagctaaacaaatcacttattataacgcaaggtgggatattttaccatagaagtctgcaagggatgctgtgaaaattagcatttgcacttgcgcagctctcacaatttaagcaattttgaatgcaagtttaatacaacctcatgaggtgttattattatagtctacaggttctggaaaccaactgacttgcctaagtgctccccgccttgtccgccctttatgcgaatggtggaagcatgacgcttagtcattctctgtttccttccccatgggagaagaagaaagcggttttgcagatgtccttgaatcccaccaccctagtcagtatagggctgaatgcacaggagctcccccaagtgtttgctatttgataagcagaattaaatgcaatgtgttgtgaagacagattgcagctcactgtgagaattttcagctagcctgtttagaatagggtggatttgtctcatcctctagaagtgctcaagcagtttctgtagaaaccgttttggggagatgaacaggttttatgcatatgatgggatatttgtataagtgacctctgagtctccttccaactacacgtttctctggttaatttctttatccagttcttctacggctatagactgagagcttatctttccttaaaagatgccagataccacctccttaagccactgattcttaatagataaagagttgctatttatgacagttgtgcaaactcataatcaatcagtacaacacaaggtatgtgattttattgaaccctccccctgatgacttaagacatctgtggctcatgcctctaatcccagcacttaaggaggccaaggtgggtggattgcttcagggcaggagtttgagaccaccctggccaacatggcgaaatcacatctctaccaaaattacaaaattagctgggtgtggtggtacatgcctatcgtaatcccagctacatcgggaggctgaggcaggagaattgcttgaacccaggaggcagagcttgcagtgagccaagatcacaccactgcactacagcctgggtgacacagtgagactctgtctcaaatttaaaaaaaaaaaaaaaaacacatgtgaaatgagtttattacaatcttcagcatggtgcaatatctagttagaggactgagtccagtaatcagtcttttttttctaaatgattgttctagttgccataaaggtaagttaaataaagttagaaaatatctctgacaagaaaaggataattattttgtaacatctattgagacccacaaaacttgttgaaaagtggctgcaaggcatgatgagttagtcaaaggcagagggataagaaaagttcttaactggttatagccagttttattttgtgtagagatttttacgtaggatgtaactccaacttactagaacatttggcaaaggtacaataatgtgcttggcggtggaagaaagtataggaggagcacattataactctagaatattctaactcctgtataaaacacaatgaaaatattccctctcacaacaccacactggtcacctctaatattaatggaatgtctgttaccatgaacatttaaatgagaaactcgggttctattattgcctcatgtggttgtgagtattggctaaggagactgtattgtcaaaggaaatttgggatagaaaagggtgtagagttatgatcttgcatggttcaagttcagacttggacagagacaaaaagatgaattaggtgagttttttgaattcccaggaagtaatatggattggggacacatagttctgttttcctgggtgcatatttctgctgtttcagtgataaaattatagcttctactttgcgggaataagtaactaatagttctcatttttataagttctgagaattttctatgattttttttttcatgttacatatctgagggacatactctccactctctctctctctctgtaatgtggattaagataagtaaggagttttcttagaattagggcaagtttttaagcaccatagcttattttgccttgaatgatcaggcattgcaccatgagaccttcttataggtatagctaagttgagagttgcccacactgacaaaactatccagctcagttatgttaacaaaaaaaggaatctcaacttaggtaagagtagccactatgtctcaggaatagtcctattgcttaactctcttacaaaatgctaaaattaacattgcccataagattttctataaaaagcagccatctagatcctttgagtttcattgtttttctccttaccagttgaatttattgacagaatactctttttaaagaccatccttgagagtgaattaagtaacagattcttggcaaatctttctcaaaatttccaccaatttaggaatgtgaggaaagttgggggttgggggaggcagggggtaaagtggcaatttgtattccaattacttgatttcctgagaatagaaagttgccttaaattaaacaaggaagagaaaaacccatgcatcaaataaattgaggaattcatttcataccaggcttatattttatgctcagtttctggtgggatatgaacgtacgattctcatacttcagtgagtcagtgtgttatgtaaacatggccttagtggcaattactattataaaattggtgatagatgtagcttttgctttactgactgcaaattaaatttagttggaaagataattctagttaaatgttttaattagcaaccttttttgactattctatttaataacaaagatacttctggtagcccagtatgccaaatttattttatgaactcttataatggatcaaatttcacattgcaaagagatctgacaagcctgattgtcccatgatgttttaatgtttttggacattcataggcaattaagtttcttcttggagaatgggcatacgtatggttaaagacatcttgagattgatttttttctctaaatttgtcatttattcagtaatagtcatgccaataacaaataatattctcataacaaatactaacttctctaacaaacataatcctcaattgtattttaaagaaactaacagcattttaagatattaaactcctctatgcaaagagatgttaaagcagtgcctaaattaacatgaatttaataggttattaaacccagcaaactggtgttaaagtggtgcctaaattaacatgaatttaataggttatctttcaaaagatttaagaaaacaaatgcctctgttttcagctatttattgctttgtcaacatctaatatggacctagaactacataagtgactctacagccgaaaattccttagtgttttgtggcacgtgtcaggcttcttcttatccaaaggttaagtcagcagatttaaagtcagcagcaagaagcaaactcggatctgacttttatgccaaatcagctacttactagcagccccataatcttgagaagtaacttcattttgaggcagttcggttttctcttttctaaagttttgaaagtaatatttactattgcttgattgcagagaagaaagttttttgtttttttttttctaggcctcaaacacagcgattgtgtttggttaatatttcttccattttctggctcttccccttccattccctctccttactaccttgtgaaggtcagaagaagacctaggtgaacagagcatactttctaacatctcaaggctgtagccctagaatggtgtctccagcctccttaagttctcagttggaaaagcttaaatctgccaaagatatttactatcgtaaattccagctaacatctgaacataaggcacctttctttcagtctctgtgggaggagaggagcctaacttcagtaagtatcagttagcaaacccaaatggcctagtcacctggactgaaccccctttttgcccttgagtgccttttccctagcactccccagctttttgtttctgtctcctgctttttttttttcccagtgaagttgcattcagttcaagtggactctttcctctatttttcaatagttattgctgagtaaagactgttcataccactttagtgtccagctttgtttacctttgacaccattcagaagcgtttccatatttgtcatcatgttaaatgggagcttggctgtggcagggagatggacaagaagactacgtcattaggagagcatgtttagtactgcatagcgatgtgtaatagcgtaaaattatgaagtgcatacagtgcatacaccatacagtgccactcaacctttagtattttaaatcttcactttaagaagttttattttatataattatatatttttctctaattatattctaattatattgttgtttaaaagaatgattctaacaattctcaccataattgcatgtctgaggaaaagctacattaatcttttgaggccttctattttggtttaggggaattatgattgctttcaaagtaggataacaatcttttaggggactgatttttggatatatttatcaacacagcctaacttcacattcattaaatatttttgagagattgtatgcaagcagtattcttcactgataatttatttcaaattccagaaatttttcaccctaaatctaccattgtttttctcagtacttttatgttgttttgtgttgcagtcactgataattgctatcagaaccatgtataaattgatcaaatattgtatgagtaaaatatttaaaaagtaaaacaaaatgtttctaataatcatgctttgaaaaaataagttcaccccaccttgccacacactctacttgatttatttctcttctcaaacacatcacctttttctttttttttttttttttttgcctctctctgaagttagaaacacacacacatctccctctcgccctctttctctatctctttccctaccctgctgaaatctaatttgactaatgatgtcctaagctgtgaacattttgttagatagctattttgataaagacacacagcaatcaagtattaactggtccgtcaatttatctcttgatacaagtctcagactccagaaaaggagctaatgctcatccttacacgtttgtatcccttctgcctagaatattgcctaattagaaaacaaacaaaaacaaaagccaaaccattaagacattatttgttttgctgaacaaaacaaatatacaatgtatccactgagttaaacagggaaggtacaggccacatctgcatctggagaaggaaattgaggaatctcagtcctggtgacccaccttgatcttcacctaggagctgtctctgacagatatctacaagcctccatcccttcatattctacttagaattttgttctttaacacagatgtagatagatttttggacttctaaatatgtgaatagcacaaatctgggtaaaagagtttgtccaaggaagacttattcaacattttcaaagatcgtagaaggctaaaatatggtttgaaattacctagatgaagtgtaatagacacataaaaacctaagtctccattcaggattcacatatgccaaaatatgataggacagacttgacttattagcagttagtgtgagaacttgaagaattcttttaattaaatgtaaattttagatgagccattttctgccacgattgtggatttgaatctaagatgtgcattgtgcagtatggtactccaggtaagaaagagtctcatattgtttgttctacaggtaaaaacaaaacgtgaacatagaagtgccttgaaaactaattttacaaaggtcagaacaatggcatttataccaagtgcctcatagctagattttgtgtccaaacgagtattcgcagttttttgttttcaataggttcatttgctcctgtgtgtctttatgatattctttctagaacgctttctcccccttgtcacctggcaaatttcaacatcaagacccagctcagacatcacctcctcagagcaactctctgtaacctcagagccactcagccataacctcatctctcaggttcaacccttctgtgctggaaactatatatttattattctatttatcaccatataggcctgtctattccatcagacctgtgctgtccaatgcagtagccgttatctgcacatggcaattaaaattaaaattaaaattaaattaaaagttgagtttttcatttagcttgccacatttcatatgctcagtggccatatgtggctagtggctatcataatgggcagtgcgggaatagaatatttccatcactgtggaaagttctattagcaggaattgtgctatagtgagatccatacagaagactttctctccctgatctctccatcctcatcatctggggttgttcctagcatatggaagacagtaactaagtactgaacacaactgaactaagaaatagtgggcaagcttatatggaaacagcatcacactcagaatgcatcgctctagacacgagcataaaatttctgattcacgaaggtagatttctcttaatagacttactgggaaataaaacaggcttctttttagatattgagctcaggccccaaaatctttccattaaagccaagtaatcacctgccaggactccagtataatggatcccttcatggggttggaaattgcaactagaagagaataattgagattcagtcattctcgtgaccaatgtttgagcaacttttatgaaactctagagaaaattttgactacttgtcacgtcagcccctgactgtcaacaatgatccttgctttgctgagaatatctcgaatgtgtacattgtttttccctaggatcacttttactgaaactaatgtagctctaaaattttatattagtttttaggtttgtgtgtgtgtgtgtgtttgttttacaagaaaacctgtctggagtacaaaactgaattagcaattaaatcgttgtcaggaagcaagtactagccttaataaacaaagtataattgagaaaacaatgtcatatcagattttggcgtcattgactaaaagggagtgtggacaaatcacactaatttttcagacatctgtgtttccaataactgaactcagctgtatttggggctatggacacagtgagtattcaacagctattgaatgcaaagggactgaatgtaaataggtctgctttttaaaccacttctgctttgtgcagtgaaagccctaaagagctgttggaccaattaaataatttgttttttcttctggggcaacaacattttttttttgtatttttatctttgtgtccaaagacagcatgcttctaactgtaaaacagcacaagctctacagacattaaaaagtagctcagaaatgggtgtttttgtagacacagagctgtttttgtcactgaagacatcaggcaaaaatgctcttttttatacatgaagttaaataacccttgggatagaatattttacttcatttgtggagggatttgtgcaccctttcctgtttagaagggggcttctgtgcggatggagcatggccagaggaggctcagagcaaagcctgagaaagggcttcagtgactaagaaagtgaatttgggctttaataaaaacactggccttatatctgacaaaatctgttgctacactagatgatgtgggcagttgtttttctataagtgagagagcttctagctctgctaaataggaaaataagtatcttccctttcaaaaccgtaagagaaatgatattgaccaaacaattctatttaggagagagacttcatacactggaccaattattatcatccataatttatgaaattattggcttaacacctgttattttttgagctgtgttatctgaaaagatatgttgaagtcctgacccctagtggttctgtgaccttagttgaaaatagggttcttacagattttattagttaagataaggtaatactggagtaggataggcctttaatactggtgtctttataagggaatacatagccatgcagggagaaggccatgtgatgaaagaagcagagactgaagtgatacaactataggccaaggaacgccaaacatcaaccaccaccaattaagagctaggaagaggcaagggaggattctacccagggtctcagagcaagtatagccctgctgacatcttgttttcagacttctggtctctagaaccgagacaagaagtctactattttaagccacccagtttgtggtactttgcaatggcagtccttggaaactaatagaatacctgaaaggcttaatcagttcaggttcttatttctaggtaagatatttgataaatgaaatgaattgaaattgattttgtaggatcatatagtaagcggtgccccttgatgatgcttcttcagcccccttcacattatcctttattgactacgtcagccttccctcattacttgccttgaaatggcgggggttgtaaggagggattgggaaacaactccctgcaattatacgtaaaacttggtgtctgcatatgtacaattttctgaggccaaagttctataggttttttcggtctctccaaagagagtctaagacctaggaatgatcctgtttttaatgctgaggggtcaccatgtttaggatatcagcttacattctttttttttttttttttttttttttaacatccagaatccaacaggccaacaagtcagggacaggaactcagtcagagccagtcagagccagtaatgtgtcacagccagacaaaagtcagggacaggaactcagtcagagccagtaatatgtcacagccagataataacagctcatgaaaacccattgataaatgatgatgatttttcaaggtggtagttaagcacaaccggtattaaaattaaattatataaacttatacttgaatgcattatattaaaaacaaggtaagaaatgcttattactcatcacttcctaattacttttagtacttttctcttacctacattctgagggtttttttcccatcgactgcatctgtgtgataggcgtgaggatgtgttactgtgcatctcttcccaactttatgttcagtgacatcaagttggtcggtagcttgaaatcaattgtgggaaatcagatcacaaaggcaatttgcaaaacgactcccgccaacccctaagcaagatagttggtagtatttccaggctaccactgattcagacttgactgattaatcacgcttttatccctggggtttctattattttggacattacataagaatattggactagactcaaaagatggccattgaataatgttcaatagcgccttctcttataggagagttcataagtttgtctaaaagtgctttatgtctagatgtgaactttaagaatataaaggagttgtcagtcctccaattacaaaatgttcagggaataaggtgccatcacctttcttataacttagcattaccgattattattttaaaatgaatctaaataaaaacgttcataacctcatcaagaccttttctcttctgtatcccagattttccatgattgagtagcaatttatgagaacagtaagtcacttttgcatttgaaaataaaacgttttctcttggataactttctgaaaagtttcagtattatctataagctacaagagactgtttcctgtttgattaccttaaactgataaatttctctgggttatttgaaataaatcatacacgtgtttttgttttctttattgcctttcttttttcccttagaagcaataatgaattttatctggatgagatatgggaaaagtccccctttaatcttaatttttctttggttatgttttctaggattggccatgtgagtgtgaccatatgatgagaaacttatcctggtcacctaatgcaaatgtttctgaaatttttctgtagtttaatcaacctccattgtataaaaactgtgtttacaactgagcaaattactggagtagtaaaagaaacattgctagcctttaccccatgaaaaacacaataaaaaatacttactttcatggttctgtaactcaaatagaaaaggagatgagaagatttttccaaactgcaattactttattgttaacacttagtgtctagagttggaagaattaagtaatgacactaatattgttcatctagccacatgtaaatgtgctttagtttcccagcttatgcacgtcttaacactatgtttgtgcttaagccttttgcattgtgaaatacagcaaaaagttttctgggcagtgtgaatgagagctaccatgtgatagactggcccaaatgatgctgtcttctctgggagggaaaaagtaatcctcatcatcacgaaatgtcaaatttcaaaataaaatacttttaatacatacaatacagaaattataaatgcccctgacaatacagaaattcacctgacaatacagaaattataaatgccccctttagataattcagcttgccgcctcttgtggttaaggtgacactgctgcaccacctttttcttatcatagggaaagtgacccagaatatcaaggatggtgagataattcacaatagactgatgagtactatttgacattttgtagattcaaaatcaactcatttctgattaaacaccacaactctgtgcatcattccttttttttcctctcagaattttgataataagcacatgccagatatttatttatttatttattttattatactttaagttttagggtacatgtgcacaacgtgcaggtttgttacatatgtatacatgtgccagatatttaaaagaaacgtttatttttgaatgagtgttagccttgaaaagacaaatgggagaggtcgaaatgatggaaagatggatttgcacctgatatattcataggcaaggctgaatggctctccagtgaggagctgtatcagcacagggtctttataaaagctgggagtggaagtggcaagttcctttgtgtttctttttttgatcccaacatattaggaggctgcctgtcaagactgcttgaaaaagaaaggaacctctacccttaggacatatattttgttttgtaggagccaagggtacatagctttagggggaaaagttggtaatgtgctgaaaacaaacctctataaccagattctaactaagcaaaaggaatgctgtcaggggtgcagaggtggaaagtgacttgacgtcctctccagtgtctcttcttccatttcctcagcaacttggcttctcaatggtcagaccctgaatgactaattagaaggctgcaagaaatcaccatcctttaattaaataacggattattgaaggcaaatcattcgatacataattgaaaatgctgttaaactaagaggtcccttcctcttggatctgtaatacacattgaacttagtaacatggccctggggtcagtggcggagcctgtgtggatctaaggggagagattttggttgggaccacacagatgtgggaaaataggtcaaatactccctctctctcatcatctgtgtgctctctttgtaatttctcagtggtgttcatgggttttagatgttattaatcatgaaagttgtaaggtgcttggagatggtcccctttgttattttagaaagagaaagaagagagtggctgtccaaagactttctatacctatctcagtgcctgttgtagggataggagcctcagactccaatttatggtgaaggttttaggtagggaggaaaaggagacttttcctcccttttttcatgcatggcttaggaaaactggaagagacgaatctcaaaaacaagtttttcataatatcacagacataccatacacagagacgcacctctttaatattcaccttctgctaaggcatgcatgagtgattagtgttcatatttaacccattctgtgtctggcttcattttaatgtttgtgacagtcaaaggtctacaaggtgtatcaggcttttaatttttttgtatatacatgctacatacatatattttatatacaactctcatcaatatttcactcagctattcaccactacttggaaatgtcacttaacctcattgaatgccagttttctcattaacgaaatgggacaaatcatttattatgttgtataaaagtgaaattatttgccatgaagtgtttagaaatgtgtttggttccttttcagtgctggttttaagggatctttcttatggtttagggagtctgtgaaatccctgaaaatgtgtgaatgattttctgtgtatgtccaaaactactttttatatggagcttttatcagattttgaaagggccttagccctctataatttcacgtatcagttaccatttgaaggtaatccattttcagataggaaacatctgcatgttaatctttaataaattaatctctctgtgtgtatgtgtatgtgtttctctattttttcctcaaagcagcttctgaattggtaaggaattatttattcagtttatcacagttatcctgtgaaaaccacttctttgggtggcagaataatttcttaagcattgtcttttgtgtgtgattatgaaagattttaaaaatgcaagaatatacagaatcagagaccccagtgtactccccacacaacaataatacctcctaatttagaaatggggtgaggtaagatggtttctgttgcagatgaacttttatacattggcttctcaaagttgttcctcaagatctgtttttgtttgtttgtttgtttgtttgtttgttttttcttgccttccttccattatgtgtgattccctgtgccagtgcccagagatgcctgtgtgtgcaggatctggttattcctccttggatcaaatgagaagaaacacactttagagaagtttctattttatcattgctgtggtttcaatgtactctccaaagttcatatgttggaaacttaatctccaatgcaccagtgttgacaggtggggcctagtaagaagtgattaggtcatgagggctctgccctaacgaatgaataaatgttgccctcttgagactaggtttgttataacagtgaatttagccccttcttgctctcttgcttttgtgctctcttgcccttccacttttcaccataggatgacatagcatgaaagccctagccagatgggggcccctcaatcttggacttctcagtctctagaactgtaagaaataaacctctgttttgcataacttacccagtctcaggtattctgttatagtaacacgaaacaaactatgaccatagtaaaaaataattgaagcagttatctatttaactgaagaattcaattctgttgacattggaatattttaggaataactcattcccactcccatctttttcactttatattataggtaagtaagccaaccatctccaaattttcctatatggatattacgtcaggtaacacactgataaacacacaaagactgtgtttgaaatgcctacttataaagaatcttgtcgctgagcatggtggcttacacctgtaatcccaacactttgggaggccaagttgggcagattcttgaggttaggagttcaaggccagcctggccaacatgacgaaaccccatctctactgaaaaaaattagccgggcaaagtggtgcgtgcctacagtcccagctactcgggagactgagccaggagaatcgattgaaccccagaggtggagcttgcagtgagctgagatcatgccactgcactccagcctgggtgacagagtgagattctgtctcaaaaacagagaagaaaagaaagaatctttacttaatgtgtgttataattgtttgttggttatttttcatccctatcatcatttgggtttgatgaatataaatatgcatgtaatatactatacctttgcttcgcttattttttctctctggtcttccctcattaacaaagccctgtgtacctacaatgttggaacatgggttggaagtatgggatcaatgggattcctatagtatgttctatgttggcagttcattaaagaagattcaggggttgctggatgagacaatgacaaaatcaggcaagagaactcagataggattatttctgtggttgctattttagcatttttgcagtccacatatatgtgtgtcttcagtcattatgctttcatgctcattttctttatgttaatacaggaacataaaaataattttgctgacataaagatcacagaaaattcaaactggctttatgtctcatgacaaacaaatagaatttatcttctgaacctgctaaagtgagatttgtaaatgatatgagccataactgaagcatccagtcaggtgtctcctacctagattgattagagcaattattcttaagcatggcaatgctcatctcaaacccattcctctcctctgggtcaatgataagtataagacaagggtatacattcttaactagggaaaatgcaacctaataaaatgaaaaatgatggcaaaaatagaagaactagcaaaagagaaactagagatgtatttttgtgatagaaatatttcctgggaaaatgtaaacttggggtaaatatacatattctgctctaacacagagatgtggaactgaagaatcccacgtgaatgctaaactgtagatagataaggttgataacaatctgataaaatgaaactactgcatgttatactgttagttttgacttatataatgaggttggtcattcatacaagctaggcaggaaacaaaggcagatgtcaaactatcatgtaagcacagctgtttaaattaatttcatcattacctatgagctgctctgaccttgtaagttccgctgagtagagtacttaagttctgagacctgtcaataaatatgtggctgctgatccacttccaacagggcatgacatggtcataacgttttgcagcctcccgtttctacaaatggtaatgaccatggattccaaagagattgctttatagcatgtgttgtaccatcagaaatggtatattcaacagaagcttagtaatcactataggctgatttgaagtagatggcgaaccaaatctgtaagaatgccatgaagatttaaaaaacaaatgaacaaacaaaaagcagaaaacaaaactgtaaaaacccctggctgaagtttgtatgtactccaagctttatacatagaacaaaattatttgcatctggccttattggacttaaatatctagtctttgttggaaaagcattgaggttgaattataatggctatgataatttagggctgtgtggttggttacttgtagagaaacccaagatgacaatgataaattttatagtaaatttacggtaggtttagacgtgaatgtcagccaattaaatgagcaatcaaaccacaaatataattagtttcctttgaaatgccagctccatggagagccccattacttgacaaaaatagacaacttatagaagaaatccatcaaaatatattgtctggaactaaataagagctgaggtagcaactgtgtttattaaggagggaaacctaatttggaatcacagtgaacaattaaattttaagtaaaatatactgagagtcagtgacaagttacaggcttgagaataaaaactaaacttcctgtaatttttttctctgtgtgtatatatacacacacatacatataaaataatatataattacacaaactacacatttatttgttccaatatgtgaaccaacatttgggaaatttatgttcccaaaatttccattaagtagctacaagctcagaggcttaaggaccaggaaattaatatgaacattaacatgaagtgctcagtgttataaaatatagtagcaaatgatgggtgatagggccatttgggagctcaagacataaagtcattcccattcaactttgtgacctaaaaaccgcctttgggctcattcaaatgctggtgatttgaccagctgactttcagatttgggaactcagaatgaaaccattaaataatcacttaagccaaattcacctgcaaatatgctatgtaaggatgagagagattttactattccaagattgaaactatgaagcaacaccagaatttgtgcataatattactaaataatgcttctgaatcacatagacatatttttaggactgtctcctgagaaatctgactataataagaaaatatctttttgtgatttgttttgaatatctgttgaaattgctctgctaatgaatttcattcaacagacttagatcacactttcatgtttattgatagcactttgctcagttatttcgcggacttgtggaccatttttaccattgatcactagtatctattctacttaattatagttctgttggtatctcagtaatttccatttaatttgcttccatggaagtggttggaaactgaaacttttaaacatttccattactccaagatatgtttctgtctggtagaatttatctgttttcaaaaaagaatatattctctggggaaaataattagaaaccttttttgttctacgtaacgggttcttgcaatgtaaaactttacttgtaagtgaattatcaggatttcaaatatatccatattaaatattacataagtgtaaaatatcttaagctgtgtaactttttttgaaatgagccattttagtaccattggccacatttctgaagtatgccattattactcaaaaactttgtaaataaatgaatggatgaatacactatacatacagctcttaatagaaattgtaaaatatacatttagaaaaaaattctcaatacatgctttatcagtactgaaaaaaggtactaattttgatttattcagaaagcaaaagcaatagtagcactggtttttaaacaggttacaaatgaatttcttcttgcatcaataatgtcagaatcactaattaaaatagtgtatattaaaactcacaacccgtatttctaacctgagaagtttagcttatattaaagaaggaaacatatctttcaacatacctgtaaaaagtagacctgaacatttaggttaagatgatgagagtagaatactctaatcatcatcattaatcatcctcatgccgctctgtggattcctcatctcacagtaccacaatatcctaatttcacaatatttgtgagtgctgggaggaattttatatatctgagttgaccatatgttgatcctatgtattgaagcatgatgtctttcttatttatttaaaactcagcctgaaaaacataagatgatatcctataaatgtatttataagcttttattattttctgatgcttgaaacccattgtttcaataaaagatggatataacataataaaaatcaggaatgttcctcgaagtccagaatccttagtcattatattaaattttccctggcattaccattggaagcctgggatttactctacatatgatggtgtcaataagacactaaaactgtgtcactaagttggttatgctgaagtggtgtcagtggttctagatttagggtaaaaacaaaaaagagagaaagtgaaggcaagaaattgttaaaactctgaattcaggtttggaagttaggtgactttttttttaggccatatgttggagttttgtaccaatgcatgtttctctatctgtataggtcatggatggcggcataagtttgtctgttcttcatatatgttagtaacaagacagacaacatttttggcatttagtggttgtgttaaaatttcatgattagatatgttgtaaattttaaaacagcaatcacattttcagatactctgaaccagatgctcagcattaaaagtctaactttcccatatgcttcccctgcaggctaactcaattggaaaacctctgccctattggttctccaagacaatggcattgtcaccaatctaatcatgtcttgaactatattgttgaatacccagagtgatttctctaggtagatgcgatgaagcagcaggagtaactctgggaaatgcatgtgacagatgtttttaaaatcaaatccatcaaatattactactttaaattcactcaaaattgattagacccactcctgtgatcttgcctcatactggttttgtttagtttagttaatgttgcaattaatctctgcaaaaatctaattcatccccaagcttatttcatgccatgatctgtttgtgtaaatcttctgaagcaaaataccctgtctaatttgatctgttgtcatgattgaaaatactaagttgatatcactttgtttctacactgatataattaaaatgcccacgcttttctaattaatctaatctaaaattgctttggctattagatatcctaatagaatgtaatgcattgttttttttcttatctctgtcattagtcaagataattaattttgccaagtttgaaacacacccaatatttatttgcatatttagatttcaatctaagccagacttctttgtcgaatattatccattactattaaatagaattactctaaaaagccatgttaacaacgttcaaagtagaatatataagaagtaatgtgttatttgcatacatactgtttacatttaaatatatatgtacataggtgtacatattcaaattaatatatttagagttaggcctaataaatataatatatttaatacaagatattaagtaagacacattatatgtaatactatatttaggtacatacataatatatttatatacccaaataattatttataatgtttatgatatactttctgttatatttcaataaacaaattaaatactctttacattacacactgtaagtaagaaatataaaaaagtaaataaagacttagaaattcagtaaatggccagtccattttggatatattgattgtcattatggttcatgtttagtttttagaaataagaaatgtgaatattttatcataattattttagggtataagaacataaagtggtggatactcttcattttaattgcttattttcaaaattgatattaaatagtagcacttacattacaaatgcaaatttaaattgcataatatattaaatttatacaaggtattaaatatgctgatgaagctactctttaaaaacatccctaaactcattttacaaatactctgactgaaagcaaaaacaagagtatgtaaataataatgaacgtgataatgttggttgtaagatattttgataaattgttgtgtttaagtgtgattaaaagcagctaatatactcaaagatatctgcatctcacaaaaatcttttaaaatattctatttggaaaaataatcctgtttttaattgcttcattgaatattttataatgtattttattatttaaaacacttttgaaaaaatataaccccatattttttagctttgactgtattttcctcctcatatttaaattcaatactttattttatttttcaaagggatatttttactgattttgcaaagagggttacaacttcagttcagaaatatgccttgtatagcttaaagacttaaaaagtcaactttttccaaaaaccatttttaaagaaatttttattgataataaaataaatgaatgggaagacttacaacattgagataaaattgctatgtaaaagcatttttaatggagaaattcattttgtatttgcatatgtttagagaaacatgcagtttaatttgaattcatagggattctgcaactaaacgacacttaggtttctatttattaagttcatgggccctacctcaattttttttttctaccaacgtattccatctccttcccatatttttcatattaacctatatggcacaggtttatccagtccttcatccggtcacatattcatattataatgattatataagctataactttataaatacgttacaaaatgtggattgttttgatatagtgattaagaagacaaaatatatggaaaactactcagtatcgctaggcatcatggaaatgcaaattaaacaatgctgaaatacccttaggcacccaccagattatttaaattaaaaagactaataatgcaaaatgttggcaaggatatggaagagctggtgtgcacgtatattattggtggaatgtaaagatgaagttatcactttggaaaactctttgacaatttcctgtaaatatatgtcttccttataaaccagcaattctacttctaggtatatatcctagagatacaagtgcatcggtatataaaattgccaaaagaaggtattcataggagctttattcatagtagcaaaaatctggaaacaaccctagtatacatcaacaataaaataaacaattttgatgagtcaaaaatagaatactgaacagtaattaatgcacaaattgatgtacactacaatatgaataaatcttaaaaacattctgagggaacaaaattaaaatagttcctactctaaaaatatatttaagtgaagctcaagaaaaggcaaacctatccattatgatagaactcagaatagaggttattccagtgggaagattttaaccataatagggcacaaaagtttagcagagatggaaatgttttatctcttgattttgttggtgtagacatatacataaatatacacacacatacacatatgaatattaatcatgtgatacagttaagatttatagattttgccaaatgtaaattatgtcaataaataaaagaaatacagtgagttgttacttaattaaaattagagggtttttatcagcattgatgagactaaaacataaaatacataaagaccttaaaatcacaggcaacctacagaatgggagaaaatttttgcaatctctccatctgacaaaggtctaatatccagcatctataaggaacttaaacaaatttacatgaaaaaaatgccccatcaaaaagtgggcaaaggatatgaacagacacttctcaaaagaagacatctgcagccaacaaatatgtgaaaaatagttcattatcactggtcattagagaaatgcaaatcaaaaccacaatgagataccatttcataccgttagaatggcaatcattaaaaagtctgtaaataacagatgctggcaaggactcagagaaataagaacacatttacagtgttggtgggagtataaattagttcaaccattgtggaagacagtgtggtgattcctcgaggatctagaaccacaaataccatttgatccagcaatccccaaaggattataaatctataaagacacatgcacacgtatgtttattgcagcactatttacaatagtaaagacttggaaccaacccaaatgtccataattgatagactagataaagaaaatgtggcacatatataccatggaatactacacagccataaaaaatgagttcatgtcctttgcagagacgtgggtgaagctggaaaccatcatcctcagcaaactaacacagaaacagaaaaccaaatgccacatgttctcactcataactaggaattgaacaatgagaacacatggacaaaggggaacatcacacaacagggcattatcggggggtggggagtgaggggagtgagagccttaggacaaatacctaatgcatgtggggcttaaatcctagatgatgggttgataggtgcagcaaaccaccatgacacacgtatacttgtgtaacaaacttgcacattctgcacatgcatcccagaacttaaaaaaaaaaaaaaaaatctgagtctaattcttcttcagcctgactacccctgcttttctcaagaaatatgtcatatagcacacttccaatcaacactcaaaaactcttatttccttgggaataaagaagcagatttcaaattatagattattgtgcacagtgtctacttctaaaactgagttactgtatttgaagactggtgaaagtttcaacgaacacaacaataaccatagatagatacttatacatggtgaagactgtaccattacatggattatttcactgttcctcatggcaatattaatgaaatggatactattttgtaaccttagtgagccatggagctgtacctcaaacccagtcacactgcctttagaagacctgtccttaacaatatattatttttgtgctagatattctgatcgtaatgatcatatgaccaaaacagttggcccattttgaatcaatctacatttagatcattgtaagtaattagatgaatcacttgcttattggcaggtaagctattgtgatttcttaagcatatatttgaagttaaactgttctttggaacatatggataattattttttttattacattttaagttttagggtacatgtgcacaacgtgcaggttagttacatatgtatacatgtgccatgttggtgtgctgcacccagtaactcatcatttaacattaggtatatctcctaatgttatccctcccccctcccccctccccccaccccacaacaggccccggtgtgtgatgttccccttcctgtgtccatgtgttctcattgttcaattcccacctatgagtgagaacatgcagtgtttggttttttgtccttgcgatagtttgctgagaatgatgggggataattatttatgttcttccaatgtaggtacttaaagtagaatgtttttctactttaaaatgaagtgtattagctttatgaaatttaaagagaagatacaggaaggcacctatgagaaggctcacgtgttcaagtctgaagaaaaaatcattggttttaagtttggaatccctaagttacctttagagagaatggctgaattgctgcataaacatctgaagctggcaggaggaaatttggaagaccaaaattaggccatcccagaaacctactttatgatgatatctgtgtgatggagtaatgtagaggaattgacatctccatttaatttaattcccaagggagttcaagaaaatcctttatgtatcttatttaatatgtgttcttcccctacacaattaaaattagaatgcaactaagactctactaagggaaggaaaatacaaatgtaaaatgatcattctttcaattcccttagaagtttgataagtgagagaaggaatgtcaacaattatgctcagattctagactatcactagattttgcctctcgaaaattcttctgcttcctgggaaaataattgctaataagctgtttaacaaagataatcccaatctgactttaattcattcaaaaattatttatagcaagtttaaaatatgaaaagaactgaaacctttctgatctgaccagctggctaaaatcttggaacagagagttttagaatgaacataagctttatgcatttagccgaattaaacatcatttaatttgtatgactctgattaatcatagtcactcttaaatacaaatgcaattttagatttcctctagctcaagtttattgaacactttgtttctgatgtagactaaccttcagttggttgtgtttagttgctagtggctttagatgccccttatgtgagtgacagtaatatttagagggtacatgcatgtgaagggaaaatcttgaaatatttatgttctaccataaggaaatctctttttttcttcagcttagaagaggttatatccttacgtacaaacattatgtttacaatgttttttaaataaaatggtatttttttattgcaactcttcgtctacaatagagatcgatagacttactttaccatatgatgaacaaaacctaaaaaatattacttgtgaacttaaccacaagtttagacaaacaaatgcactgaactgaattttgagtaaacttatgtatagccaaggattaagaaaattccattacagtctatagataaactcttactaccattaatatatttttcaaaagcttgtgcattatgaagttcatgtctctttaaccaaaacatataaaaatatatggtgaatactttgtcaaaacttgtggaattcattaagtataagaatccacataatccaagtttactactatttaattttaatccatagctgaataatgaaagtaaatgaacagagccaaaaacatgtcacttttgagaatacatatgtcctccaaataaagtacatttatttgtattattctttgtctgtccatcttctcaagctccattaaaaaagaaaatatatggaagtgggtgaaagcttgaggactaaatgtgtagctgcaagtacattcttaattcagaacttaaaaatttctaggtagtgtttaaacctattcaaccagaaagggaaacatattccactaaaaccattgataaaaaattatatgatggttacattcaaaggcatgtcctattttgctctcaaacacagcaaaatagcaaaatagaacatgcctttgaacataagcatcatgcatttagctgaaataaacaatgcatttgcaaatttttgccttagcttttgctataactttaaatgatacatgtccttgagaattatggtcaaattttaaataaaaataaaaactgaaaacgtctgttatgttagtttccatttcattattcactagaaataatgaaactaaaatgttacctaacatatttgaaactcatgacataccaaattaaagctaaatatatattaaaattttaattattttgtttatttaattttataatgggagtgagagtactttgtcttttgagactagagaaatatgtaagaggaaatgctacagaatcaaacatttttgcatatgtgtcaagttatagaagaaattagcaaagaatatctaactatatttgttttcaaaagattttttacgtctgccctttaatgtttacagcttatcagcaactagaaaattgagtcaagcatttatggtaagctgtttttactgaagtatgtttgctggttgataaagatgtcctctgtgagaagatagaagtagctagttatcttcagccagaggaatattttgtattaacatgcggcagagtactttgaaaagtggtttattgaagttcttactcactttagttttataaaaggcaatgtgacataaatcatggtatgttttttttttctttttcttttctttttttttttttttgagacggagtctcactgttacccaggctggagtgcagtagcgccatctcggctcactgcaagctccgcctcccgggttcacgccattctcctgcctcagcctcccgcgtagctgggactacaggcgcccgccaaagttgggtgaagggtttacaaatgttaattttcttatgcttcataacatgcaaatataattttacttatatgtgatatttttgcgtaacaacttccagtaaaaattaaaattaatatgccactagtcattctaaaggaacatataatttaagcaagaaatgtctttcttttcagtctttattaaagtgggttatttttagtggtttctatctctaggtatctaattgtcattttaattaacgatagtttataaacaagtatgtccagttttagaagtttgttaatttcttcaataaccatactaaattctaagtctgtagttactgggtacaggatgcagtcttaaactgggatttatattcatgatattcaagggttattcttaggaacaatggtccataaagttatggggaaatgataaaactaggaattatcactccttctagaaaaatgtatacatgctcatagatgtaattttctaaaataaaatctaatataatagtctcagatctcctaaaattcatccattgctagcagcagtaacatcatttacttttactatgccaaaaatttgtagtattttctttttatacatactactgcaggttccgtaaagttgtttctaatgtagatttcgcctgagtttccccatgtcaatttctgcatggtggcaatgtttcagttttcattgcctgttcttaattcctaagtttagaacatttgggttgcaacagcatttatcaatgcaccaacacaatctgcattccactgacatgtacataatcttgtcttgatctttgatgttaaatgtgagttttacacgttaatacaattgcttgagaaattccttgatgggtgcagcaaaccaccatggcacgtgtatacctatgtaacaaacatgcacattctgcacatgtaccccataacttaaaagtttaataataataagaagttacaaaagattggaagctagcatcatattatttctacttaggcaacatgacaccaactcctgtatataaaacaaatttgtagaaataaatactgacattatagagtggtgtatgctacagcgtcaagctgtcagctgcgttggttttacctaaattctgaatataagaatttacccagttgctcccaaactggctttaaggaagatacattcttcactaacctcgttgcctacgtctcctctttttttgtgcaaaagtgtttacatattccattctctttatcagaaatacttatgccctactaactatacttttgattggattgcttcaatttatttttgatacttcaatttaaatatctctttctcagggatgatttttctgtacatgtcctttctctatcaaagcatgcaattcattttgttttctgaaattaaaaagaccagggtttattatgttgcatagaatatggtatgtgctcaaggagcatttcatgttgaaaattaaatgtacaaatgaatagatgaaagaacaaatgaatgctataacatagtgcatactgaagatacacctgtttgatgaataaaacatgctctttgccttcagttttagagatgctcatgacaaaaactgaaataattgcatttggactttcctacatatactatctttatatataatcttgttttataccaaaatcatgattgtctatttttcatacaatgttttttcaatgtcttttcttcatgtagtctcctacattccttaagagcattaaaacactagatttcagaaccaaggagagttccaagttgatgtcaaccaacaaaaaacttggtgcctgaattttgtaggagaaaactagtaatgtactttaatcagtggttaaaattggccgctgactggggccaatgctgtctagcacaattattttaacaattatcatttttacaaacaagatagctgagagctttcacgtaattcaatagctgactttaaaaattcaggatcatttttcccaactcaatgttacttcaacatcacttgaacctatggctctgataattgatatcaaggctgaatttctcttttttgcctatatggttcatagacatttaaaaagtcaacaccttttatttttacagaagacattggaactacccctgttacttgtgaaaagttttcagataggaaatgagactttcaaaatgaagaacaacttaagccattgtcatgagctacttttcctagggttggtaccttaagaaaactcactggtactcatatccccaatccaggcaaactttttattcccaggatttacatactcttaatagttcatcccaccagccttatcctggattctgccacctcacttatccttaagccttcccacttccttttcataaaatattaaatctataaatgaaaattccaggatatatatcacattatcttttgctgtgatatattccagtttatctgattttttagaccgggaattggcaaattaaggaccatggatcaaattcagctgaccatgcatcattttttaaaataaagttttattgaattacagctagggtcatttgtttacttattatgtatggttgcttttgtgctgcaataccaaagcagacagcatgtaacctacaaagcctaacatgtttattgtctgaccctttacaaaaaggaccttcattgactcctggatgtagatattaggaattataaacatggttttaaggaacatattagagaaaatggcatttcctggagtcacaaactaaagtgattgtagccacatgcaggtaaactaaaagtgatcagacttggtataagaaatgggaaatgatggacactgtgggaactttgaaggagcatgcttagtttcaaaactacatctacaacccagccccaggtcaatttcccttactagattgtagaccatgtattgctaacccttctaccttttaaagaaaagccagatatttatattctaatgtgacactttcaaataaaaaaaacccaaatgttttagggcaatttatgcccaaaacatacttttggcttgatttggccatagatcatcttgttataatcccagcttttattaaaaatagttcttttcatgaaaatttaaaattgcaacatattgcagagccaaggagagatcaacaaattatactttcttagatttctctgaaaatatttataatagaattcctaacacctatattaacatgttcataaaaatgtcactgttcaagtctctgagtgtttcgctcaaaattgaacctgcaccaaaagttattcagaaccagcaataatccaaacgaaaaaggtctcatactgtatttcctaacaatgtggcatgtttcacactcattagttcctagccctagtgtacatgtaaaagtcatccaattagccttggatgaacaatatctattgaggcaatgagtaaactgtaactaatactataattgcatcttctcatatgtttgttttaaaatacctctcaggtcaacatatttcccatttagaagggtatgagatctgtagggtatggtggataagtcagagtccctgtcccccttagctagggaattagatagaatttaataaagtggcttgtttttaaatgagggggaaaaatttagggaacaagagagagtgcagagcctgcggattaatggtagttccaatagctcattaccacctctagaccaatagaagaaaagcaggttccaagttatgaaacctggagtgagaagctaatggctacctgacaagaccttttactagactgatgcaaccaaccagctgtggcttagaagccagggagcagagaggaaaatatcctgaccatcctctcaccttctactgatttctcccagtgttgaacccactgacggcctgagggaaagggcacttgctgagacagtccacaaaggtcggcttcctcacacacacgtcagggtatggcgaagacagaggttggctctgaaggggcgaagagagaatacctggccccgtgttcattctttcttgtggcttgtaggtcagtgttctaacctctgaaatctgtgtggttttctgaagctgaaaacacagtaatggagagcatgaattggaagatttttctttaaagctattgaagtgaatgagctgtgagtgaatacttgagcagagagtatcacatgtgtctgttaatgactattattatatcgtgttctattatgagtctggcaagctgagaagtcaagtgagggtgacaggcacagtggaaactgtgaaataccatacctcttctagcatcctctgagaggaagtactgaacagagaattgctattctatataaacttacgtgtgtgtgtgtgtgtgcatgtgtatgtgtgcctagaaggaagaattctcatgaagaaaaggataaattgtacacttatatattggagtattccccagcactgaactcaactacttaattttgaagttcaattgattgctttaatcagaccatgctcttgcagatgtactgtaacagagagaaagaaagcacgtcactgttaattctagctgtaggctggcctaataagaaaaataacttggatgacttgatggattttgcacaattctggaaaaccttaattagtattttgggaaaagcaagcagttggttaatggctgcatttggttttatttggactttattcaaaagttctggtttcacctacaaataactacatcaaatgttgctttttgggttaaaatttgcaaaattgagtttgatagtttagttgcaattaaaatgttgggaaagctatattttgtcagctgtttccaggttatattaatattctgtttcttcatgtttacataatttatgtcagcatattaattgatctaaatatttttagtgcaaaatctatattataatgtatatgtttgaaaatatcttttcaggaaaataaatgcaattaaatattcaggatttagcatgaatataaatttgtaataacctattttaaaaagggttaacctcaaattagatattcttattttaagatgggttgagaacatatgctttagggtcataatatctgggcttgatcccacatctgccatgtattatctctgtggagttgggccggttgtgttacctttctgtgtcacttttcataccagtaaaatgaggataataatactatcttatgagatagttggaagcactaagggttaattgcaaagtagttaaaacaatggcaggaacatagcacttaataagtcttaattattatgctttcactaaaaaagatacatacatatatatgttcagtattttttatatatatatgtgcgtgtgtgtgtgtgtgtgtgtgtgtgtatcactaacggaacaccatgggaaaactaggaactctaaatttatttaaaaattattaccatattgaaatgggtgaagagatcataatgtgtcactagtatgcagattatttttctccttttgccctgttggtagaactactaaccctatgatgcagagaattgtcaaaagcatcaatacactggatacttcttgataagcctttcttttctgggtgacttagtttctgaaatttaaatgtgatgactgtaaaaaaatcctgaaaatgaaaaaaaatcaaacaataataagttttgtattattggatttttccagtacatgagagctcatcattcaggtctcttcctaagtctatgtcaatgatatccccttgaaagtttgaagtaggcaacgaagggagtattaataccacacaaataggttaacgctataaatctcgactttttggaaggctggttgttaaaaacttatcaacatgctgctatgtaatccctacatttgaagagtccaattgaattattctgtgctttgatgcactttttctagttttgtaataataaatgtaccatagtaattagtactacttaacagtatagaagtatttaccagtctataataaagctgtttatataaccacaaaaattgtttaagaaataatttcaagattcttctaagaatatacagttttgtgacaaggttgacctttagtagtcgactgtttctaaagaaatgttttcttataagaccctaaaacttagagtataataaaaaaaaaacataaaaaaaataaaaataaaaataaaaaggacaaacacatatataactcagaccaaaaaaaaaaaaaaaaaaaaaaaaaaaagattcttcttatgcagcccagattttggtaatacgtcttcaatgttaaaaatctggaccctgtgatgaaataatttgtgtaccaaaccccagcaccacgcaatttacccattttacaaacctgcacatggaccccctgaacctaaaataaaagctggaggaaaaacaaaatctggaccctgtcgccaggcaaaactatatttgagagatgcttcttcatttactagctaagtgattttcagcaacttgtttgtcctttatgatactgtgatctttaaaatggttgtttataataataatatagagtttttagaggctttaaagaaatgtctgtgaaattgaacgcagtgcctcacttcaaaagcctcacttatgtgtggattgatttgacagctgctgtatgatctgctttccaggattgtacatagaaagcatgctatcctgcctgcagatgccccaaattccacttgatcgtctagttagtggaattattttatttctattatctggaaaatttagtctaaaatgtgtatctatatgttatggttcagttatggttcagatgaataaatttcaagggatgttttgcctattagatgggtagaatcaacaactctataacttgagtgtggagaagatagacagtgggtaaaaatgtgtttagaatggagaaaattgacttgaagaaaatatactaagagcaaaatgtatcctatttgcctttagctcaggacgtttaacttttaacaagaaacacgctaaattttctcttaaaatagtttactctgaagtgttagatgaaagatatgatataaaacacatataaaagacaagaatcaacatagggacaaaacttttgggaatagggacaaatggacctgatgttcttttgagtataatcttaggcaggccaattcttcactaaggacttttgtttgcctcccttgcaatctctaaaatttcacaggatcctcctctgagcttgatttgtgaggttactgtaaatatgttacatttgcatagctctgaacagtattcaaatgctttttactctcattagctgagggaaacttcccatgagccaaagagcccatcaaagtaatgagggaagaacagaggtttcatccactgaatcacagcgaatgggaaacagaaatgtaattccacaaaggagacccaatagttcctagtaaggaagccaaggactattctctgatgactgctttcttgtggggttctagtcctttgatctacttttaagtaatagcaacattctaattaccaattcaatttaaaattcctaagccttgtaaaataggtaagtattagcaaatgttaaatttttatgagcaatgggaaaagggattgtagttgttgtttcttaatagatataaattatgtcttttatagttaatagcactaacaatttgctgtagcttagcatgttaaaaataaaacactctacctgtgtatacctctttgacctaccatcttcatagaaacaagataaacattatcattgtaaattttcccctatcaaaatgcatttttatttacataagtaatacaggaacacatgcaaattgtattaaaagttaaaatataatggagaaggctgattcttgaaaatgcttgaatttcacaaaaagatgaaaagctttaatctatgacccatgagcttgcccttaaatctggttaaaaattttggaaagttataagcaatcaaatgatgtatgaggatttactgacgagtcactggaagtagatgagaattcgtgaaaaatagctatttaaaaccagtatcctgccatttttaaaatgatatcactaagctggaagatcgaaaagatttggtaggaataaaaaaataaatttgtgctatccttaaggaaaatattaaggactgtaggttaacggggtagatttctagtgatgtaggagtatacctaaaatggaagagagatgaatgggtatcagttaacaggattgtttgccttagggtttgtaccttggcccttccctgttcaacatatttgttaaaggctgatgtaatctgacttgaggcgcagcccactagtaaacataagattcaactgtgatatggaagtctagctcccaacagtagtttaatgccaatccttattatagcatcactattccagaataagactctaatatctgactctgatgcctgattttatgatgttttacccaaaagttatatttatcatgctttgcctagcatgttggatggaaatgaaaaccatactacttgagggacatttaaagtaactgaagatgtttagactggagaatataagattaaatgggcagagaatggcagatttaatgggcaaaaactatgatacacacacacacacacacacacacacacacacacacataaaacttccatatctgagggtattaaactataaaataggtcttggtggaataaattaaaatgtggtgtaaaataaatataatttattttttatttaatctaagaaaaaatctttatactgtttatagattttcataattagaataattccctgtgaaggaatagctttttcaacacagaaaatgttccaattcagcttggaggatgacttttcagggtgattggtcatgggactcatgtgagttaataaaataatatccaagaacatttaaaaactgaagtcctcccctactccataagtctatggagaatttttattagtgtaatttttttggaagatattgatatttaattatctttattttaatgtgtacttattaaacttaatttagaaaattgggtgaaaaaagaaaatttaatgctctgtcacattggtacaatgttgtttctttcttttctaatatgtaatgatctctctttatttgtcttttatgtcttatctatgtttcctccaagtctttttagccatcacttaaaagttatgttatagagcattgtcaacttttcaactttttactaggaagcagtgattttttgattcaacattctaatggctggctttccttcattgaattttctgctttccctttagaaaatgtagtctgaattaataactcacacctaggaaatcctcattacttgctaccacaacctgtctttaaattttattattttattttatagacagggtatctctctgtcacctaggttgaagtgcagtggtgcaatcatagctctctgcatccttgaacttctgggctcaagcgagcctccttcctttgcctcccaagtagctggaactgcaggtgcgtgctgccatacctgactaaaatttttacttttatttttttttatagaaacagtcttactatgttgtccaggctggtcttgaactcctggcctcaagagatcctcctaccttgacctctcaaaatgctgggattacaagcatagccactatgcctggcctgaccccctctttctttaaaagcaaaatttgaagaagtctatgaagatctagaagggtatttccaatttctgtctaatgacatcccatctttgaaagaatttgtctcatctttctcagtcatcacagattatccaaaaaattatttgtaattattgaatcccttttattattcacttaaaaaatacaacataaatgctaatttcctgggcattcttaagctgacagagtgctgtatttctttctcatgtctcttattcctcaccataacagcctggaaaagcataccctccttaggacaattgggttctcgacttctactacactgtagtagaatagcaatgctgctactttccttggaggagtagagatatctggttcctgttttatagggacactggagtaaaatccactgtttatgatgaatgtggaaagggttgatacagctcagcaatgaataagcctcagagaatccatccttatgagagatattgtagaggcaaatctagtcaagtaacgttaatattagcatcaacaaacattaatatagttcatcacagtttataaagtttataaagagctctaaatgtcattcggagagccagtttgaaattgtgtataactatgaataattttcaggcagggaagctgatgttcaggaaatgtcagtgctctgacaaaagtagagcttcaggtcctctgtaggagaaaacccaggtaaatcaatgctttgtaaaacatttcggtatgtccatacttggacacatctgagatgtcactcatagcagcagtcatttccattttctttttttctctcttctttttctgtcaacttttcttctcactcctcctttcctttcttttactttccctcacttccagcctccaacttcttttacagctttactctcctactgatgttagcaataacttgcgtatagttttgacgcacgtcaagagcagttattttttttttctgttctaatctctgagaatctggccaaggggagacagtggcattataaagggaggaagtactggattcatatgagcgagtaaggtggtcttagagcaaagaagtgaaggcaggttagcatgaataaagataaccatggagacctgaacagtgatatatttaagaatactgacaaagaaatattagggaacatttagcagtaatcgcataatgacaggcatatggacatttttattaaagcccaggtagccagtctaaaatacactgtgtccaagttaatagcattgcagaaaacacactctcatgttgcctacatgggcacgttcaactcagacaaataatgctatcaatggtaattggaagtgctattatccatatctgaatgtgcctcaggtaccattagcagcagcactcttttcgttttgttttgatttttgctttctcaactgtagaattcacattatttttattaaaatttgtcttgcattaaaaattgtatttaataatcacgtctttctctcagtcaattaatgaagcccctgtccccccagctaaacagacttgcctcttttcaccacttaatttctaaagtgaagaaaaattatataaatagctaactgcacaaaattacatacgcataatattcaaagtattttaccagaaattatatagttataccattatcagccatattaggtagttgttaaaatccttaaatcattattctaattcaggctagtttaattcttttataacttcttaacctaatagttcttttattaattatttgcaaaattgactgtttaaacatttctcattgcagtttaatatgaaaactctgaacaaggacaatagtctcaatgttaaacagtagcctctacaatacttccactggactttttatgacatgcaaatatgccaaatgtcccacccaaccagtgttactgcagctatgattgcaacgtatgaccatgaaggaaacaattagtataccacaaataaattcagaaatgtctctccttatattcagcttatattcagctatgtggctgagaattcttggaatgaagaaaattaccttcttagaaagtttcccagttttttctttttccatttgagctatagttttaagagggagaaatgcatatgagccatattttgtctttacaactaattcacaaagaggtgaactaaaaattaccaaaatgtggattcatatgagccatattttgtctttataattaattcacaaagaagtaaactaaaaattacccaaatgtggattcatatgagccatattttgtctttacaattaattcacaaagaagtgaactaaaaattacccaaatgtggatttttagccagttataactcattagaaaatattagtagttggttgaacaaggaaacacagatatatgggggattaataattttgctatgtgggttaagaatagcctaaaataaatttctattgcttcattagaacagtgtcacctgttcatgagatcctgaaatgtgcctgaatgtaatgcaatggcatacaataaatgtttattatttgcctatcatatgtaagttattctgctgggacttttccaaggtacatttagggtagaaataatcactgggcagagtcaattataccttctccatgatcccacagcaaactggaaatgcctggtttgtagcctttaccatacttcatggaaattatctacttctatattccagttgctgtcactaggttttgaataacttgaaggcagattctatgtgtcttttttttatctttgtatagctacacaaactcagaggtgcatcatatatcatattgttttatttgattttgattgaagtaaccacaaaaccctatcctatcattttgaggggctattcagcctatgcccctcctccacttactcaacagtcccatgtggcttggtaaggctgtgtgtggagagagcctatttgtcttagatcagtcctcatcatcattcgtcatcatctaagcttgcctggtctcttaaagatagttgactcgattgtttttgtgctgagtttgagtactgaggtatttgttgaagttgggagccctgggctctagaatctagcctacctagatattttatgcagccattcacttctcagattctaccgtcttctcagagcagaagagggactctttctggtttagataaatgttaagtctttcccctagtttaaccttttaagaacttccttttcttcctcaaccctcctggaatgtctagcacaatgcactttgttttaggttataaaacaaaagacaagaatggagatggtctccaggaaacttaggctttcagccaattattatccccccattccaccccagtaaagtaggaccactaacttctggctaccttgctagaataagagagataaaagtataggagatatatgcacacattgacatctcagtacattttctaaccataattatatatctagtgcagggaaggttctgccacataatatatactcaataaagtgtgtggaatgactgaataaatgaatgggactcttcaacataaagaacagggtctattccattttcatttctattttagtattctatctagtattcaggattagcattgtacatgacaggaagcactcttctttaagctggaaatatgttcactactaatttatgaaaacttagctgttcttggacctattgctataggtctctgtgctatcttgagtaataaccagaggctatgctgtaacaaggcccccaacttagtatgtgcctttgctttctagttgaggattagtggataccacattctaactcaaaggaaagaggtttctgattgaaattttgggcatcatcctggtgggagaaatattttagaacggagcacagtgttagttgcattccctcacttcactggggcctaggcctactaacagtaactctgttgaaatgcattcttaggagaaacagtgaaatgaaatacatatacctgcacactaggaggcaggtgacctggaattttatctatcaccttcttgagcagtgttgtccacatccacaaatggggccacattacctatatattagactatgaatctctcttgaaatatttttctggctgggtggggtggctcacgcctataatcccagcgctttgagaggctgaggcagatggatcacgtgaggtcaagagttcgagaccagcctggccgacatggtgaaaccctatttctactaaaaatacaaaaattagccaggttttgtggtgggcatctgtaatcccagctacttgggaggctgaggccggagaattgcatgaacctgggaggcagaggttgcagtgagctgagattgtgccactgcactccagcctaggcaacagagcaaaactctctctcaataaaataaaataaaatattcttttctgtcttgtgatcccttagaatcttgataaaattatttcatagactagatatattgcagtcttgttgcattgtaaattagagttcctcatcttttctgattaaaatcaactttttttcactctaaaatattatgtgggaagttggaagttgctaaaagtacagatctttagagtactggagatgagggtccaattcttttctgttgtaagagtgataactgatttggatcagacagaaatgactttgctgtatatctgcaggacttagttatttggcttattcaaattttgaatacaaaataaaatttgagtgaaaaaaaggaaagggagattaatagaactaaaaaaattttcaaggaaatataagacaaaaataaatataatattagggttcatcaaaattatatacactggacaccaatctaaaattatgtttaaataatttcttcagttggctaaagtatttcaatgatactttcttgggaaggactcctaaggttttgtaacatactctttgtagcatatgtttttaattatattgaaaattaaaaatcattttatagatgtgggagtgtgtatgtgtgtgtgtgtgcattgtatgtatgcaagtttaactaattttaattttctgttaatgcatttttcaaaaaggggcattttgatgttcttggttgaactggtccagcaatataagaatgtgatattttagcaaatatgcaagctgactagcagatggtgtgattttgtgaaatatgtatattgtactcaggaggtcagccacagattttcctgttgtttgggtacagaagacaatgtcatcatctagaaataatacagaacatactttcatctttttgaatcagtttattttttcctgccatgaagatttagaatctcctcaaataaaaaaatacaaaacttgtctagaagaacgtgagaaagagaattgattctaattttctctatataaagtcttatttgggaggaaaaagaagaaaatatattaaaagcccttttacctgaaagaaagataattttctggaaaataggtagaccaagtgtatgtatttctcatttgatttctttgttgtcagctctttgcatggaatacagaagcttattgagttaacctttttcttgtgatatatgaggttgcttgtgttttgacaaacatattttgcatgcatagcatgaattttgaataaaagtctaattttaggtgcattgtctttcatgtaaaaattcttttaggatttaggcatctttggtcctatgcattgtatctgtggattcactacctatcgtcatagttcctgaaataagaaaatctcaagtttccacacttaataattttgcatttatatggaaaaaatgaataagaaaaatgcccacgtggtaaccccttggagatgaagagctagtatactctgagctactgtgagagctttagggtacagagtgcatgaggacatagggattcttttctgagcagagtttggagccctgtagctgactgctggggaaattagtttctaataaaaagaaaaacctgcagttcaagtcagactaacacttgaggtggaaatggtgactctcccagaaaactccctttggctctaaatctgagttttctcagcaacccacataaaatctttaaaagcgtaatggcatacctagttgttcacataaagactcttaatgagttgagaattctctgctttagtatgctttacattcaggttaaatagagttagtctccatgaaagttagcgctggttctgtgacaagtgactgaagactcctaaacagggtaaagtcaaaagggaatacaatgacttatagaaataagaatgttgtgggtgaggcagacttcagttggagtgtaatgaaggaactcaactggcaaaaccccaagcatgccatggttagctcttatttttactcagtctgcaactagactcctgaagccaaacatgggtggaagacaacccaagaccttgctggctggtctccctaaattatgttgattcccagcttcaagtgagacttaacggtgtttggtgatctaacaccacttgatttcccaagcactgtgagatgggtgactctttcgcaatgtttcctttctcctcattccttcactgcgtcttgcatatgttgctctcaattgatgactttgctttccatttcactgagaaaatagaagtcatcagaagagagtgtccatgtattctaaatatatccaatctatgtttgcgtcctgcatgctgtctcagcctctctatcaatgcacactggttcccattcctccttgagacgctaacagcattgttgcagcatctgtcttctgtctctcctgcatcatctatttttccctctgtgctagatcattctcaaccacatacaaatatgccataatactctcctatcttaaaagaatgcactttttgaactccctttccttttagatatcaccttattcttttagttgcttttactataaaacttctctataatgtagtcttatacagtctgtcttcactttcttttctaacaatccaacaaaactttgcttattaaggtctccaatgacctgtatggttatttctcaggccctaacttacttattagcgatatttggcatggttgtcataccctccttcatgaaacccaatcttcatttttcttttgggacacctcactggccactcctttcagtctcatttgctagtttcatctcatcctcctgatgccaaatgttggatttttcccacctcttagttctcacttctcttctctctttttgagagagaagatgatattcttcagtctcttagctttaaatactgtctctgtgttgatagctttcaaattgtttatttatatcccaaaattctgccccgagctttagagtcatatacactctgcttagatatctaatagatatctcatgtataacatgatatctattcatacattcatgtatgttccatacacatttgcctagttgtttccaaatttctcatttctcttcacagcctccttatgtcatcatacctctccagaaacatttcccatcttagtattacatcaaatgcattatttctttgttcaggcccaaagaaaataatacaaagtcactttcaacatctttctttctcctccctcacaatttacctctagtccatctacaaatcccattgactctaatttcaaaatataatcaaaatacagaaccttcactactaccatgccatgctggctcaaactaccattatgtctcccctagtctgtggcagtagcctctcagctgatctccttatttttatccctgttcttctacattctgtccttgacacaagcaaccagagtgatcctgatcaatctgtcatattaagtcacttatctgctccaactttttttttttttatggttttctctatcagaatagaggccaaagctctggaaatagtccataaggcctgaaagatctggcattggtgtgctcatctgctcttctctctcttgctcttgctgcaccagccatgctggccaacttttctgttgcttggacatttcaaacacattcctgacttgagatttgctgttctccctgcctcagatgttcttactctctaaatagcccattcacactaccctagctagtccttcccactttcctacacaattcttcacatcctctcttctcctttatgtactttttgcatcacttgttatcacttactgttttaaaaatttattgatatataatagttgtacatattttgaggatacatgtgatattttgatacatgcatgtaatatgtaatgatcaagtcagggtaattgggatatccatcacctcaaacatttatctgtgtgtgtgtgtgtgtgtgtgtgaattttgggaacattacagatcttctgtttaagatactttgaaatatacaataaagtagcctatggccataccacccgaaatgcacatgatctcatcttactattttctatctcactaaagtacaatatgtgctccctgagaatgggaatttcttttattttctgttgaatcctcagtgcctaaaacagtgctgaaagcaaagttttaaggtcaagattttagatatggtctaaagattctggatttcactatctgcagtattacctggtcaaactgatataattagactttccagtgctaagtggaaaatgaaatcaagtgtattttataaaattttaatataattgttatttgagaagaatataaaggttaatgtgaaaacttaataatatttgtctctcaaatattatgagcatattgctcaaagccgcttgcttaaagaggaacattatagcagcgtagggaaaacttggaagcagcctaaatgaacgcagcaggggctggctccattctttggtatgatcatgtaacggggtagttggcagcctttatagactgcactatcatttttattggcttcatattaatctataattagtttaaataaaccagtcattgtagtgtatatttgatccagtttttctcctttagaaacagtaatggacatccttatacacacttccatacatatttgcatacttgttgtcatattatccttagagcatttagtatttcactattacaaataatacttcagtgaatatccatgctcattcatcattgtcaccaactctacttatttttatagactgtattcctcgatgttggacacttggtaagagggaatacacatttcgagggctctttatacatcttacagaattgctttagagagtatcaatttatctttctttcagatttatattatagtgcctgattcatttcaagcttaaaaacacttggtattaggtttacaaaaaatttaagaagatattaaagattctaaaaatcttttcccaagtagattaggatgtgtacctacacaatttatggtatagtcagttctactataatgcttgttttgaaaacttggacttcttccaagattgatctattagggcacaatttgagtatcttgcaaaatttgcactttcttatatgtgattttatctgcaagcaacactaggtgaatagagaaaactgcacccagctgaaccaacaagtgaaggaatacaaaattcaaatacctaccagttacattaattcacctcttgtttatgagccacacctatgtatatctgattttgcaactttctatctgatttcagataacgttccttctgctacttcactgtaacattgtgatgttttggaacatgtgtgtctcaatacagtaaaactgacttcatgtgatttcaacatatatcataggttacgtctacactgggtattatttctgtgcatttgttaacagcttagataggtagcataggtagctgaatgctattcaatatgcacccctaatcctatctgctttttaattgtgcgtggagaaggcaaatgagaaagcagaaattgaaatggaaaaggaagtgttcagagtagttggtgtaagcaatattggaacacatctgtttgcaaaatatgctttagaggcttggagatgtgttctttcaggcattgctttccatcctgggtacaattgaatccttcagccccttagaaagataaagattagtctgaagctgatatacattttcaaggtagcagggacatgagtatttttcaagcaggtagtagagcaggatccatatcaatccttaaaactctgcaaacatagaattattttcatcagtttcaggcaagagagctgacttctctttacacagagtaaaccattacggggacatcaggaaagaccctttcctcaaagaggcattgtcaactcagtcaatgatgcctaaagagttccatcccacagctagagattaaactgcaagtgaagccatcctggatttcgtttctttgtgttctaatttagattcaggtgcaaatggtgtcaagtccacctaggaaaatttggaggataaatgaactggcaatgtgtagttgaagaagatagcttaaagggaaacaactggaagtaaacatagtcacagaaaatgacatatattgcctacttaacaggaagacagtggtctgacctcttaataaggcacaatgtccacaagtgagggtagacattgaaagaaacagaacctgagatgattttattgttcatggtcatttgtacagcctcgctctgttatccatttgcatctttgcctcttggtcccgcaagagcctctctcataaactttgagtagaagatcataaaaaattgttacttaaaaaaattgaagtcctaaaatttaccagctctgaaggaatataccatactgatatagaaagttcaatgaataggtagcaacagaaataagctttgataaacaaagaaaaccaaatgatgctatctgaaagcccggtctttgaaatcaggtggacttggcctcattctcacattccatttatgggttcacaacgtggaggatgtcactcagctgtcacgagactcacttcttctgtaaaagcacaactgatgaaaacacttgaaaggatttttttttaaatattgaatgagataaaatactgtgaaaatgttctataatgtttgacattggaaagggtaggaaatgaaggttaacagaagagtaaaaataagcaaatgaaaaaacgtaagaacattatgtcaaagctctacctttggaaatagatctcaccctagagatggacagatgatacagtctcaaatgcaaaaccaacaggtacatttgagattattaccaatatttagcgctgttatcttttgatttattcatgtattcatttagccctcaacaaatactgagtaactatttataagacattaagctaggttccagagataaagcaagagaccagtccctaaacttacttgtacagtaaattagaacagggaattctgtttgatatttgataccttagaattctgactattactggcaataataatacatatgtaataattactattgtgttagattgggctgctgtaataaaatatcataaacggagtggcttaaacaacagacgtttatttcccagagacagcactattcttatcatcgcctaccctcaggacctaatctaaacctacttacctcacaaaaggcatacctccaaataccattactttggaagttagggcttcaacacgcaaagtttaggagtacatattcagcccctaacacctatacactatcattaaggtagaagctccgcagaactttctctctcttatcctcaaaatcatctcctttagatagctattagtatcctcactttacagatgaaagctgagacccagaataggtgaattcattgcccccaaattccatgaccactaagtgtttataaatcagaatgaattaattggccaaaaattccatagccactaagtggcaggagcagatattgagacacaggcttgtctgtgattactcagcctgggctcttttaacactgtgccttttaataccattagagtagtattcacagaatatcattcagataggatgacagaggatggtcaattggtgaagccaggactattccttggattagtagaaatgcattaaaaaaaaaaaactcaaacatgtaagggaaggacacttgacattagaaaagatgaaatttctggagacacaattgtgtgtcacctaatcagctgtcacatcagggaaaaaatatcttggagaaatgttgaggtcgccaaacccagggagctttttaactgattcatttcatcttgcatgcatcccaatagttttagaagctgctggatagatttattacacaaagtctgtgtctctagctttcagcaatgtgggatttctttttctcagagcccactgatcaaaccctgcattcacacgtttactgatgtgtcatattttaacatccaggtctctgcacaatgccaagattatgcagttctatggagttaacttagaaattttgtcctcacacagtattctatagttgttaattttccatgcaaatgaaaacatttatataatttctgctgtttttatgtggtctcataaaatgtgaattacaaaactccatctttgaatttcctgtgctgctccactttcattctctgtaaggaatatttgccagaggaaggtctatgttgtactttcgtagccaactagaatgttaaaaggattggagaggagatttactgcatatttgtgattattgttttttgggagtgagctgaggtcccaaaccacctattccaagcccatgctgtggcagaggttggaaagaggcttcttgactctacttgtcctctagccaagagggaggctctccctagcatgacccttaggcctcacctccacatctctctgtctctggcataggttattggtcattatgtcacctctttcttggtaggaccccagagaatttcacatcctaatcacaagggatataaaaactgtcaagttctatggatccttttcacttttccttcatgttttaatgtagttgttcctcttctgtaatagcaatgatcacaccatataggtattaaaaatatgttccttctttttcctactggaatgtccattccttgagggcatatctattgtctgtgcagctgcagtgcccaacacaatgcctaacatgtgggtgctcagtgggtgtttgctaaattaatttaaactgtattgcccttagtaatggcagtcggagtagaaacagcaaaataaataggtattacagaggctgaatgtcaaagcttgacactgattaaatgcagggtgtgaaaaaaagaaaaagtcaagtgtgaaaaatatagataacaaactgagtgacatggatagaatgcagaaattcttctgataaaataaaaatagtagctaaaatttattgaacagttactatgtgctaggcactgtgctatgtgctttgcatgtattctctctttaaatcccaacccaataacctgttttactaatgagagactaatcaaaatgccaagtaattgataatgccaggatttggagtaagccctatttctctgtattctgtaaaaccagaatttctcaaagtgtgatttaggagctacataaaccgaaaagcatatggaagtggtggttaaaatgtgtattcctgagtttcatctcaaacctgtcactgaatcagaagctctgggtgtgaatccaaggattctgcatgtttaaaacacgccaagcaagtctgttgtcagctaaatctttagaagtagtggatttaattagatttagtaaacttttatgaagcttctataagattgcagaatttggcccaggcgtgggagttataggaatacacataattcctttccccaagaactattgaattaataggaaaaaacaaaccatcatagcacactgtaataagtacttgagtagctttgggatctggcaaactaatcaaggaacgagtaactctggacatgagcaaatttgaagtgagaaaggagacagagtctgaaaaacccaccagggagctgcaaatgtggaaccactgagacaggtcaggattgaatataatggtcatccatgtagagataaaagttgaagggtgcaggcagtaagaatgccaaggataagatttgaaaataagaggatcaatagattgcaaaaaatttcttccattgtgtaggttgcctgttcactctgattatagcttcttttgctgtgcagaagctctttagtttaattagatcccatgtattaatcttggattttgttgcaattgcttttggtgttttagtcataaagtctttgcccgtgcctaggttttcttttagggtttttattgttttaggtcttacgtttaagtctttaatccgacttgaattaatttttgtataagatgtaaggaaggggtccagtttcagttttctgcatatggctagccagttttcccaaaaccacttattaaataggggatcatttccccattgcttgtttttgtcagatttgtcaaagatcagatggttgtagatgtggtgttatttctgaagcctctgttttaaagttccatctgtttatatatctgttttggtaccagtaccatgctgttttggttactgtagccttgtagtatagtttgaagtcaggtagcatgatgcctccagctttgttcttttttcttaggattgtcttggctatccaggttttttttggttccataagaaattaaaagtagtttttttctaattctttgaagaaagccaatggtagcttgatgggaatagtattaaatctgtaattactttgggcagtatggccatttttatgatattgagtctttctatccatgagcatggactatttttccatttgtttgtatcctgtctgatttccttcagcagtggttggtagttctccttgaagaggtccttcacatcctttgtaagttgtattcctagttgtattttattctctttgtagcatttgtgaatcggagtttgttcatgatttggctgtctactatttgtgtataggaatgcttgtgatttttccacattgattttgtatcctgagactttcccgaagttgcttatcagctttaggggttttggggctgagatgagattttctaaatatataatcatgtcatctgcaaacagagataatttgactcctctcttcctacttatataccctttatttctttttcttgccagattgtcctgaccagaacttccaatactgtgttgaacgggagtggtgagagagggcctccttgtcttgtgctggttttcaaagagaatgcttccagcttttgcccattcagtatgatattggctgtgggtttgtcataaatagatcttattattttgagatatgttccatcaatacctagtttattgagtgtttttagcatgaaggggtgttgaattttatcaaaggccttttcagcatctattgagataatcatgtggtttttgttattggttctgtttatgtgatggattatgcttattgatttgcatatgttgaaccagccttgcatcccaggtatgaattcaacttgatcatggtggataagctttttgatgtgctgctggattcagtttgccagtattttattgaggattttcacatcgatgttcgtcaggcatattggcctgaaattttctctttttgttgtatctctgccaggttttggtatcaggatgatgctggcctcataaaatgagttagggaggagtccctctttttctattgtttggaatagtttcagagagctaatatccagaatctacaaagaacttaagcaaatttacaagaaaaaaaaaccctctcaaaaagtgggcgaagtatatgaacagacacttttcaaaagaagacatttatgcagccaacaaacacatgaagaaaagcccatcatctctggtcattacagaaatgcaaatcaaaactaaaatgagatactatctcatgccagttagaatggtgatcattaaaaagtcaggaaacaacatatgctggagaagatgtggagaaatagggacacttttacactgttggtgggagtgtaaattagttcaaccattgttgaagacagtgtggggattcttcaaggatctagaattagaaataccatttgacccagcaacccagcaattccattactgggcatatacccaaaggattataaatcattcttctataaagacatatgcacacgtatgtttattgcagcagtattcacaatagcaaagacttggaaccaacccaaatgtccatcaatgttagactggataaaaaaaatgtggcacatatacaccatggaatactatgcctccgtaaaaaagaatgagttcatgccctttacaaggacatggatgaagctggaaaccatcattctcaccaaactaacccaagaacagaaaaccaaacagcgcatgttctcctaagtgggagttgaacaaagagaacacatgaacacagggaggggaatatcacacagtggggcctgctgggggttggggggcaaggggagagataacattaggagaaatacctaatgtagatgacatgttgatgggtgcagcaaaccaccatggcacatgtatacctatgtaacaaaccacattctgcacatatatcccagaacttaaaatataatgaaaaattaaataattaaaaacaagaggaccaggaagaaatccttggagattacttctcatctgacattttattctccaaagcctagttccctgaataagcaaaccaccataagcaattaaattgcccttttaaacggccaagaacttcagatcactttatgagttttctttgccaaaggagagttttggaagtcatttggttaacatgttacatttcaaagatgactttaagagggaaatgtgacatcactgaatggcaaagttgtgttttagatagtttcttcctaaagtgtatgctttaacaatctcattactctgagttagatacttttgcactatgaaatcctagtaaactattaattctgtggataaataaaaacctagccctgctatcctcacacaccacactcactattctgtgatgccatttaactcttccattaaagtactgttactgtgcctgtgaatgccaagaaaaaagaaggatcaatttaaattgcctaaaaatgctagaatgtatttccctagatctaatgggtaatggcactgacagcttcaaatatgtttcataaagagttcgatattactgttcttgcctactaatatccggattattgaagaattaataaggaggtattacctttgagaacaagaaacatatcttctcctttcaaagggacaataacaagatagtctgctgggaagcatcttcaaaacatgaaagaagagaatttggagtcagtgccattttgccttccatgtttgcttgatgtataaagcaaaggcaagatagtctcttttttggtttggaaaaaagagaaaaatgaatatttccttgttcaggaatcatgaagtgactgcacaggccattgaaatgctttgataacttgcatagtatgtatttttaaatgtagtttggtagaagagaaatgccactgattgaaattcaggaagcttgagttctagtattgctgctgatatatatgaactgtgtgatgccgtagaaataagccatttacccttaactttttagtacataaaatataaggcatggactagatatctaagactctttatagctcccagttgattaatcaaattagcatttactcagggctcattactttaggatataaagtaataaatacttaagtagggttctcttctcaaagtacttacagcctacatttctgccccacctgaaattcaggcttactaagaaagaaaaaataaccagacagaaaacaactccttaagtaactcataacttgacttctaaattaataaatttatttttcttttcacaatgcagaaaatttgtaccagctttaaaaatatgcatgcaatagtagaaagagtattcatatttcaggttacatttttgttaaaggcatgtcaacgagtgcaaaaacattcaagggcataagtatggctatagaatatagatgtttatagctatatatatgtatgcatgattcacaaagtcttgtgttgattaatgtgactgcttatgtttgacatatgaacagatataaaatgtatatacagaaacaaacaaggtaaatatgaatgataagtatgaaaatataccagggatattttagaagcttctgagaagcacatgttttttaatcagaatcaatggatggattataagctttctaacaagctttcctttaattgatgaataatatggtaagtacaattatgcaaatactttagagaatgagaaggtatagaaaggattctgtaaaactggaagaattacataaaacatttcctcaagcttttctttccaaccctttccaatgagattttaagcataagaggatttcagtctgaaatgcaaggacaaaaatgtaagattacagcaattcttagttagccttacttttggcccttgtagttcatggatatagaggagaggaagaagtgtttccttgaggcttgaagagtattagtcacaggagaagatgtttagggttacaaattattttgtgtctgagttgactgccttatcccaaatgacaaaggtggccatctatagcttaatacacacatgtgcacatacatacaggcacacacacacatacatatgctgcatatgtttatttacaatatgcaaggtcctctaaagtgcaagaccgatggcagggatttaagagtagaaatcttaatagtcaatgaaaatccctagacttcttttgatttgccctgctgttaaacatgcactagatttcgctattttgtaaaagtctaatgtatgcctttgtcatttcccattaatacattccattttaaagttcgatgagagttcttcccgactaaaataaactttttgaaatagaaatgttttattccgaattaccactatgaattacacatgaattttataatcattcctccttggcttttaaatattcagcaaatggtcaaagactgttttcatcgactgggcaggaaaccattcaagtttgtagatggctcatgtggtgagattttatgaatctaacctgtccgtttcacacatacaaatgctttttccatgatttttgaaatcctcacttataaagcagtgaaattactatgaactctcgtgttatcttcaggtagataactaaacactcttttggccaaaatataggaatgaaaagacaaatagagtctcaaagctggaatataatcgatgctggaattagactttcaccaagtaatcctaaaaatacatcatagtaagtgttgatttgaaagaaatactgtcatttctcaataaggtgttgaactaattacccttaaactgcctttgagtcactttctgtgattttcatgagatggtaatgttggtatatattgttttaagcaatgcattaatgcttgccaaatattaagtgaaaaaataaaaagcaaagtgaaaattttatctattctttcaagatcaaccttatgtgaattgttcaagctgaatagcattgaactacccatacatacttccatgttagactcagaattttaaaactggaaaaaaaaaagcctgcagataatttactttttttagcagcagaaaatgttctgatagaactttatattaatgtggaaggtcagtatatagaagagatcaacataacactaatttgctggaaagtgttaaaaagttgggaaaggcaatacaagaaccactccacctacagtaacacttgaaggaattccacataacttgaaaacacagattacagttcaaacttctcaatttacaaagtaagaaactgaagtcaagaaaagttcagtgacttgacacagtaatgtttgagtttgcaaacatgagaagttacagaaggtattctggaccttctagatcttcaaaataggaaaccgaaatccaggacagttcagtgacttactctaaagagtccgtgactctctctacaacacagccagagctgggagtcagagctcctgtctttcatttttttaatgcagtggcttttcccaggtcttcctgtgtttgttctcctttcaccgaatttgaggtagaaaacattctgttgttcttttctccacatgatctccctgaagggtttatatgcttgtcaccagcaactacagtttctctgaattgttttcaagccccagtggacaaatatgataaaaagaaaaggaaggtaaatatgtttatcaactatttataactcatgtgctgtttacacaagctcttacaatttccaatgaattctcctactccttaaggctatcctggtgagccatccctgcaggtaggatatatatatatatatatatatatatatatatatatatatatatatatatataattttatatatatatatataattttatatatatataattttatatatataataatatgaaatacatattatacataaaataatatatactttatatattatataaaatatgttatatattttatgtattatatattttacatatatatatatatatatatatatatatatatataccatttttgctattgaggaatcttttttttattaaactgagaagtcatatatacttgcgtgtctggaaatacatctgtaataactgaccctacccttcgttgccttcaattgtaaaatcatatttgttaatggatttcactttgcaagtctcaagcttttacacagacatattgctttttttcagctcatcacaaagcctatagagataggaacctattgctttaattacagcagagagataatctttacctctctgaggcatagtccaggtaacagacgcctggagtctgcttaccactaaagactttgtgaccttgggcaatgtacttaacctctctacgccttatttttctcttgtgaaaaatgaacatgggactaatacataattgaatacatgaatggatagatctactattttcttttgtgttttccttcgagatgtgtgtgtgtgtgtgtgtgtgtgtgtgtatagtttatgtatttaaaattgtttttaatgttataataatatgccagccactcttagcttgctcatttataattaggaaaatgacatttccccacactattaaaggcatatttttaaaatctttgtttaaatagcctttttcttttgagttatgttttgagaatactgagtctctatttgttgatgttttaagcctttattttaggttcaggggtacatgtgcaggtttgttatgtaggtaaactgcatcacaggagtttgttttacaggttatttcatcacccaggttataaggacagtacccaataggtatttttttttttctgatcttctcccttctcccaccctccactcagaaaaaggcccaagcgtctgtggttccgttttttctgtccatgtgttcttgttgtttagctcccgcttataagtgagaacatgtggtatttggttttctgtttctgcgttagtttgctaaggatgatggccttcgactccatccacgttgctttagaggacatgatctcattattttatggctgtgtaatactccatggtttgtgtgtgtgtgtgtgtgtgtgtgtgtgtgtgtgtgtatacatatatacacacacatatatatgcatatgtgtatatgtatgtgtgtgtatatatatacgtatatacatacatgtataaaaaatgtgatatatgataaagaaaatgtgatatatatatacacattcttttatatatgtatatatgatatatatatatacctattcttttggatatatactcaatgatgggattgctaagtcaaacggcaattctcttttcagctctttgaggaatcttcataatggctgaactaatttacatttccaccagcagggtataaggattttcttctctccacaacctcaccagcacctgttattttttgactttttaataatagtcattctgattagtgtgagatggtatctcattgcggttttgatttgcatttctctaatgattagtgatattgagcattttttcatattcttgttgactgtatgtatgtcttcttttgaacagtgtcttttcaagtcctttgcctagtttttaatggggttgtttagtattttttttgtaaatttaagttcattatagattctggatattatgcctttgtcagatattatgcctttgtcaaatattttatcccattctgtaggctgtctgttcattctcttgatagtttcttttcatgcagaggctctttagtttaattaggttccatttctcaatttttgtttctattgcaattgtttttggcttcttcatcctgaaatctttgccaggtcctatgtttagaatggtatttcctagcctatcttccaaggtttttaaatagttttaggtttaatatttaagtctttaatccatcttgagttgatttttgtatatagcttcaggaaggggtccagtttcaatcttctgcatatggctaggcagttattccaggaccatttattaaatagggagtcttttcccctttgcttgtcatgttgttttgtagtagtagtaactggtggtaagtatgcagcattatttctgggctctctattctattttatttgtctaagtgtctgcttttgtaccagtaccatgctgctgtggttactgtagccttgtagtatagttagaaattgggtaatgtgatgcctccagcttcgttctttctgcttaggattaccttggctatttaggctctttttcttttttggttccatgtaaattttaaaatagtttttttttctaagtctgtgaaaaatatgattagtagtttgatagaaatagcattgagtctataaattgctttgcgcaatgtactagtcagggttctctagagggacgaaatgaataggtcagacgtatatatgaaagggagttaattaaaaataactgactcacatgatcactaggtgaagtcccacaataggccatctgcaaattgaggagcaaggaaaccagcagtggctcattccgagtccagaaacctcaaaagtagggaaaccaactttgtagccttcagtctgtggccaaaggcctgagagcgcctggcaaattactggtgtaagttcaagagtgaaaaagctgaaaaacttagagtctgatgttcaagggcaggaagcatccagcacaggagaaagatgaaggccagaagactcagcaagtcagcttcttccaccttcttctgcctgctttatctagccacgctggcagcagagtggatggtgcccacccccattgtggatgggtcttcctgagggtgggtcttcctctcccagtacactgactcaaatgttaatttcttctgttaacacccagaaacacccagatacacccggaaacaatattttttgcatccttcaatccaatcaagttgacacttatccatcgtgggcaatatggccattttaatgatactgattcttcctatccgtgaccatggaatgttttccatttttttgtgtcatatttaatttctttcagcagcgatttgtaattcttgttgtagagatctttcaccttcctggttaggtgtattcctaggaattttattctttttgtggcaattctgaatgggattgtgttcctaatttgactctcggcctggatgttgttggtatataggaatactactgatttttgtacattgattttgtatcttgaaactttgctgaagttgtttatcagatcaaggagcttttggacagagacgttggggttctctaaatatagaatcatgttatccacaaatagggacagcttgaattcttctcttcctatttggatacattttattttatccttctacccgattgctccagccaggacctccagtactatgttgaataggaatggcttggaaattttttaaatgcaaaaaggaaaagagatatatctatacttgcataaccattgaacactttcaccttggcatgtttacttccagaggcagttttccaaaaaaacaaaaactttcagaccaggtatagtggcttatgcctgtaatttcagcactttaggaggctgaggcaggaggactgcttgagcccagaagttcaagacaaacttgtgcaacatagtagatgccatctctaaaacaaaataaatacatttgccaagcatggtggcgtgcgcctgtaatctcagctactcaggagagtgacatgggaggagcacttgagcctgggaggtcgaggctgcagtgagccatgattataccattgcactccagcctgggcaatggagagacattgtgtctaaataaataaatacatacatgttcatgtttttattcaagggcataattgatgaagtccctgctgaaaaagaacatctctcatagcagatttaccttctcattcctcctctcatttgcccacctttggatctttagtatctaaagtatttgtttcaccctgttcaggtttataatgatggaattcttttcagtaaccattatttccattgtgtttacttttatttctatatataaccatattcaaaacataccaccaattattttactacaatgcctaactgggtggctgatgttcttaattgcttagattttgttgttaggtttattctagaaagtgctgtatttcctgagcacttttcataattgacaaagtggatttgtatataaaagattctgtataatattcttgggtaacattactccattgtattctgatattggatattatcatatggaaatctgattccctttcacttcttgtagatgtgttttgattttggtttttctttctggatgttcaaataatttactcttcatcttatatcttatatatctttacgcctcatcttgtatcttaaataagatatatctctatcttttgagatttatgtactcagtttcccggaaacacagtctttcaatctgaaaatttattttcccagaaaagtatcctattctttaactttgaatatatattctgtcccatttgtgggcttatggcatcaggaatgccagttattttaatactgcatcatctttctttgtactctttttttttgtacaaactcagccctaattactttaattccttcacccttctcatttacattcactctgatgatatcgagtctgatacatgttggtaatttgatatttggtggcatctattatgagacttgtactttctaatttatgtattagttatataatgatgttgttttggtccttgattcatttccttaggtccactaactcccttttcatttaattctgttgttttatcctccagtctttgacctctagctctattgaatttattttcattttaaatgaatccattgtgtgaagcaacttgaaaaatttctttgtgtctctaccctatattttcttctggattaagttctttgtttcttaaattaaatctctctcttctcttcctccctccccatcccccctttttctttcactcttttgcattattgttggctgtattatgtttctatatttactatgcctgtcttttatcttgatcatgtgggagtggcactgtccagacattctacttgctctaatgtagtataggttacttctagacttacttgtcatccttcttgggatcccttaagctccagtttgaagtctggatgtttcacgttttgtgtacttttaaataaccaggcatggtaggggaatgagtttagttgaagcagcattcaaactcatttaggatacctagctttgctggctagtactgtctcctactcttgtttgtgggagaaggggctgttctcaagtttccaattagctgttcatttcattgatggtccataagccttaccttactcaaaccaacctccatcccctgtgtgtctcctcaacagtaattgcaacttcttctcaatcagaaaaggaaatgccaggcacgatggctcatgcctaatcccagcactttgggaggctgaggtgcgaagatcacttgaggtcaggagtttgagaccagcttggccaatgtggcaaaaccgtgtctccactaaaaatacaaaaattagtagagcgtgatggtgtgcacctgtaatcccagctactcggaaggctgaggcaggagaagcacttgaacctgggaggtggaggttgtagtgagccgagatcgaaccactgcactccagcctgggcaacagagcaagactccatctcaaacaaaatcaaaaacaaacaaacaaacaaaacaaaacaacagaaaagaaaaggaaaacttggggctattcataattttgcattcattgatgttcggcggtgttagtgagaattcttagactttcccccaaatttcaggaaaatttctggggtttaagggaagataagaaagtaaatcctttttctgttttactccagaaacacttgttttgattttgttgtttttatttgctattgctatgctttcttttcattctttgactgctgtgggtgatttttatgtgtcgatgtatatactaggatttactttttatttcattaggaattaagagagggaaattcagttatgtgttataatctaccattccctcatagaaaatctactaataagaaatgggaaaaacaaattttctattatgttttagtgtacttctgtaatgcagttaaaaagacagagaaatagttctcatgcatgacagaaacatttattctacgcttttagaatagccacatcttttcctctcaaataccaacagggaatactagaaaatatttgactgaggaaaaataatagctctcaaatttctgtcagtatgcattgtttgggaacaggataatttattttggatatttattatttgtggcatcaaacaacacacatgatttaacacttaaatcttgttttccttaacatggtctcatttagttcacagctaaaacagaaaattcgacaaagaaagacgtttatcaattgtatatgtatggatatatatttgtgtgagtctatgtgtgtgcaggacactttattctgtgtgatcatatattttatatagaagaagagtggtccctcagtatttgtgggggataggatctaggtctaggatctcctgcagataccataatctgtgaatgctcaaattcctgatatataatgttgtaatatttgcatataacctacgtcaatcctcccatatattttaaatcatctctagattactcatacttaatgcagtgtaaatgctgtgtaaatagttattaagctgcatttacatattttattttttatagttgtattgttatttttttatctgcagtcggttgaatccttgactgtagaacccacagatatatatgaaggaccagctatataaaatcttaattctcattagagaatgtataaaattatctcatatgagaatatatatataaatataaatatgtgtgtatatgtaggctcacacacacacgcaagcttaattgttggagagttgccaataactatcaaaagccatcaatagcacatgaattatttccagccactatattaacaaaagcgtagcaataatgtcagtaagtatatagaatttggacccagagataatcctcccattattattatcacaggcttgaacctcacaaaattgtgctctcagtttgatcctaggctccacaattagagagatggaaagcttagtctggatttagaaagaagcaactctgattacaggaagagctggaactaaggaagggcaatgggattatttgtctggctaaagaaaattgtgtggagagatctagaatcgtttcctagcatatatgaaggacactaaatgttcttcattcccacagcacatacagctgaatttttagatagaagtgtttctcagcaaattgtgctcacgagaagtatactattagggtttgaaaataaaattcaaaggtctaacattttatttctctaggattattaaaatattgtcattgccaatgatagcagaatagcttactatttgtcctaatattctataggtgcaattggtatgaactttagaataaaagaatccccttatatcttaaatgttgttccccgcttagattttccaaagcgattactcatctgcagccagaagatgactgattgccaagggatttgccgttgaggactgaactacacttatgcctggtcatctataaatatttatgaagcacctatcccatgcttggccttggggacacaaagataaataagacaatccatgttcttaaggcgttagtagcttagtgaattcatatccagattgatgccacaatgggatgaattgctgtagaaccaactgcttttctgtcatgtggttttcagtaataatatatttactttcatttgagaaaacatgtataaaagtaaatatcccacttgggcttacacctgtgtcaggaaaaaagttaatacatattccagaaattgtcagagcacccaagcacattcccctcatcatggaaataatcactgccagatgagattgaaacatcttttggaatagaaaatgcttagaatgaaatccataccttgaaatccatttttctagtacagtagaagggccattcattattaatagaatgtaacttaagtatgcttttatttccaacgtgtaatacattctactctcttaaggctagaaaccaacttaacctaaatgtttagacagtatagtcaggtatgtgtgagagacactcgtatggagaatcaaatgcaaatctcaacaaccaatcctatgagagagtacagatatgtaggtaggagaaagtaaactagagagaaatattaagcagacttcaagtcacttgtcacgtaagaaaaggccgggagagaagctctgaataggacagaagatgcatcatcacagcaccttccttaaaaaagaggggaaggaaggagtatgcatttaaagatcaagttagccaaatacaagttactttggcaacaaaagttggtgcaggaagaatagaaactatcgggttgcatttctcatctcacacttgacaagtctcttagaaataccgttacctagaatgagaattttgttaaggtatgtttaacatggaagcttgtatttataaagaatatttttcctcttaggtgtattagtccattctcacactgctataaaggtactacctgagactgagtaacttataaagaaaagaatgtttaattgactcagttctgcatggctggggaagcctttggaatctcacaatcacggcgaaaggcaaaggggaagttagatacatgtcttcacaaagcggcaggagacaggaagtgccacagtttaaaaccatcagctctcctgagaactcactatcatgagaacagcatgggggaactgcccctatgatccagtcatctcccaccagatccctttctcaacacacggggattacaattcgagatgagatttgggtgggcacacagagctaaaccacaccaatatgttatctccaaacctgcattcaatgccagatggcttccttcgtagtaatctgaatgtggttgcatgtgaaacaatggctccttaaagtgaaattatctgtttatactattttgatactgcacttgaaataacccatttgttttggatttagaggtagcccaatttggcagcaaactcatcctagacatttggtgtgattagtcttttcaaatatatgcattccagagaagattaatggccttattatgtccagtatttcaacaaaaatgaacaaatgaagtccaaaggcacatggctccagggaaactagctggctttccactgttctcagggcagaatcacagccactcaaagattatggttatttttttttctcctaataaaatctgttcatcaatctggttttttactcagtttgtgttgttcagtcaccagagtggtttgtgctgcctattgttaatttaaaccaactgcatggttttaaaaatgcattctttgtcatttcaaagagctgtggtaattctttggaatatagtgttttcaaagttcagataatgcagagaatactatatatattacagtgatattttaaaattgacccatatttattacatacctaagtaactggaaaagaatagctgaatagctaagtaacttctaaaagtaaaaaaaaaaaaaaaaaaaaaaaagcaagtcttcacctatatggggtgttgctgaaaatacttatgggcatttattatgcgaaataaaacccataatactatttaagctgttgatgatgactttgtttggagctcaaatcacagaagaaatttcattgtacagaattcaaatgggtagtcatggcatagaaacgtttaaaaagaaaaacagataaatttaaagaaaacttttacccaaatttaaggtttgcctgtacaactcttaacaattgcagtctggaagtctcccttatgtattatacctttctaaatatgataaacacttttaaaaaacagaattatattttttctacatttctatcacttattagttttggttgggattccttgtctcagccccccataaaaatgattctttatgtatatactagaagtacttgcaaaggtcctaggaaacccagatctgatggaaatgtggacaatttatttctggccatggattttattttattccagagaaggaaagtacaactgaaatcaatatcttgcctgaaattcttgaaacattgtacatgtgtatgaagcttttctctgaaatggactaatactatgtaaatggaacaatttgataaacttaaaaattcatggtacttttattagtcattaggaaattgctgccaaccaaaaagcctaaagtagtgaaatgagtccttccacagaagtgggagaaagcgtaatgtgcaaagggatttaaaaaacaaacaaacatatgcttcaggctccatctttaagaaccttaatctggttggtaaatagtgatatatgtgaaagataacttatataataagtagtgtaaaagttgaccacagagatagaccactgcaagaagcagaagaaagctactctcagcttcatggaacgttatggaaaagggatatgtgagctgcttcttggagaataaatagaacatataacatctgaggaatgcaattccagacagaaatccatggccagaaatgtgctgaagaaatatatccatggccattgatgaatcatattcactctttagtcagtttttctatctgtaaaataaaacaattatattaaatcatcctaaagagccattttaactattatatcctgttttaatagcaagtagaattagtttaagtagattaaatgatttctacagaaaaggaatgagaaaaaataagatttgagcagggaagtttttaacctctgagttattaaatataaagttacaagcttggtctttattctgtggacattgaaagctcattgacaacattttgagaacagaagtggtataatgaaagttttctcataattttttaaaatggtacttcccattaccctttaattagagatgactttatcaatttgtgttgagaatataggactccagagctgtgaatagtataacatgattatactttgatcctaaattctaggaagcaatcccaaaatgggacaaatagatcccagatcctagtctgatcatcactgagaaaaaaacagagatcaaaaaagggaaaattgggtaaactttatttgtctgctgccttgcagaatagtgtaatcatcaaaaatatattcagttacatattgatttcatgttagcctgatagagccacttccactgagaagtcacatactagtgtcaagataaagcacatgcacaaataaatacagtgcagaagaaaccaagtcttaaaataaataccacagggtttccaaaaggagagaaaatttttcaagaaaaaatcaggacatccttcttggagaagtagcctcatgaaggataggtagggtgtctgtattagtccattctcatgctgctgataaatacatacctgagactgggcaatttataaaggaaagaggtttaattgactcacagttcagcatggctggggaggcctcaggaaacttacagtcttggtggaaggggaggcaaacatgtctttgttcacatggtggcagcaaggagaagtgtggagccaaagggggaaaagcctcttataaaaccatcagatcttgtgagaactcgctcactatcatgagaacagcacgagggtaactgtctccatgattaaattacctcctactggttccctcccatgacatgtgaagattatgggaactataattcaagatgagatttgggtggagacgtagccaaactgtatcagtgtatatattatagagtgaaacagtaaacatttcagggtgagaaaatagaatttacaaagacttagaattagaaaagggtcatttgtttcattgagccatggggtatatgtaagtcacgtgtggatgataagtttaacaagtaagcagtaatttggtcatgtattatttaaaagaaaggcagaagagctttaacctaattcctaatccaacccaagcctgtatgtttagacctttttaagaccctctcccatgttatgtaagtattttaattccttttgctcagcgaacttggaagatatgctttaatatttctgaaaagtattctaaaataatcaatacccgttattttctctaaatagtcatggtacctcattcttcactctttattttttcttatcattaattgacttttttatgacaagaaaataatattattttgtagatatatcatttccatggcattatccgaacttcttctactcatcttctaccaatattgccacagcaaaggatgaaaatatgcattttgttgcttgagttttttattggcatcagtagcaaatctttgttgagcatgtactaaggatgaggcattgtactaggcattgagatatggagaaaaatccttagcccttgtctttatgatatagtccactgatgactgataacactgcctaatagacagtatatttcagaaaacatgagacttagactcattttttttttttaagacagagccttgctctgtcacccaggctggagagcagtggcacaatagcggctcactgcaaactctacctcccagattcaagcgattctcatgcctcagcctcccaaatacctgggattacaggcatgtgccaccacacctggcttatttttatttgttgctgttgttgttgttgttgttgctgctgtttagtagagatggggtttcactatgttggccaggctggtcttgaactcctggcctctagggatctgcccacctctgcttcccaaagtgtggctgagccacagtacctggttagacttagactcatttctgattcacaatattgctgtttggtacttcaactccccatttaagtgagaaaagttattttttcccttgcctgctgtctgatatactgtgaaagttagagaatctgaatagaaataaagatatcaagatagccagagaagacaaggtgtccagtgtgatgacggaagcctaagaaatatgagaaaattacaaaatatagattagaactcacatatacgtttgtaatcaggaaataattgttgaggcatccctgtggtacttaacaatattacaactataataatacggctaaatcagattattttccccttggttaatcagaaatcactctattttattaatcaatgtaagagaaggttttagggattcactacgtgatcagctttgctttatttagttccattgagagataataaacaggaaaatgagtcctacaaccccaagttggaaaaacagtgaatctgtgtgaaactgttagaaaacagcaatcacttaaactcaatcatttgttttttgagaaattctgttatgtagagcacactatttttgacattgagaatatagaaaactactctaattggagaataaggaaataacaaaattgaaaaaaagcaagaggctacatacatacacataaacagacataccacatttatgtattttagtatagttacatacaataattatgtttgctaccagtgatgtattgtaatatatttttgcatttattttatttatcatgcaattatgcactgttatttgcaaacattaactgtcattattctcaattcttatctcgaggttatagatgaggatagtaacagaggcactcgcagtgagagaaggacttgagatttaaatccagcccaatctggctccattatttgggctcttgaaacttctcttttctcttcttcaatataaatttggtgttctcttctctccctttctcttctccctctatattcctaatcctttctattcctactctctctttctctctctgtgtgtgtgtttgtatacatacgtaaacgtatatatttaaattttagtctcaacccagtcaattgatttcaagttctaatggatgtgacccaaattttgaaaaactctaatgtagacataatgatttcagaaacagaaaggatggatagattcaggtaacttttatggtaccaggaaagaagaacttaaataataaagggaaaggagggttagaaaggtgattttatttaatgactctaattgcttatcacaattatctctcaggctctggaagtattattgcagtatctttctgccagaagtttcaagtggcaaaagagacagttatagcaaatcactttagtacataggcagggaatcagactgtctggcttcataatttacaagctgtgtaatttggggaaagttatttaaacaccttgtacttcaatctctccatttgtaaagtggggataatagaacctgcttcaggtagtgggagagataataataaatataaagggcttaggataataaactctgcattgtcagctctcaataaatgtttggcattgggtattaaatgaacccttgaccaaagtctttgggaaaacagacagcagaatggaactgtttccatatattcaactaatacttctgctcagaggtattcaagtaatatttctgatatcttttggtttattgtcagtgaatttgactaaggaatcaaaaaagccttatactaatatcatcaataattaataaataattttagccaagttgtttagaggtccaaatattatttagttactaatcagggaaataataaagaaagagagagatcattcagtaggaaaaatcaggacttaaatcctgagagtttttaccagctcttttatttttctagaaggcaatggccatcaaagattggacattagctttggtgtcaggagaaagtttttctgatggctgttagaaagagcaaaatacagcagctacttaggcaaaaaattagcactcatcactcactgagcataacaaaaatgacaaaaacacagtctacctttggtaatggctactaaaaatacctatccattttctatgtgaaacagatcacggctgctacttcactgtgaatttaatctggcttctcagtcaatataatatttaaatctgatgtcactcttaagtttccccacagaagagaataaacattaatttttagaatttctttctcctaggcaaggttttgtgggctaagcctgagccaagtcattagcaaagatgtgttatatttataattttcattcaattgcaaatttccatcatagagtaactagtgttacgataattaagaaatggaattaaattagtatatcacatgccatgctgtgaaaattataatacagtatagtaatacactacagtagataattgctaagacaataagaatgtggccacagtaaagatgatataggcattgtgtagttccctatcaccatagccagtttcaacagaaaatgagtccatcacattaatcctaatgaaactctagaattacaggacaactgagctttcttatcttatcctctgggttgtctcagttccaccagcttccctttctttactttatcagaatagtttccaaagacttatgtacttttcagtgtgtaagtcaattgggtacataacacatggatattcagaatgtttattatgtatgttttttttttccaaaaagtgtttccttttttctttccttgtggcagaacaccactaactgcaactgtttaactgcatttgggggaacaaaagatttgttttataatagttcctgtataataagctaagagcttagggaatgatttgaattataaatattttctatcccagagcagtgttttaaactcagtgaagacctcagcagcatgcaagttcacatccccacccactcactcacttttttttttctgtctttgcagttccgccatggtttttaaatcatccttccaacctgtatgcctatgaaagcatggatattgagtttgaatgtacagtctctggaaagcctgtgcccactgtgaattggatgaagaatggagatgtggtcattcctagtgattattttcagatagtggtaattattttgtttcatatttgttttataatcccattcattgttttctatttttttcacttgtttttatttcttgaaaaaaaaaaaggttcctgttggagattttttgtgatgtgttaaaaaagttattcaaataaagcaaatgattttctagacataagaatatttgaactgagaaagagtgatcaaagaattcagccccctggttttacagacaagactttaaaacatacaaacaaacaaaaataaatgaaatacagacagcctaagtatttctgagtagtttcacagtttcactgctggtttatcaaagagagtttagaacctagttctagacttaagccaagaatcccttacttctttgacttttacccattttaatacagttttataagatatgatacttatgattatggaagtcttcacttggtaatacagacagcttttttttcctaccctgccctgtaggaccagcttatcctacatgagccattgagaaaggcagtggtgatgtggtaatgaggacagtgggtgctggtggcattggtggctgcagtcataggccatgaagaaccagagtacacattgctttgtaatttccaatactggaatgaattgaagctaagaggaataacttctatggtttactataagttttagttcattttctatccctattgtgggagataatagggatagtggtactctattcactgagttgttggcctggtacacatggagtgctcaataccttccattattgtagcttttgctgttactggcagaatgcttgtctcatttggaaatgctctatgaaatctcacttataggtataggttagcattggaggttctgattttaggtatatgaatatatgagagcgatgtaaagttcttttcaaataacaaagaacttgcagctacagaagagggttttaggcctacttatgtttgagatgcagacatgacactttcaaagagctgtaatctagccaggtctcctgggcagaatgagactagagcatagtcatcctatgagtccagacacaagctctctccatcgtattacaatggcctttgttgcaaagtgcctcttccacaatcagtcgactttcagaaactttcataatatctgtgtgcatgcatgttggcctactataaaggttcttaaggaatacatccataaaggacattttatcacttttattaccacttattatttttcacttttagttgcatttgtttaattggttagaaatagagtaagaaagataaaattttaacttttaaatgccacagtgatccattatttcctttaaaggcgatgttatttccactaccactgaattaaaaatgatctgccaatgggcactttaaaaagtgttgtatacgcctaaaatatatgctacttacacttaaaggacatttttcagtgcccttaaggacgtattgtaaaaggcaacatttatttttttctacattttgaatataatctttctcccagcatgactcattacagccaaccaatttaaattcttcttttataggtgaaagaaaatgtaaggtattgcccgatttgcattaaattgtgcttaaaaatatttcctcaacagctccagaaatttgagagccattttctgtcacacacttaacattgagcacaaatagtaagttatatgaaaattcttaattagaagttagccagttttatcaaagaattttacatcagctaggaattgattacaagacactaaaaacaattaagaattccccatgaggtaatatttatctcttaatgacttcaggggaggtgatttaacacgtttcacttacttaactaattcttacactaatatcgaagataaactgaattagtataattaaatgctatctctagatcattttatcatccatccttgaaaaagatggtggctcaatttctaaataaaaggagttaatgttgctgtatttaatctataaaggtgaaacatttcagccatacaataagaaccacatgggtgtaaaatattcaccatactcccctctccaaaccccaaaagcttatatgtcaaagccatcacaatatttaaagaatttttagatatttttctgggcaaacgcttccagaaaatatccaactttgatttcttgtcctttagaattcacaaataccagtatttataccctttcttttttttcctgagcagctactaaacctgaacttccttcaataacaagtaaaagaatgagatttcttttcatggtaatctttgttgcttctataattaataaaatacttgtctgttgactgctcatttaggtattgaggatggtgcatatttttgtcagcatattatttaatgcagatctaggttaaactgatgcctgtgaattcagaaaagaaaattgggaaggtatgacttttcccaggtggcataggacacgtctgcgaggctgagacccctcatggcctctcctcttgtttcttctgtgctgttttatcaaactttggtctcatctaagttcattttgtcaccttgcattttttgctttctaaaatactttacctgctttttcttttccctagggaggaagcaacttacggatacttggggtggtgaagtcagatgaaggcttttatcaatgtgtggctgaaaatgaggctggaaatgcccagaccagtgcacagctcattgtccctaagcctggtaagacaatgggaaccttgctttggtacctggaatgaaaattattcatagtctgttggtaaaatccatattgtttttcctacccctcaagggcaatatggcaatatgaaatcatttagttaattaaggtgtatacttgtgtattgatgacattttccctctagaaaattgtgtgtgtacatgtgtgtatatatatatatatatatatatatatatatatatatatatatatgtgcatgtgtgtatgtgtgtgtttgtgtatatatatatatatataaaatctccaatgagataaagtcatcatgaataatagggcctctgcttttcaaggcaataaccactaaattattaccttctccctcttttgtggcctgcctttcttcccagcattccatttaaatataaaatatataatatataccttgcatatatgttaggtgtatattttagttatatatgtgcatatatacgtacacacatatctataaatatatatacataaggactgtacatattttcttatatgtaatcttgaatcaatggaagttaattagtgtattagtctgttctccactgctatagagaaatatctgagactgggtaatttataaagaaaagaggtttaattggctcatggttccacaggctgtataggaagcatgatgctggccatctgctgggcttctggggaggcctcaggaaacttgagattatggcggaaggcgaaggggcagcaagtgcatcttatgtggctggtgcaggagaaacagagaaagagggggaagtgctacacacttttaaacaaccagatctcatgagaactcagtcactatcaggagaacactaccagcagggaaatctgcccctgtgatctaatcacccccaaccaggccccacctccaacactggggattgcaattagacatgagagtttggtggggacacagattcagaccatatcaaaaggatcttgaaaaattactctttttaattataattgcaaaaaatgtcattttgttttatagtcttttggaagcttaatatattgctgaattacagaattctagtataagtccgggcacagtggctcatgcctgtaattccagctttttgggaggccaaggggtgaggatggcttgagaccaggaatttgagaccaatctggacaacatggcaagactttgtctctactgaaaataaaaaaaatatatatttaaaaacaggcagccacctgtagtccagctacttgggaggctgaagcagaacaatcgtttgagcccagggtgttgaggctgcagtgagctatgatcacactactgcactacaacctgggcaacagagcaagactctgtcacaaaaaacacaacaaaacaaaaactagaataaattgatactagacctgtcatgtaacagctctataacaacacaatttcttgggaggagagacaaaaataaaaacaaaagaaccatcctgctgctctgaaatgattaaagaagtttaaaacagggacaagacagttgttaatacagatccaaatacttcaaaatgttaatatctcccataaagagttatctatcatgttacatacatttcaactcttttggaccagttttcttccttttgacatggctcgcttttgtgttaatcttttcctgaagtaagtttaatagaaagtaggaaaagcatataagacatagtctttctctggcttttatcatttaaaatgtgcctattaagtccttatattgtatgcaccccagccagttagctgaagattcacagcagtgctcacaaagatgactttctcctatttccttgattgaaataaaaataaaataactatagaacaacaataccagatgagtcaagaagctaaaggaactatgtaggaattaaaaggagcaattaactctggctcaagatcaccagtttctctgatggacttcttttccctccatttgatgtgcttaagtgtcagtgtaacttcattggtgtgactaagtatattattttctgctgaactagtaatgcataagtaggagaaaaggaacctttaaaatcagggtctctaatgtgagccacactttttttcttttaattttattattattatactttaagttttagggtacatgtgcataatgtgccggttagttacatatgtatacatgtgccatgctggtgtgctgcacccattaactcgtcatttagcattagatgtatctcctaatgctatccctctccctccccccaccccacaaactgtaccatatcattagtaacaaaagtatgggtgcctttaagctgatattggctgctacgccagtcacagaacaggagaattgtaggtgagtttgatttttcagctaaggccataaagctgatgacaatgcaagataagtgacttcgtgtttctaaaggaggtgtaagatgtatcctcctagcacttggcactgaccaaagaagtccagtgagcatccctgtacctgctcacagggagggaggattctttgaagtgctagaattcataggatgagaggttgtcatggtattttctctcctgtaccagccaagttatacagactccaagaaaaccttttagactgtgtgtgtgtgtgtgtgtgtgtgtgtatgtgtatgtgtgtgtgtgttgctggggactgattgcaaaaatgggaaatgggcaactttattctgctatttcatggtctatacaaacctgcccccagtgtctgaggaagctgagagaccaaagaaagaggctgacaaatctagtttcttagaaatacttaatagggacttatgaacaggagccatatctgtgtctctggcagtgctgagacaacatggtggcatggggatgccactagcccccagaccgagggcttatataccatggggagaagtggttttgaagggaagtgtgagatgatggaagtacagtaacaccaaagttttctgacctaatggcaggatttatggtaagtacctgctgttacacaaggaaaattgataaacaggaaatcttagaggccttcccagaagaggggttaatcagaagccaacaaacatggtggattagcttccaagatggagttgctttcgcctccacactggctggaaaccacctggagctgtccacaatgcagggaagagaaaggagaggacaacattaagaagaagctctatttcgacccttgagaagaacaagggtgtcagttccacttgaagaaggcaaggctgaaggtttcttgaaaggacttttcccaagaggtcctgtctgctgaggctgtgccaaccaagacactagagtgatggcgcctggatggagctgagctaggagggtggcgcaggtcagccagagagtgctttgccaactccagcaggggtccagtgactgcatttctaaggtggggattttctgaagaactcacagaactgctccacaaaaacaaaaaaaaaaaaaaagaagcttgcagaaaccttccatgagtgtggacttttgaaaggacaagctgagaaaaacagtctttgtctctttattccaaatccatcctcccctctctgaccctgaggaagccctaaatagaagggagaagcgacctgagagactgaaacacagatgataggcagtcctactgcccccttccctatttacaatctacacttgctttgagagatggaaagaaattttaaattattagttgaatattttaatttagatctcattgaggtgtttgtgtgttgtggggttggggggggttgttattgtgtggagttctgtttgttttgtttttgaatacctgaagataaagcttttttttttttttgagacagaatctcactctgtctcccatgctggagtgcaatggcacaatcctggctcactgcaacctccgcctcccaggttcaagtgattctcctgtctcagcctcctgagtagctgggattacaggcatccaccaccaagcccagctaattttatttgtttatttatttattggtattttttaatagagacagggtttcaccagattagccaggctggtctcgaactcctgacctcaggtgatccacctgtctcggcctcacaaagtgctgggattacaggcctgagccactgcacccagccaataagggcttttaaatacttacctcaccccagggccagaggatggacccaagttacaatcagggttgggaagacagagctgacagtgtgtgtttgaagacggatgacagcagaaaaataaaaagctatttccttctaatttccaatagttgagcttattcagtcaacccattatagatgttcaatttcacttctcccaggaactctacaggtagcctttaattcatggtatcttgcattccacttgggccctgatttgtttaggtctatgtgaccataaagtgtcaaggctctcctgagcagaaatggcgtttaactcctcactagagcccaggaaaatcttgaaaattcatttattttccatctagatggtagagtgttgtcagtggcatctactctcttggtcgttgtttattgtatttggcattggattcaaaagaaagtaaaagaaaatgaagataaaaatccgaaagcgtgacaggacaccattgtgactgtcttatatttcccccttacacatgatggattgctttttcctggctatttaatcaggtcttcaaagaatgccactccaattcctcagagatgcagcacaggccgcgtgcacagatggtagagaggccagctataaattaagcaatgaggctgaccatggtgggaagaacatagccctctctgtttaagttttgacaataaacggtcaccatatattttgaagtacattgtgggcgtgcattacccagctgttcagctttagcctgtccacaggggcttgtggctgagagttactcttggcaaccataacaatctgcttctcgctggagtacagacaatgacctatttgagccagtgtctgtagttgtcggatatttacataagcctaatgaagtttcaacatagtcttttatatatagttacctattccctctttagcagttagtgacttaggaaataaaatgaacataatctgctgaattaaattgagtgaatgacttgtttttctctccagaaaatgctagggaaaaatatttgaaatgtatgcattttcaaatgtgaaatgtatacacggtttcctctagataaagatcaagattaaaatcaagaagatcaatggtgtttttaaaaatcgttacactacaggaggttctatcaataatggtacataagtaacataatgccatacacacagtgctatctatgcaattatttattttctgtctctctctatagaacacatgcacaaatagaggatggattcctgcacacatgagactttgcatatattacattaaaaatatggagccatattatgtaagcagtgtgatggaaagttaattcagtttagttgatttatatgatgtgtattgtttattaatctctccttagatctggggacagagttttattgttgtttgttttaattaatttttgaaggggagggcaggatgttggctaagaagtctcctttctaaataagacattattactgcaagtatactattcagtgaatagtctagcaaaaaatgggttaagaatcaatgtgttaggactgggtgcagtggctcacgcctgtaatcccagcaccttgggaggacaaggtgggcagatcacctgaggtcaggagtttgagaccaaactggccaacatggagaaaccccatctctactaaaaatacaaaattagttgggcatggtgacacatgcctgtaatcccagctacttgggaggctgaggccaggacaatcagttgaacccggagggcagagattacagtgagccaagatcaagctactgaactccagcctgggcagcagagtgagactccatctcaagaagaaaaaaaaagagtcaatgtgttctgtgttacaagaataagaagtttcagtagccagagttgcaaacaggtaagcaataagttaggatcccattggcatactggatggtgataaattaattactcccatgttaccatccaataaattgtagtgcaggtaggcagtaattaaattaaggaccctgtttggtagctgagtggagaagttagcaattatctggagctggggagcaggagatggggagcaaggcaggaacaaataataagatgaatttaagatattagttatctctgagtttcttatcctggttctagatgttgcatggcattccgttttctgacagtgtctgcagcggaaggttgttggaagtacctgactgctgagcagggaagtggagggccgtggaactgggaatgcacctacgataggggcatacgtagtctgggatgtgtttaatatagtggcataaatgcgtgaagacagaataaagttgccatgggaagaaataatgtattcattatattctaccatgcacaaaatggctgtgggaaaaatccatataatcataacaagaataaatgctattatagatatttcccaaaatgttggtttgcttgggcaagatatagggtctatgtcttatgttaatattgcatatttggctgtgtggtggagtagacagagcacagactttggagtcaatttaagtacaaatcacagctctatcatatattagctgtgtgacattaggccagacacttaactccaagccttaatattatatcctgcaaaatgtggatagtactatctatgccatcaatttgatgggagaattaaatcagaataatgtaagcaagacacatatcacatctaccacatagtaactgctcaataaatgtaatctgcacatttgatcttccttcatctaagatatacacctgcttttaagcaagcatggtttcttttattcatttgtcaaatatttttgtaggcctactatctgctattggggaaagtaaattgaaaatagaaaaagagataaatttcccactttaaaaaataatcacgtttttattggaagaggaagacaaataaaaaaaaataaaaataggcccggcgcggtggctcaggcctgtaatcacagcactttgggaggccaaggcaggcagatcactaggtcaggagatcgagaccatcctggctaacacggtgaaacctcatctctactaaaaatacaaaaagttagccgggcgtggtggcgggtgcctatagtcccagctacttgggaggctgaggcaggagaatggtatgaaacctggggggcggagcttgcagtgagccgagatagcaccactgcactccagcctgggtgacagagcgagactccgtctcaaaataataatgataataataatgaagaataaaaaaataaatgctggttttatttttttccctctaacattggttaaaaaaaatagtttcactgtagtaggggaaatatattggttagacgtttagaaaaatgagaagcattatcaattatctgtcctcccctggaaaaggttactgattacaaatgatgttgaattttaaacattttattaagtcagtatatcatatagcttggaattcagaagagtcaatcatgaacatcaagacgtaaaaccagaagtattttatatctgttttcatgagttgttccttatcaatataagaagaatacctagaaatccaaatggacaaaaggaatatactaataaaattgtatatatattataatataattacattataattatagtgtttcctactacatgttgattctgacatactaacttcactgagattcagtgtgaagcaatgaacattgaataattagttcaattattaagatctattagaatttactttttcagtgtaatagcacctaagcaactacgtatgagagattgaatctaaagggctgtacttcttactttgatattaactactggtggagaattaagttaaattttgtctcttatatgagaaaagttactatgatttaactgtttcattgtgtttagtgtaggatcaaattgtccctggagttctgtaactaatctagaagagccaatttcatgtgccatactacaatgttaaccgacccaagcaggtaaatgggtccttatagtttcctcacacaaacagagatgctcgttaacactacaaaattcctctttaaagttccatcattggtccaaatgcataaaagtgcaacttaatatttttgaaacatattgcagtgatattatagctcataagcttccctagaacgttttcctttataagccttggtaattaattgtagctaagaagatacagagccaagttttttcaaagtggctttgttaacttcagcatatctgatggtacatttattcaataaattgtaaaattatttttgcttataaagttaaaaataagagaatagtaatgtatttttttttattttctacttcaaagtctccctcccgttagagaaatgttgacacccatgctaacattttccctgagtgattcattgataatctaagtttggcataaagcagtcatttgatctttgaccatataatactcacctagtgtatgagatgtgtccacatctcatttctacactcttatccagtttacttgtagagatttaaaaatgtattggaatatagtgtatatttatgaagagattcttaggcaatattgcctaacctttccaagtctctatttcttcagctgtaaaattcagtagataattgtctcaaagatttagtgcaataaatgtttgtaaaagggatttgtgggctgtaaattgccacacaaatgttagctattatgaagtcttttgttggttttgtttagtctcaagaaaaatagcaggcatttattgggatggataaaatgatagctttcttctagcatatttttctaccctacaagaaaataattagtaaacacatattttaatgacaatgtccattcaaaatttaggtttttagcctagtggacaaggttaagggaaaagtcctttttcaaaatgactgctagttgaaagatttgcagcacggtttgcagtatcagtttaataatgacttgctcatgccagttttatgtaggcagaggtttctcagcaaataaaggcttgtcattcaccttgtccttcattcagcacgtgcttcaggtaggaagccagctcagtgctaatcaagaggatatggctgtatggcagactttgaaattagaaatgaattctgcagtaatatgaatgtactgagaccagtgataataataaatccatacaatatggaaaacttgatagattcataaatattgatcacatcatacttcagtggtaaatataccagagtgttatcccattttttttttttttttttagctctctagagtagaaaaagcggaagagaagaatgctggtttttatattgaatccaaatgattttgactttgaatttgttatatttttatctttcacctgtatatcaccatttgatgaaagatgtgcgagtgcacacaaaacatacatacatatagattatatagtatgtagatgctgtgcttatatgtatacacagaaagagatatatattccttttgattagagaagtcttatttcctggggaaaagaagaaggttaatgagatgaactgtaacccccaccagtgcaactgcaactggtctcaaggctgcaattggtactatttccctcctgctacccgctgtaaattcctcttactctcagctagcatctctgctagtttctgtggcttacccaaattcctgtccctttactggtcatatatgctgtactagccaatacatgatcaaaattggggaagggagtatcaacagatactccagtagatcatcagaatgccaatcatattttccttctttcccaactcctcttaatgacctgggcaattattttgccaggatagtatcctgccttgcctgctggtattttggcacaagacgtatgatacaacaaggcagcagcaatagctcaaatttcaatgatagaagcattcctcctttgtgaattaggacttctgagtctacaagcctagagtcatagggatggtaaacagagattctccaaatgggtcactgggagtcatggtaagcagtttcatacctactttaatctcttgtgtttgtttagtctacctattgaggacatggtaccatatactggccattgatctagacatatactagaccctagaaaaaggtatcccttttgcttagggtatggtctccagcctggctccttaattccacctctgaaggctttactttggctgtatcaagtcagcagctgttgttgatatgtgataggattagtagatcccgtggcaatgcatttatgcctatacctctttttctgtagagtaagttatttgattcttttcaatataatgagggattccatgttggtctcaaatactttgtgagtctgagatggtggtgccggtagaagccctgagaataggaaaagcaacccatttccagaatatgtgtttatttcagtcaagatgaatttctaaccttttcagaagagaagtcatccaagtaaatatgtcacccagagactagttggttttcttaaggaatagtgatttgttgggagctcagcatgtgtctctgttgctaggagattgggcatacagcagtggtggcagcttctggtgagtagcagaaaccatgtaggattagagcccatgccagtgagcaatgcataggctccattcttgcctctgtagccttatcatttgtgcacctttatgccaccattggatgctggctgatgtcaacaggctgaattgttccatctacataattgcttagtgactcttccataaattatacaatctggtgtttacaggggattcaaagatttttttttaacttggtgttcattcctgtgggcctatcaacatgtcttttccccaaacctttttgttcctgatctttccatcattggccaatcagccaagctatttgaccttgttcacatgtatatatatatatatagtcctaccttgagccatttataatttcatataaagtaggtggtgtggtatactcaacattctaccttgggaaaggttctctttaccactttcttttggggctatccctcactgagctgcagtgtagcagccatccaatttggggtgtacccacatacccacagaccaagctgaccacctggtcataagtgtgagttaaaggggaaggtagttgtacaatagtgattgaaaacatggaggtctgggcccctcctgttatgtcctctggtcccgtttttccctgatgccaaatgtaattcaccccatgaactgatgatggtcctgtctgaccttataacttggtgcatctcagagaagccagggtatgatgagcagttctggtcagtggactctcccatggttatttttctcttactttgtgagtagggaaactgctgcacagaaaagttaactaacttgtccaaggtcacacagctagcaaaacatctgacttttcagcctactttctcagccattgtgttataatgggtctgtctacccaggctttgtccacacatggaggcttctcagataaatgggtgatatttcaggtttatttgagtctaatcagactagttttagaattactaataaaggttaaacactggaaattaatttttaaagtctaggattctgccactcaaatgatctctgttcaactttccaatatgatagggcccattgctaagtgtgggttaaatgtgtgaaccgtcttgaggtgaatatcacataattgttgctatccagaaatccatagtttaacaaagagtaaattcgatataactaatcttaattatcaaatgcaattaaagcatagtgatttgcaatgctatattcattattcaatatttatcgagtacccagaaatatataaggaatcacaaattagagtgttgtgatatgcacttgcagtcccagctacttgggagattgagatgggaggagcacttgatctcggaagtttgagactgcagtgaaatatgatggggccactgcactccagcctgggcaacagagcaagaccctgtctcataagcaagtaagtaaatacataaataaattttacctagatattgattttttaacaaagaatcacaaatgagagatgttagatacaattcaaagaaacattaagtctttaaagttagtcttaatactcctcaaacataacacagccagtgcctgacatactattttttgggtttgaccctatcttacgaggatggtagtgtcatttgccacacagaatgacaaagcttctattgtattgaaaagctccttcacttattgttctattttgtttaagtgaaaaggtctaggttacaatctaggttaaaaaaaagagaaataatatttttttatttaaagtatctattcagagttctttagcttataatgtagttccatcaaacaataattaatcagcctaaatagtataggcaatgcacagctgtctttgttattttgtgttgacaaatatataccaagaatctataggtgaccctaactttccctgaaacattgacaaaataaattttttcatctagatgatcgtctatgatgaatgtgagaaaattcacttgaaattaaaatgccccatcctcaaattaaaacacacgtcattataaagcaagaaaagtccaacagaaaagccagtttcccatatttcttggtattcttcaggtccagttcctatttaagttgacctacctgctaatcagaactgatgtgttcagttctggcagacatcgcctgagttgtatgaaaatgtaccaaagcagaacaaactgttttgaacaaggaagactgattctttctttaagtgattttctcctaacagtatggcacttagttgtaaggaaaagggaataaaagtactatgtagcttatttcatattcctcccttgccttgtcttcttgatttcataaatggaaaaaagaatggagaagagaattggtagcctatacataagtcttttgatctcatgaattccatgtccaatttttgacacgtagaccacctgctttcttgttatacttgagccttacttctcattatttaatgtgaggctttgagcccaattttgataaaatattttagatcttctttaatacgcttgcttatatagaaacagatgacccttggggaaattcaactgataaaaatggtaaatatctttttgcttttctagatcaagaaaaataacaacactaaaacctcatactaatgatgtagttactttgcacatgaaacatcctagaaaaagttatttctactttctgaatgcacgtgttaagtggatgcttaagcccttagtctaatagggaagtttggcatagaacaaatttattttgaatcccaggaatatttaagtgcaagatataggggtaagaaaaaggagatagcacaaaggagaacttaaacaactctttcaatgggaagaggaattcattgctgaagatgtgacatctgagttgaaatggactttgaagtagggatgtggtttggccaagctgccaagaagggcaaagaaattgctggtagaagaaacattacatacaacacatgggagcatagagcagaagcaaaagtatgtattcagtgaattatgtgtggttctgtaaggctgtagagatatgcaggggctggatcacagagtatcttttagaatatacaaagaaaattggactttttgtctagactatgtgggatagggatggctaaatgtaaaagataggcttgcttctatttctgttttttaaagataactttggaagctgtgtgagttggcagtggtagaaagagggactagaaatattgaaactagttggaaagctgtatcatcagtaggctaagcaagagagaatgaggtcattgacctcaactgtgcaagaagagtgagttaatgtattagaaggtcctgacagattggagattgagatgaatatgtgcaggtggattaggaattggggctgtttcctaaattcttgacttaactgaatggatggtaaagccatcacttaagaaagaggaagaatgacttaagtccatctccacagaaagagcctggattctgagtcctttgaaggcccatgtcttgatcatctttgtatttccagcaggagtaaagggcctgacaatgacagactctcaatgactcattaggaagcctaaaaggcaaatactttgttttactgattaattgataatgccaggtataaactatgatattgtaaaaggtgaagcaaaggaagtaaatatcccaaagactccaaaacatgcaattgagaaatttataatcaaaataggcaaaactagtaggcttactgaaaagcatattttgctttgtgtgttagatcagagcaggaggacagatgaatgcagaatattttgtagtatctccagagggaaataattatggcctaaactgagtggcaactctgctcatggagagaatgattaattcaaagaattatatggaagaggaaacggttagcagtttgcatttgaattgaaaaggagcttttgatgctgactgggaattctgtaagttattggcattgctgatggtaatgaaaagcttaagggagagtgtgacagggccttatcatgcatctttagttccttgatagggtataagtgagtcattctcctactgatgggatgattcctccttgctggacatattttacccagctttgagaaaggaactcattgcactgccatcttggaataatgagttaaagggttatgcattaacataagataaccactgagcactatcgctgccaggactggaatatattgatttgattaatccttaaatatcagaaggtaaaaactatcactttttccccccctcccctctttatttcctctgtctgtggcagacacagattagaactgagaaataaattagaaggactaactttggctttctgccacctagaaatagactaaatagtttaatatggatttatgtaatgagttcacaaattgattttgcagagtaagcttgctttaggaaataaacacctgtgtactatggtttgaatggcctacttctatgtgcactcatgttgataaaaatgaattttcttaaaaaaatctatcttatggtcacttcatcattccaatatttttgaaatccacaaatcaaaaaccaaacaatgatttagaatctctagatatcacctagggaaagcagtctctattgggtatcagtgataatgtcttatctttgagtgacaggattaaaaagaaaaaaaaaaagacctcctccactctctgtgaaacctccacttctccttttcccttgtttaagaacgtcacatgtgcctcatttaaacattaattatttagcttgaactgtacacagctaatgtgtaaaataaaatttcttgcaagtttgaagatgaatccagaggtaccgcttgtaagcaggcccccgctttttctatctcgggtggccaaattatgtgtaattgtaattggtgatggatggtgactgttgtgtcagccaatcattctaggaatggctactaagatttgtaattataatgtcccttattcctatttaaattaaacagtcttcacataactattctttcccttgaaacatggaaatttgggtgtgggaattggggacagttaagggtcagggttttacctcttaaaagctacacttttgcacagtctgtcccatttctctaaggcaccgtagatgggggaggccagcgatcaagaatggtaatttacaatctaagagtgcttaatctaaaatctgtccttgtcaaaggagaatgcgttggtccccatgcagcagtaatggaaattttatttcagcataagcttcaatgggggctttcactgtattctttaaactaccctcgtccttatcaatttatgccatgtacaggttttgtgggtttttaacatcattctactttaaaagagaaaacattaaatataataaataaatccacatttggaaacctataaactcaccttgcaagcataataacaaaaattgttatatggttatggctgaatctagctttattattaatcatttttcctggggattaaaacttaatttttcaaagagatccttttctctaacacactagtttctcttttagggtaacacttttataataaaaaattattttccttaattttcactgtcatatacaaagagcttttcctgttaagaaaatagatagttaagaaatataatactccagggcaaaaattggaccagattaattaaaataaatatatgaagactttataattgtttttgttcagtaacaaattagtaagtaccatgctaaatgaagacaatagcaatgacattatacattgtaaattagtaactatgggtattttgttttaaatctatttactagctcttgtttactaaaaacctctaagtatgtctctttcttatagtttccacgtggtatgtataaatctgttttattttccttcagaaaacacacatgctaactttattatatcttcttttctggcctgggattagttaactaggatttatatttatcttctatgttctacctcattaatatctatctcctatgttctacctccactccctcattcctagactccagtttgtgcctccttttgtggatcctgaaattctacatctcactgaattttatatatgcctaccactgtaacactggcccactttgttcttcatgctagattctactagagagcaattctaaggtcattttttttttacctttgctatttctcccacaaatttttccaagtcattattggccagaacaaacaaaaaaacaacataatcatcaaaacatctattattctctgctatctgtttcaatacaattttctgttcccaaagctcagattctttgtttttcgattgttccaaataggagtgacaattggtgtgctagagatggcatactgatgaccatgaatgagatatacatagaagattctatatattgttgccaaaagaaatgtgaggtatccaggtatccttgggaaagactcaattggctataagtaaaatttttgatgtctaaggcctcaggtatggcttggatgattagcaacatgaaagaacactggcaatattaaaagtgcacactgtatgttgtcagtttcccctacattttatacagctgtcaagaatactaaaagaatttgtgagacccctttttgttgactatttgttagattcatctaaggaacagttaacattctgaaaaatattactgagtcaaaggtcttcctgtaactgcaacattacttgcacattagtttttagaaagagtacattttaacactcttggctattcaaaataaatttcaagacctacaaatacaaaaaaaatatgatggcatacttctctttagagagcatcatgtgaaaaaatctagctctttgtttacatgtgcatagagacctgattaaaatttgggggttgtcatatcaaatttccttactatgtttccagatattcaaagttttggggataaaatgaacagctataaggaacaacaaaaataattgtttacagccttcttttgtagcagagacatgtgaatatcaaaggataaacatgaatgcggtggatttttactgtatcaacttagtcaaactgtaacaacctttctccgaatttccctctctttgtggttctgagttagtgtgggccagaaaaggcaaatagatgtaagggagtagtgtcttagtccactttctgttacttgtaacttgaaactgggtaatttatttttaaaaaggaattcaattcttacatttatggaggctgagaagtgcaacgtttaggagctggctctggtaaaggctttctttctggtgaaggctctttacagagtcccgaggtggctcagggcatcacatggcaaggaggctaagtgtgctagctcaggtgtttcttcctgttcttgcaaagccaccagccttactcctataataacccattaatccattaacctattattccattaatctataaatgagttaataaattgatgatggctctgtcctcatgacccaatcatctctcaaaggaccctcccttgcaaaactgccatattggagattaaacttcagcatgagttttggaggaaataaatattaaatacactgcaagtacctatacttttttattttttatttttgggaggtttgtgcaggatatgagttgctgctctctggtggctcacttgttgggacagggcaatacctcagccagttgctcctccaggccctgccagatcttctgtttcagcttttctaactggttcccagctttgaagacagagcaagggctcacaagccaagcactgtgggtggacagcctctttaagtaggaaaaggcaaggagatgaattcatctttagagcctgcaaaaaggaatacagctttgcctagaggacatgcgagacctctaacccaaagactatacaataacaaacatatgtaatttgaagacactgagtttgcagtgatttgttatagcagctgtaggaaacaaaatttgaattcaagattcttccactaattttgcatctacattctgatcattttggaaaattcttacagaaattggacaatgttgaacaaatagtgatttttaaaattatatctaggactatcattgccaagggactttgtcttgatatttcacaagaagaattttggaactatgaaaataggggatcccatagttcttactacaagcatagaatgcccaccaaacaatttaaagccaagcctattatccaggtacccagagaatccagcctccagaacagaaggaaacagtccccactgaaagaacacaaaagccaggaagccacaaggaattgccctcaggttctgaaggacaagagattgtgcattcaatagcttttgcaggaattaataagtgaaggccaagggttataataaacatctaaaggaagaatttagcacaaacaagaccacatagaagaagaaaaatgtatgcaagaaaaccagtatgaaccacacctagaaacctagtcagggattttttttttccatctaaaataattaaggatctttaccagttccttagcacagagaaatgtcaggaaccagtgccttgtcctcattattctttatgtgtaagaaactggagtaaacaatgccaaattattattccaatttgtaggttaaataagctccccaaatcacctagtcaccgtcttaaatttttaccttaaaaatcctacagggtattattataatggatttcctgaattgctgaaatattacttaatcaaagggagaagccattaaaacatagaacatgctatgttacagggctgacttctgtttacttgtgcacattttttttttaaataggaatataaagctaacttctcaggtgggaagatggtagaatcatcactgccatctccaaaactacacttttgtgatgctggcttgaacttagaccatacaaagttactcattttcagatgtttgtcaaaatgatcctccttcaaaaaaaattcagttattatggtctcagtaattgtgaaatgcaaacagaatcatttaagaaggataaaattgaatattttgtttcttacataaaatccagacctctgtcatttcagctttggtggagtattttctcttcttcttcttcttcttcttcttcttcttctccttctccttcttctccttctccttctccctctccctctccctctccctctccctctccttctccttctccttctccctctcctcctcctcctcctcctcctcctcctcctcctcctcctcctcctcctcctcctcctcctcctcctcctcctcctcctcctcttcctcttctcttcctcttctcttcttcttcttttcttcttcttcttttcttctttccttcccttcttcttcttccgttcttcttcttcttcttcctttcttcttcttcttcttcttcttcctttcttcttcttcttcttcttcctttcttcttcttcttcttcttcttcctttcttcttcttcttcttcttcttcttcctttcttcttcttcttcttcttcttcctttcttcttcttcttcttcttcctttcttcttcttcttcttcttcttcctttcttcttcttcttcttcttcctttcttcttcttcttcttcttcctttcttcttcttctttcttcttcttcctttcttcttcttcttctttcttcttccttcttcttcttcttctttcttcttcttccttcttcttcttcttctttcttcttcttccttcttcttcttcttcttcttcttcttctttcttcttcttgttttagggtacatgtgcataatgtgcaggttagttacatatgtatacatgtgccatgctagtgcgctgcacccactaactcgtcatctagcattaggtatatctcccaatgctatccctcccccctccccccaccccacaacagtccccagagtgtggtattccccttcctgtgtccatgtgttcttattgttcagttcccacctatgagtgagaatatgtgatgtttggttttttgttcttgcaatagtttactgacaatgatgatttccaatttcatccatgtccctacaaaggacatgaactcatcattttttatgggggcatagtattccatggtgtatatgtgccacattttcttaatccagtctatcattgttggacatttgcgttggttccaagtctttgctgttgtgaatagtgccgcaataaacatacgtgtgcatgtgtctttatagcagcatgatttatagtcctttgggtatatacccagcaatgggatggctgggtcaaatggtatttctagtcctagatccatgaagaatcgccacactgacttccaccatggttgaactagtttacagtcccaccaacagtgtaaaagtgttcctatttctccacatcctctccagcacctgttgtttcctgactttttaatgattgccattctaactgctgtgagatggtatctcattgtggttttgatttgcatttctctgatggccagtgatggtgagcaccttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccattttgtaggttgcctgtttactctgatggtagtttcttttgctgtgcagaagctcttgagtttagttagatcccatttgtcaattttggcttttgttgccattgtttttggtgttttagacatgaagtccttgcccatgcctatgtcctgaatggtaatgcctaggttttcttctagggtttttatggttttaggtctaacgtttaagtctttaatccatcttgaattaatttttatataaggtgtaaggaaggggttcagtttcagctttctacatatggctagccagttttcccagcaccatttattatatagggaatcctttccccattgcttgtttttctcaggtttgtcaaagatcagatagttgtagatatgcgacgttatttctgaggcctctgttctgttccattgatctatatctctgttttggtaccagtaccatgctgttttggttactgtagccttgtagtatagtttgtagtcaggtagcgtgatgcctccagctttgttcttttggcttaggattgacttagcgatgcgggctcttttttggttccatatgaactttaaagtagttttttccaattctgtgaagaaagtcattggtagcttgatgggcatggcattgaatctataaatttccttgggcagtatggccattttcacgatattgattcctcctacgcatgagcatggaatgttcttccatttgtttgtatcctctttgattttgttgagcagtggtttgtagttctccttgaagaggtccttcacatcccttgtaagttgtattcctaggtatttcattccctttgaagcaattgtgaatgggagttcactcatgatttggctctctgtttgtctattattggtgtataagaatgcttgtgattttttcacattgagtttgtatcctgagactttgctgaagttgcttatcagcttaaggagatttggggctgagacaatggggttttctagatatacaatcatgtcgtctgcaaatagagacactaaaataagagcagaactgaaggaaatagagacacaaaaaacccttcaaaaattaatgaatccagtagctgtttttttgaaaggatcaacagaattgatagaccgctagcaagactaataaagaaaaaaagagagaagaatcaaatagacgcaataaaaaatggtagagtattttcttaaaccattgctacctggagtttctccataatgatgccctttttattcccagcaatgattttctattattttgtgttacatttaagttagctttcttattaacaaagttaatgatcatatagttctcattgtgaatattaaaaaagattagccagaaacgagcattaacccaaaacacttgattgataagtttgtgatacttgataatatgaatatgctctaataagtaactctatgcagttgtgtattacttaaaataaatatgaccagacattcttcatggtaatgtgactagcttagttattagttttataaatcaatgcaatgattgtactcacttttttgttgttgttgttgttgcttgttttgagacagagtctcgctctgcctcccaggctggagtgcagtggtgtgatctctgctcactgcaacctctgcctcctgagctcaagtgattctcctgcctcagcctaccaagcagctgggattacaggtgcctgccaccacacccggctaatttttgtaattttagtagagacagggtttcaccttgttggccaggctggctttgaattcctgacctcaaatgatcttcccacctcggcctcccaaaatgctgggattacaggtgtgagccactgcacccggccgtactcatgtatttttaagtaattttttcctctttcatgccttgtgtctacttctgcctcattgtctatggaaaaagaaggcatttatgcttttgcaggcctctttcttcatgaaaaagttactaattttataactgctttggaataaagatgaatgtaatccaggatggacttattttttcctcctaactaaaaaaaaaaccaaaaaacaaaaaacaaaaaacaaaaaacttaaaccttctttatgggcacctaaaagtactgtggcccttgacacagtgcctactgtgctgattggacaagtcatccctattatatagccatatcgtggttatactttaagaaaattgggcctaactttctaagtgctttgaagtcatgtgatgcataaagcagtgaattgtttcattatctcaattttcttatgatgtaataaattgtttttagtttaaaatcatttttatgtcacaggtatattgtataaggtgtcagttaattttttaatcaatagaattgttatttttcattaacttgtgttactgccacaaaggaattgaatattttataccaatttccagtacaaatagcatctaacatttaagctttgagaatctttggctctactttctccccactcccctcgctatttggcacactattttgtcctcaagttcatgttctgacacatacatgtgtgtctactagttgctaaaattttaggaaagttattttctaatgaaagtcattatccctaacttacttgcattgtcgcttggtatattaaaatgtcttttgtttcttaaaggaagaaatacaagaaaatgttcttaatagcaactgtatttctttaaaggcaaatagttatctacattaagtagcaaatacaactctaacagtccatgaggccagtacattctctcactttctgatagtgaaaaatatcttttctgggtgctagaggttgtctcaatactatgggctatgcagaaaaatgtggaagaactagcattttgaggggtgacataaagaatgtattggtggctcacgcctgtaattccagcactttgggaggccgaggcgggcggatcacgaggtcaggagattgagaccatcctggctaacaaggtgaaattccgtctctactaacgatacaaaaaaattagccaggtgtggtggcgggcacctgtggtcccagccactcggcaggctgaggcaggagaatggcatgaacccgggaggcagagcttgcagtgagccgagatcacaccactgcactccagcctgggtgacagagcgaaactccgtcccccaacaaaaaaaaaaaaaaaaaaaaaaaaaaaaaaaaaaaagaatgtatcgtgtttcttgatgctaaaactatcctaagcagttcaattgagttacaaagcttaataatttttcaaagttcaactagaatgtcttaggacgtaggacaatttgggggaagtatttccaccttaaaggaggaaatggtggtggcatggtctacagttattttatacccttgttctatagaagcatgtgtcctggggttcctgagtgtctccatactgttaacagctcctctggcaactacattgtaacagagtgtcaggagttggtgcagaattccagcatcagttccaaatgctgaaccagtaatcgatttcccaaggaaatcaatcccagcaaaagttgagccccaactctctatagcatgtgaataaaacagaaaacggctatcttagagaatacatggtaagctgaagaacgtaaattagacttccaataaatttgatgctttgtgtacttagaactcatataggcattatagatccaagcagtttcagctagcttttcatctctctcaaaccctgggcgaatgataaacatcaaagagaataacatgaaaagaaatatttactttgaccgttctaccaaatatatatatatataaatatatgaaaatatatatactaatatatataaatatatatgtaaattatatataaatatatatgtatatatacacacacacacgcacaattcaagcataataatatgctttagactgagtggcttatgcacaacataaatttatttctcatggttctggtgaccggctgagtttccctagtctgagattagggtgccagcatgatggttgggtttctggtgaggacccttttctgggctgcagactgatggcttcttgtatcctcgtacggtgcaaagagagagagataattccctgggatctcttttataagagcacaaattctatttataagggctccatcttcatgatctaataacctcccaaaagcctcacctcctaatatgatcactttggaggttaggatttcaacatctgaattttggggaatatgaatgttacgttcagtccattgcatacactgtacatatatctatctatctatctatctatctatctatctatctatcaatctatctatatatatatatatatctacataaatatgtctttaaatttgatatatttatctttaaaatattgaattctgaataccattggctagcaaaactatgggactgaaaataatctgctgatttctcatcttggcctttgagatcattaagaaccctgtgaactatctttatatgacaattatttttaattctaggaaattcaatacagtagtagaatgctatagaataacatgttcattttttgtgttcattttcgtcacataaattgacttcttaggcttcaaaatttggagagttttaatgttaatcctaacatcaaaggtaccttaaattttttaaatattatccattattagagtagctggtaggtttataaagaatttagtgtgctctgagatctgtatttttaacaagcaactcaggtgactcttaagcagatttgggaaccgaagtcgtaagcaagtgaactatgtaaatattgtaccctcttgtctttctttctattttgcctgtcactctctcctgcagagataataatgcataataaattaatagaggaatcaatgactagtctatggttagacatggactttataaagcaagcactccatcatttattaaagcatataaaatatatatcataacatatgttttaactttattgcaacaatccattttatgaataaaaatctcctaggtagatattttgacacagtcaagaaggaaactgaatctatgactgttctatgagcctgttagaattgatgaaattcaagatctaacatgcatgaaagcattttagatgtggagttagctgatattatttgggtggcttttctctcacatgtttattttgctattttgcttatagtcatcagtctacttgtccatctacccttgctgtaagaggtcttatttttccttccatataccaatccagtccccatcacagaccctgatgtatcatagaccccgaaacaacttgttaaggaaatgaatttctattcaaacatgtacacacacacacacaatctaggcaattttaatgctagcaactgaatcacaagaatggaataaaagatacattctatctctgatatgaacaactgcattactatttaaaaaaaagtgggccaggtgtaatgacttatgcttataatcccagcactttgggaggccaaggcaggcagatcacaggcagatgacttgagaccaggagtttgaggccagcctggccaacatggtgaaaccccatctctactgaaaatataaaaattagctgggcgtgggggtgcatgcctgtaatcccagtgggtggctgaggcaggagaatcacttgaactctggaggcggaggttgcagtgagctaagatcacaccactgcactccagcctgggcgacagagcgagactctgtctcaaaaaactaatattaatataaaataaataataaaatgtgcttacatagacttaatattgatgataaaaattttgaataacacgttactattgcatagcacatcttattgctcgaaatgagacctaggtatatgacatttgtcaacatacatcaaaagattgttgatttgggaaaatgatcataaggctgataagttttctcagttcaatacatttgagctcatgacatgttttgaactctgaccccctaaaaaggaagcgttaggcatgctaatgggataaatcagccaaatcccatctatctgaccttattaatgtaactctaggatttagattctgaccttccataattattgacacctatttaatttatcttctcatcaatagtgaagcctagtgcagctgctatggcacatgtaaatacatcactgttgccagcacaggctgattggcattcatgcttgagtgtcttttttattttctccttggctgctgggagtagcctgagcagcgcagacactaaagagcttcatctattaggcatgacagatttgtattcagcgataaacgcctgaccttgctctactctctcatccattcccatcatcccctcgccagatgaaagagtctgcttaactcctgtttcctggctgtttccttggcaacaataactgagtcagtctgacagaataactaatagaataccttggtagtgagattaaagtgctttaaaaaaagtcgtcacccacagaattataaatgagaaatgtttaaaatcggaattttaagatgataccaatcagtgacattatgatttccttattaacccatttcattttgtggtaatatttacagacttttcccaaggtattttaggccgggaccagagtatttaagcttttaggatccatttgtgttatatgatgaaaacagattggttttgtaataaaacttgtattgctttagatgttgaattagtgggtagaagatatgtacagacagtgtcccaactgggaagaaggactttgtaatgaaatatgtactatctatttttctcattcctcttctgaaggagatgtacctttttaaggcattataactagaagatcataaagctacaagtatcatctccctttaggattctgtcacttttagcccaattcttactatctgaaagattcatcagcattcttgtttcatattgttttttgacaacacatcacgaggttgtcaaaagtctcagaatccctgtggaattcttaaatttggactgcaaattatagcataagctgaaagctaaacttctgaatttttcagtgaaactttgatggaattttatagaataattttagattactttatatcttcataagaatgcatgcagctaatagatacaatatagagagatggagcagagagaccatttgggtaaagcattttctactctgaatgtctccagtgattgcatcatgatttattagttttgccttgggctcaaataaattttaaatgatttctaaatatctattttttctattattctaattatatttttctaatctcatttaatattttctgaggccacctaatatttggatgtgcttaactgggtctaataaataatagaggacagaaataatgtaataacattaatttagataatctactctagaactctatattaaatgaaagcttatcatttatgattatgtcttgctattactacacattttgagagtgcaattaacttctattatcacaatgataattacagttggcaacagaagtcaacaaagcctatttatctgttttgcaattttaaaaatttagacatttccactcacatttagtacctctgattagaatggacattttctgctttgcagtctttttatagaggtttaatataaatttattccaattgttattgccagtgctcatttcaggaaacctgcttaaccacagaatgaagtctgaaggaggtgagcacatcaaaatgtagagatgactgttcaccagtcttcagatgactggatggtctgtttctgtccccatggatatcagaagaagcagttgtctttgctaatagatttgagagggaaaaatctttcaaatagtgtgtttgacttgctctaagaacatgaaacaaaactatattagcatccaattgctgctgtaacatattaccaataatttagtagcttaaaccaacataaatgtattattttaaattctaaaggctagaagtctaaattcagtctaaccagctaaagtgaaagcatcaatgaatttcttggctcatggccccttccttatattccttcaaactcctgctcctcctcctatcctgattcagaccctcctgaatcaactcataagacctttgttattgcattgagcttatttagataaaccaggataacctcctcattttaaaaatccttaatttatttatatccgtaatgtctttttttaccatgtaaattaacaatttctagggattgggatatggatatctttttttttttttttttggagggtatggggtttttttcatcctaccacaaaaacacttattcttctaaaatgtgtgcatacagagtaggcagtcggtaactattcctcaaaggtataaatgagcatgaatacacagaaatgtgcaagaaataatatggaaaaacaccagtggccaggcacagtggctgaaggctgtaatcccattgatttcagaggtcaggagttgggagacatgacaagaccctgagatatacctaatgctaaatgacaagttaatgggtgcagcacaccagcgtggcacatgtatacatatgtaactaaccagcacattatgcacatgtaccctaaaacttaaagtatagtaataataaataaataaataaattttaaaaaataattagccaggtatggtcctgcaagtctatagtcctagctactcaggagtctgaggcaggaagatcgcttgagcctgagggcccaaggttacagcgagctatgattgcacccctgcactttagcctagatgacagtgaggccttgtagctaaaaaagaataaaaaagaagagaaaattaacaagagcttgtaaaaataagaagtgtaactttcaataaatcatttaagagtaacctaacaactgcgtggtcagatctctagttgagtaaaatagagaaaaggggatgaaaagtagagtttgaatttgcagttgaatggttagttgtgctggcctctagattttgtttgtgtgattccatgggagactcaaaattaaggagtggagaagatataagctaagaaaaataaggcaattaaagacatcaaaataaatataatggaggggctatgctttagattgaagtttatagcctcatagtgaattctagatcttctttagctttattctactagataccgctagggagagagaagcaaaatagaaggaaaagaagcattaagcagagagtctaagcaattgtttaaaaatcagcttgcagtttgtgatatgataattattattatgatcctcgtctgtgatagcattaccataattactatgctaaaaatatcataactactttataatgaagtaaaatgtattaatatttagagtggtacattttacacaaaatacattctcaaagggtttacaaagctagataatgtagttaaaaatacacatcaaaagaaagaaagaagaaaggaagaaaagatgaaacaaaaagtggaggtggacttcactgtacttgaagataagtctttagggtgtgatattaaggttgaagggactaaaacctagtgagacaaaaagttgtattactgtgcccatgcaataataaattgcttaatacatttaattttctatccaactgattaatgagctaatgtagacaatcttttgttcacattcatatatcttctgtttttagttttctccatctttaaagcattgaaaggtgtaaattgagtcagttgttgttgatttatgaagaaatgggctgatcacttcccggttgcccttctatgtctgggacacctaggccattatcctgctaacactacatcctgttgccacctatatggtttttctctactaatcttaaaatatcataaaggcatttatttataaaattatgtgcctaacttctatatgctggacctgatgtcattttaaaataatatatgtcttgaagtagcttaaacttgattggggaagatagatgagtatagcaataaattagaccagattgaagcatacatatttgattttcatacatcttttaaggctcaaaacgtatctggtctttattataatgctgtactagtcagctagggcttccatcgaaaatagcatggactgggtaactttaacaacagacacttatttgctcacagttctggaggttagaagtccatgattaatatgcaggcaaattcatttactggtaagggctctcttcctcttctgcagaaggccaccttcttactgtgtcttcgcatgactttcttttgtttgcatactgaaacagagagagagagatttgatgtctcttcctcatgttataaggataccagtcttattggattagagtctcactgttgtgccctcacttaaccttaattacctccttaaaagccctgtctctaaatacagtcacattgggggttagagcttcaacgtatcaattttgaggctacacaactcagtcagctgaaggcatcagctgatgccttctcagattacatcagtaccctaaaatgcccctgttctctgacttcctacagagtacattgtctaaatttcacaactagaaattgattttagaattgttatttgaatattttgacttatatcatctcaaaattgttagctcagtgtagaatggtactatgtttcattttcagaatagagttttttttttaattctgaaacaattccaagcaatgaaaagttgcaagaatactacaaaagttgtaaaaatagtagaaagaattcttatgttctctttttacagagaccttactaagattttgccgattatcccaataatatccttgaaagtaaagggtaagatccaggatcattcattgtacatagttttcctattttctagtttctttcaatctgtaacactttttccatttttctttgaccttcatgaccttgagacttttgaagattacaagccagtcacttcatagaatgtccatcaacatgaatttatccagtgtttcgtgatgattagacctaagttatgcattttgagttgggctagcacagaactgatgctgttgttctcattgcatcacattgggtggcatatgacatcaatttgtcccatgattgatggtgataacttagacatttattaatatggttactgccagatttccctactttaaagttactttgcccccctttataatttgttttctggctgggaacagtgctcacacatgtaatccaatcactttgggaggctatggcatgagaattgtttgagcctagtagtttgagaccagcctcagtcacatacgggagaccccatccctacaaaacgtttttaaaaataagcccagctgtggtggtatgtgcctgtggtcccagctagtctggaggctgagacagagaggattgcttgagcccacgaattcaaggctgcagttagctgtgatggcgccatgctccagcctgtgtgacatagcaagacctcttctcaataataataataatagtaatagtaatttgtattctgtagagaggtattttgatgcagaataacggcctattcctcatgttccttttctccattagttttaatagccacttatgtttcttgcctaaatcagttattactaataagttgccaaatggtaagtttcaactcctatagttccttccatttgtattggtttgtctcctgaaagaagaacattttcttccccctatgtatttatttattcatttatattcatgtggactcatgatctttattttattcaatgggttattacctgttattatcattccttattttgatattcgaattgtcccagattcaagcagtaggagtccttctagcttcctactatgccctttgacatgttttaattacattgtaatctgaatctttcctgaaatactttacccacaaagctctaaatgatgcaagcacatggagatccccagaatatagtttcaattctgccgttgctagtttcttcctagctgtgcagtttcaacaagtaaaacctgagccttaatttcctattctgtgaaatggaatgggaattaacttgcccagttctttaataataataatagctaatatttgttgagcactatatatttgtcctctaatgattgacaacaggtagggattaatctgtttttatctgaataactagtaagttcctaaaggaggtttgaaccccaaaaaaggggcttcagggtcatagcaagaagataataaaggtaaattctattactattacatgttatttatattgtaatgagagttgttctaaataagagttgtcaacattgttgccttggagtctgaactagcagaggattcacctaatttcagctagaagttagaggtatatgagtttcactcacttaagagacttttcttttcttttctttctttctttttttttttttttttgtttgagacagagtcttgctttgttgcacaggctggagtgcagtggcacaatcttagctcactgcaacctccacctcccaggttccagcaattctcctgcatcagcctcccaagtagctgggattataggcaggcaccaccacgcctggttaatttttgtattattagtagagacaggggttttgccatgttgagcaggctggtctgcaactcctgacctcaagtgatccacctacctcagactcccaaactgctgggattacagtgtgagccactgtgcccagccacttaggagactttccatttcccttatacccttagcatgaaatgagaaaagagtaaggggagtttttgtgatttactctgagtatcaggagagacatatataaatttacttgttctaagataatagttctaattaaagaagaatttttagcaacctcttagtttcaaacactataatgttcacagcaaataaatagaaaggagaaagaaactgtttcagtgttgaagtaaagtcagagaaaagagagagacagaaaaaggagaacgaggacaataggtacaagggagggagggaaagaagaaagggaagaaagggagtagagtcagagaaaagaaagatagaagaagcaggacaaaagggacaaaggaagggaggtggggaagaaaggagaaagggaagaaagaaagggaaagccggagggagggagagaaagaaacaccgagctacctgtgtagcagaggtctcggggatcggatgtctagttgtgctggtcccatctcttgataagccctgagcactcatatatcttgtgtagtaaataacctaattctaatagcttccaaggaaagcttgcaaaaaaaatgggcagaggaatggagagagcctgttttaagatagagagagggctaccatccttgcatgtggcatctgaaagataaccacacagagcatattttggagattcaatttttatgtaatgggtgtcgttactatccagaccatgggggaggaagacatgcaccctttaatcctgtagcaccttcaccttcatcttgttccacacaattaacatttatttggatggctgtcttttttgctttcctaataacagtgtaattttactttacatgtgagatatagcataacaaatcgaataggaaataattataatcatgaaatactctcacagaggcatctccttccagctagttccaggtggcccaaggtcgattgtgaacactcaggatggatggcgtgtctgtcctttctctggaggtgtcttgggcacacagacctatatgtgcacttggcattgtgcttgttcacaatgttaaagttgtgatgttagcaagtcagagatgagtaggggcctgcagaaagagctagttagattaatccttaaggagtgagccatgaaatatttcatgggctgaaatgagaggcatgaccagtactaaatcagcagaccttgggaccctttaacagcggtgctaacccaaaatatttttaggcctgaaaaaaatgggcaaagtgatctttacataaattattctctgggctgctagtcacacaccagcatgctgggaacaataagctcacaggggtatttgttcaaaatatttgatttcccataaggctacttagccaagaaaacgtagaggacaatttacttttcactgacatgtttgttgtcctttcttctacagccattctcccaggatgaggataaaatatggagtcttgattctgagacacagtttgtctttactagagatgccatcaaggttctggtgattccctaggacaagtggcagtgcttcctgactaccactgggctgtgtgtgtgtgtgtgtgtgtgtatttgtgtgtgtgtgcgtgtgcgtgtgagtgttgacattgatttctctcctcttggcatgtagaagtcccaagtgccccactgacccattacctgagcctgtaattacttcaggagtagggaatgaaaagggcatatctcctctgctttcagggaatgacagactcgggaaaataagcaggccctgcattaaggcaaatctctcaggagagcttaaagactcaagtcttgactcggatgcatttttacatcagtagaggccatgctcattaccagtgaagactgctgaagttgtggagttggcatatgaccctgaaactgcttcaccataaagacagattttaatgcccatatgtgacatgcaggcacaaaaatgtaatcgctataattagccagcatccctttttcatagtgctactatttcgtgactacttgcctacttcattttgttaaagataaaatgttcgtcctatttttaaaaagtaagttgtttcttcacaagccatttttagggatacattcatttttaaaggtattttatagggagataagtgatcattccgtgtgtttttattcttttgattgtctaggatctagattttgcaattttgtgaatctgtttccaaactctgcaagggtgtctatattataagttatataaaagccctctgcctaattttttgatgtatatgtatttccagcctaatatccaagctgtattgatgtgggtgagtgagcattgctccctcagacagtctgcttagctgatttttgaagttaattatggtgcagtgaaatctaaaggtcagaccacatctattttcctggtttgttcaatgctatgggcatacgggcaccagataaatcccttaactgctgacctaactaataactttcctgtacactttaacctatttcctgttccaggttttcagactctttattgtgctgtagggtcttcttcagaatgggttattacagagcacatcacccaaaggctaccatgaagacccccttaggaatttcaaatcataatgtgtaaggtagcctttctgcaatacacccccaagttatcagtgtatttcaccgattgcctggattatttcattttatccttgccacttaaggagaaaattaaatttcagagagaattttgaaaaacatgaaatgcttagggttagttgctaagggatggttagctcacagttttgaaaattgtcttgttatttatacgttcatacatttaccccattcatttatgaattcattcattcagtgatttcttattgagcactaccctaggatatatcaccatgcaaaattccgtggtatacaaaaactcaagaatcatagaacctgacataattacatgatcataacacgaactacaaatccaggcccagcttctatcagtgagagacagaaccagggtacatactctgtgcagtgcatggtagcagaaacttgaggaggttcaaaagaataggggaacacaaagcaatgggaacccagggtagtaactaaagcagcatgttttgtatttgtttagggtgtttttaattttaagttttatttttttcttgaagcctatgctggagttcagtggcatgatcatgactcagtgcagccttgacacttgagcctgggctcaagtgatcccttttgcctcagcttccaagtagctagaacttatggtgccttctttaaaataactcataatgttcatccatgattaaaataatgtgctatgactctcaatgaaaatttaaagccaatagttgtcatttgtatttgcttatctaatcctaaatcagctgtccccagaacacttctgttgtactttcatgaaacgcttgatccttttaggattattgttcctctaatttaaagttctatttcttaatattcttagaacagtattaaatttattaagacattaggttctgaatggattcttctgccacagtttgaatctaaatattctcagtaggaaaaggttaagcatgtgagtgtccttattcattatttgcctttatattaactggaccaatacatgggggtttagaagaagaatctagaaacacagctggactagggagaggtgagtgaggcactttcttggggtatacaatttaaggggattccaaagcactctgtaatcaagataatattttaacacaataatttttaaaaattaaaattaatgctaaaatgccaaaattcacaaacaacataccaaaatcttaaattcagacagaattggtaatactgattttcctcttgctgcaggcttcagtgtggtgcagcatggcagtgatctagaacagatggctcttgcattctataacagttatagagctttaactctgggctacatcatttctcagaatcttttaagacctagtgatatggtttggctctgcgtccccacccaaatcttgtcctgaatactcacgtgttgtgggagggagcctgtaggagtggaagataattgaatcatggggcaggtcttttctgtgctgttctcttgagagtgaataagtctcacaagatctgatggttttaaaaatgggagtttccctgcacaagctctctctctttgcctactgccatccatgtaagatgtgacttgctcctccttgccttccaccatgattgggaggcctccccagccatgtggaactgtaagtccattaaaacttcttcttcttcttctcagtctcaggtttgtctttatcacagtgtgaaaatggacaaatacacctagctatttgattttctggtaattcaaaaaaaatgcaattgtttatcactggaacagttttacaaataggcaatgagcttgagtatgtctggattatctttaaaggtcaaactatagccaggaaattaatatggattaattaaccaatgagtaagctgcagagtttggccttgaactttcccttctgacttctggttcagtgatcttgttaagtcatcatactacttgggtcccgaatgctcaagaggtagaagtaggttatttatcatttagatctcctgtctgtgcagtctcctagagaggttctatgcaaattcaatttcacccttaacacaaaatgaatacaccacatgggagcagacagagaagaaaagtaagttaattcccatctgtgattatgtaaatgcattctagttttcatgcatgcatttaatgggttggcaatcataattttaatactactggaaatggtactatttggagatttgtaaattaaatgtgttcatgtattaattggcatccttagatttctagatcttggaaaaacagggtgagaagatgctgtgactaaaaggttctatgcatggaagaaatgtgttctttctggtgctatttcttgacacagaatttccttagcaggcagtttagatttccttaataaagaaagccaagcatcttcttgggatacctgaataatattctgaaagtggcagactactcttgttggcaactgaaaatgtacaagggccacaagggctgttagattcaagcccatttatttcccgagcttatctgtctcggaaagatcttagtcacagagtgtttagccccaaatttacaaacattgtttttctctcatggcccttgctttataatggggctctagtacaaggaaatgatgtgtatttttatttatttgtattttgttaagtaatcagatttcagactacacaagtaggatctaacacaaaagagttaaatacatgtatttgcagaacacaaattgtttttgaaaggattgtgattttattcatacactggcttcattaacaccatgacgagctgttcacattataagctaagttacctgatttcatttatgctttgctgtcccctcccacgtgcatatcccatttttagaaggtgctttctgtgcctgggaagtagaatgcattttttgcagcgaataggttattttcttatcagtctctgacaatttgtagtctcataccctcactttctgccatcatgcctgcctggaagaatcattctagtgtgaccaacttttgaatgtcctctttagtatatttgtgagtgatgcctgaggcattttgtctgttcgccttctttcacacctccctgtgacccaagatgagagagtaatctgacaagcagaggcggcaggctgtttgaaaccctagcttggctttactcgatctctgtcattttgtattttatttgactgtggcagtttcatgggtatatcagagccccccagttatcagttaggggaagctaataaaatccctgacacatcagattgttttctctttctttctattgaactctttggcaattgggcttgatgggttaagactcaaaggaggcgtcttatttcccattgctgcctaacctagattcttagctaaggacagctagcttcttagcacattttgccatctgccaaatgcagagtggaatgtcctgttcccagctttctgccatgtgcttggttcttgctcgcatttgggactcatttgcttacttgcctgcctggtactgggaaggtatatatggtgcttccttgcaagctgaaactctgggcatgttattctctccaggtccagaattcatgtttcttcaactcaagaacctgttcagcgggtgctgacttggatgtgtgtgttatggcttggccacatggtactcaagatgtaataagaggagataattcactctgagacttctaattaaggttcaacaattgaagatctaacaacagattttaagtcctcattttgttactggaaagggatcctgatctagaccccaagagagggttgttggatctagaacaataaagaactcaggaaaagtccacagagtaaagtgaaagcaagtttattgagaatgtaaaggaataaaagaatgactatgccatagacataggggagtgtttccaaaagcatgagaaagaatgtgcccaccttaggcacaatacttgtttcaatataaggtaacaaaagcaaaaaatcatggggtagatgtgctctactacaagaatgcctgataaaagattgttaatcttcgtgtaattactgttttccacaagaatctgtattattatctttttaaagcgaaacttattcttaaaataggaatgcttttgttcttaagacatagggacatcaggacatttcatgaatctgttaagtcctgggtctggtaaattctggatctgtttggtaaacattattaacgtgttttcttaaccataaacatcctctaagaatgcctaacttcctgagaatgcagcccagtagatctcagcctcattttacccagcccctattcaagatggagtcactctggctccaacgcctctgacaatttaaatgtagaagaaaaagtctaagattgagtagagatcaaagttgtgtcaagaacagaaggaaacagtgagacatgttgcagaataaccacaaagagtcattttacctactgcatgtcttatgtgatagaagtagatccttctattacccttctactgtcttttatgttcttaaattgggcccatttttctggcctttcaaaagagaatttctgtttgacagtgaactctaaattgaaaaactttaaatgactatcctatagaagagaattgtgtctgatgctctcttacgtttataatctttacttcaaactttgatccaaaaaaaaaaaaaaggaaggaaaaaaaaaaaaagaggaagacgtggttcctaacctcaaacagcttatactaaagtttgtttttctccctcaatcagaacttagaaagagtctccagggagatgacctgattaagaaattaaactgttcataggtgaccatgtgttacttaccacagatagcatattcatatttaaagagaggctttctgcctcgtgatgctgtaaagttttaaatggtggtttctgtttgccatcgtataatagctagacttagaggacaataatctaggtgagagtaagggctatgattttcctgtgctttatttaagctcaaaatacatttacttatccattgttttctattacgttttatttctgggttttatcttttttccttgtttgtttatatttatctcactgttctctttcacttcttttttctctttactaccctcaaatagataatcactggaagagcaatgcatccgagaaaaataaattaactttaatccaagagtaaaactcaacgtatttttcagaaatttagaaactgccagtttatatcagtggctttttgtgtgtttgctttcttttatatattttctattatgaaacataagacttatatggaagaatgcacgtaaagacatacacagaaaaacacacacacacaatggaggcagctccatcaattctcacttaattcctttgagtcaagaaacagaacattgacagctcccaaagaaactccttcaagacctttctaattgcttgcctatgtttcacaccaaaggaagacactgtcctgaattgtattgaaacttctttctaagtgatatatggtctaggaagaatgtatccacacatttctacagctacttagtaccaatagattttgtgaaaggattagttataaataatcaatgttgattttgttagtataatgtaatttaattattttctagtttgaacttttaaaatcctatttgttgtcatatattacaaattttgcgtatgtacataaaaataaatttctttgatagattgaaaagaaaaaccaaaaaacttgtttctaacttttatgagagttgtacttcccaagcacccatccagaaacactctaattcagtagttgttgaattatatatgaatggaatcccaccatgtatattattttgtgtctagcctttttttctgggcattcttttgggagagtcgtccatgttgcatagctatagtttgctcaatgaattgctattgagtgtttcatggtatcagtataccataatttacttatgcgttctaccaatgatgggtgtttggattgtatctgatttgtggctgttttgctagaatgaacatgcttggacatggctttcctatgcagcaagcacatgcctttctgttggtgtacatctaagtgtggaactgcacattttcaaactcattagataatgtccatctagttgccaaagtggttatatcaatttatattttcacctagtacttataagagttgcaattactctatattctcataaacactgtcattttaattttagccattttatgggcaggtatagaatctcattgtagctttaatatgtacttccctgatgactaatgagggtagtcagctttttgtatatttgttgaccgtttgggtgtcttttgtgaaatgcctactcaggtctcttgtctatttttagattgataggttttccatgtgtattgaatctactgatcagtttatagagacagtacaattttaatagtattttaatattttataatatttaataattcaatcttccaatactggatatctggtatggtgattctttgcaattttgactaagtgttctaaaacttcaatatttattaaatcctctttattattttttaaaaatattttatagttttctgtgtgcaagccttgccaatcttgtattagatttatgttagaatttctggtctctgtctctgtgtgtgtgtgtctgtccgtctctgtctttctctttctttctcctcttccttcattccttccctccctccctccctccctccttccttccttccttctttccttctttccttagctggttcttccagtagagcagtggttcttaaccccaggcaattttcgtctgctgggaagatttggtaatgagaagacatttttgactgtcattaactgagaaaacactgctgatatctagtaagtagaggccagagatgcctttaaaaacttatttttaaatgttgtccttttttttccttccagtagttctcaatggaaaggtggttctgagttttctggtctaccattacaggaagcagaattcttgttttatttgtctgtgcatttgttaatttatttctaggtaggaatctaagaaaatcagcattgaaaactctgaaagtattttttttttctgggaaatagtgcatattcaactgtaaactattgaaaatgatgacgtatttaacaagatatgctcatttcatagaagtcctaatttgaatgaaaaccattttttctttaatttctataatcatagcttgaagaatgtctaactcatacttatgcagaagagatgtccacttgctctcactatccctgagttagaaacgaaatatttaaatgattaaaaagtaattctggaataaagtgagatgacttgttgctcctcagtttttcagctgaataaacacagcttcataaattgtgacattaatatcatcaatagttaaatgtgttgacagataggcaaagcctgtagttggcatttctctcttctcagtgttatgtgggtatattaaacgactgttccatatcatagaagtagattggaggttaagcaaaataagataatttagcaatcagcaagttttaaatttttaagaacatccaaacccaaccaagaaaacaaaagagggcttttgccactttggtctaagtttaagagtaagatctaaatccagcagagacgtctaagtctaaagagaccaccaacttaaatttacaagaaaaaaacaaacaaccctatcaaaaattgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattgtcagtaagctatcgcaaggacaaaaaaccaaacatcgcatgttctcgctcataggtaggaattgaacaatgagaacacatggacacaggaaggggaacatcacactctggggactgttgtggggtggggggaggggggagggatagcattaggagatatacctaatgctaaatgacaagttactgggtgtagcacaccaacatggcacatgtatacatatgtaactaacctgcacattgtgcacatgtaccctaaaacttaaagtataataataataaaataaaataaaaaaagacaaaaaaaagaaagaaagattaaaaaaaaaaaagagagaccaccaactttgggtttgaattctctttcctgcttgttagttgcagcagctcagaaaaatgtccactctgatatccctgcttccctcataaacaaggatttttacaattttaggttatcagtctgcctttcaacaatacaaagacttgtttaaattgctttaaaagaggaagaaaaaaaattatctcatcatgtttagatcctcagtcttgattctgagcatttatgctaatgggatacatatatgtccatcttgtacattttccctggaaacctccaatcctgttggaattaattgaataactgcatatgcaatagaacctctaagtataatgaatctgaaaagaaatgagaacttggagattcagccaagcacaagtcatgttagatattttagttgttttgcaatttgcagtttcaattgctgaaaattctcttgaatgcttcattgtctcactgatctaccaggaaatgagagttgtgttaagagggaaaaaaagagaagaaaacacccatttcatcgtggcctgaatgttgatctgagtggatactggagactgttttcacgattgcttttgagctgcattgagtgactctaggcatgcatttagaagccactacaggggtaaaaaaaaacaaatcaaaaccaaaaagccttctaaataagtaaaatcttgtcttatatttaggagatgttataccaaaaatgaatttaatgcattttaggacataaaaacaccgctaacattgaatgaagaaaaatacttagcctttatattaatagcccatttttctatagcagtctcttcttataatactaaaaaaaaagtcaataactatgaaaattaagtgaatatatactctgctaagtactttttattcactttataccccataaaatcctcacaacactatcatgagaaaggttctattgtacagttgacacaaataaatagaatttaaagtggtgaagaaactcgccactcactcatataataaatggcagcttctggatttgaacccagatctgcctttattaagtgcagtgctgctgcattgagtgtgggtgactttacagtgatcaaattatgggtgtatgaataatgtaatggatttatgagagtaatccataagctataacatttcagctgccctcagataagctgtatgtaaggaccttgagacatgttttttagactcttaaagggcctccttaaaaggatgggaagaaaatctattttacttcccaccatagattccatattggcaggattcttggggtagaattggatattattcacactcaaaagatcactgggcagtgaaacataataaggccacagaatatggtgaagtactctgtactaccttgaaacatttttagctttcagcatccaattgtgtaattgcaatgtgtgttgtcattagtacttataagcctttttgcttaattttaaaattggaattaaaatactgacttacattttgaaaattccctaaaaacatcatcctctttcctttggattcttgctcatgactgattcatagaatcaataatatgcagggccagtattgtgagagattttcttttaaatgagtttctagggctccagtgattcaaaaaatcccattaaagtatattttaaaaattaaactgaatccaccaaataacacatccatgaatgcttatttgaaaacaatgtaaaagagaaggttaaagaagttgatgtatattttattgtttttaaaatatttatatgggatgaaaattcagtgaatcagaatcttttattcagaggctgctcggtaaataaactatagaacacgtaagatttatttttatgtagttggatataatttattaattcgatttcaatacagtgagagacttagagtgatttaatgattgacatgataatttataagacttatatttaccctcattcgtgtcccttctggaaatctcataatcttacctgtatatattgattttcattagttcagatatttttcctttaaaaaaacagattctatttttctttatttgcttttatttgtttactttggcttttttggtaacagctttattaagatataattcatatagtataaatcctattattctttagtcacatggaaataaaagttgaccttataccagatcaacaggtattgtaattagaaaagtttagaatgtagattactttcagaattattaaagcaaaagcttttatttttgtcaaaaacctgcttttttttttaagaaatagtatatgcatttcttgtcttaacaaactaatggtaaatcccaggtgttaaacggactcaatcccattaaatagccatattttctttcatttttaactgataaatttcagaaccatactgcttcactttctgtcattttattatgtaatcttaactaagccttgccaatgatgttttaattatacctttactatattagagtcatatttattctattgctctaaatttctgaattttctgaagctttcattctctctaaatttcaagcagaattttacagttctgaagatttaaattgtgaacatgaagatagactataaattactgattgaaaaaagacaagtcaaatagccctctggaaattggtatcccatagccctttgcaatcgtaacttgtgcataatgcactcatgtttatgtaaatgacatcctaccaaacagtcatttataataccagttagcatttgtattgaatcctggcagtgctttatttctaaattgtacccatttttaatgaacaccccccccaccccaagtaatgtcttaaaaagtaatgtcaggtgcaaattatttttaaatagttaggttttgtttctgtataagatatttaactttgaaaagaaaagtgacagcctgccaagtgcataatgcactctcctgagtatcagtacttgcatattttaagagaaatcacataaaaaagtaatagagtatctcagtataaagcaaactcaaaaagtgtttttctttcatgttagcttcagcatattttaaaatctggtgggccattgagaaaacagttgcgatgttatttttaaaatgtggaagccacaatttttttttaaatcaggcatgttgtgtagtgtacataccaagcccatgagcccacaaaaaggaacagaaaaatatattctctttgcaaagtagagtggtgggttattgacatgcagatcagccacgttggactgaattgctcctacacagaataactgaggacttcaaatcactttgaaaagaccaggccagggctatagatttctgtgggccctggctccttgattacatttatggttggattcacaaatttataaaaataagccagttcgtttatttggggacaaatggaatacagatgaagaaatttttatacacttgatgaaagaaatgtgtccaagtgcaattattattttgaacgttgaaagcaaggcccactgccatcaatgctaacacatgaactgttgcattctctgcgttgaaagctaagcccttgtttgaaatgaactcttaaggtttttccctttcttcaagaaggccttccaattttcaggtttttctccttaaaaaaatacttaatatttattagctaaccaatgatttggagaaaatagacttttcaagaggaaagggaaaaaatcacactcatggattattggtggtaatttgttgtatggcatagcagttcactggttgtatgccaatgatggttttctgaggtgtgggagatgaactaaaatctttcttaacagaaagagaattagcattacaagaaatacacacaaaataaaagacatttccatgatgatatctaatatattttcatggagacttgagtatctatgtcatctttgaaaattagttttgcttgttttacctagcatattaaagttggggtgtgtgtgtgtgtggttagtggcagatacgggtgggggcagggtagtatagaaactagtagtgacttaattgaatgaaatgactagaagatagctttctaaatcccatttcaaaactggaccatccaatttcactcttagatttgattcccccatcccagtgctagaattcggccagtagttgtaaaaaatacaagcactgtggtggttgcattttcttaatgaaggtaacatttgagttaccaaacagtttacctaactgttttgtacataaaagtaagagatattcttttatgataaaaatctattttaggattctcattcatttaatgtgtacatttggttatttggcattaaaagtaaactcaacttgaacaaaaatttttttgtatttgctaaaagataattatgagatgttttaatgggaagattaaaaattttctttaagacgaatatttttcttactatactgtattctgtggcaactttatgattttttttaccaataatctcgagaatatatgcaatggaccagggacaaatccttacccaggatgtgggagcggggttgaggggggtgctgtggggaatggttcaaagtagattagataaatttatgggtctgccaaatcctcataatgggttgaacgatcgtgacacacaatgttacattttgctgacctgttacttagtaaaatgtcaaaatggagccagatttgcaacacatgatgttaatggtggagagtgtccaggttcttggccacttgaacaaagaattggacaaaacgcacaaacaaagcaagaaaggcacaaagggatttcttgaaaatgaaagtacactccacagtgtgggagctagcccgagcataggagctcaaaaagctccgttacagaatttttgggagtttaaataccccctagaggattccattgtttatttgggatacgccttatgtaaatggagaggaagaagtaaagtgacaaagtcatctagttggcctgcgccctatggagaggatatttcctgtcatagctgaatcagccttatgttccgtgtctccagaccctgttttcctgcttcaatggaatgacttcaactttagttacatggttttgttttcctgatgtttgcaaagttacctctgtcttaactaggataggttcatctttttttgatttgttacacagttgcagctattcattattgcatctttcaaataaacatgaaagtactcttgggtttcagatcaggaattattaaaaatgatttgtagcaaaggaggttgctttaaatccagttcaatatcatacacttcttctacttcattctttgtaaaaattaatctttctaaagttttccttcgatttcaattgaatatttctcaccttttcttgatatataatatatattgctaaccttttaaaaaacagtacacatttatctcacccatttccctaattcctatgtctagactaaagggcagatcctccatattaagttagttttgaaaaagtaaaataaatttattttctcttgtgaccaaaatagtttagattttcaaccagcccatcaagtgaactttcaaataaccaaattcacattgaactattttttagatggaaagttataatcaatgaaaatccagtaaaatgcatatataagtctttcaaatgtcaaaagagaatacctgaactaagctttggaatactaagcatttaaaacattctccattgaaggcatccatcctttattaaaatttgcttatgtgagatcatttaatccatttctacattgggagttattttggctggattgcattggtcaatattacctttataatactgcactgtaagaaagtttacttgctccgtatgaaatttccaatatttgatggtttttgacctacaaaagcagcaagtttcacttgcttcaaactaaaactgcttttcttaagctcctttgaggattaaaggagaataggacagaaggaagcttcagaatccagaccaaattttactactcatcctccaccctttcttttgtcatcttctcccaaacttttatttgcttccaatctttgtgttgctgaatgtttggggctctttagttgttgaatttgtattgctgtttcaaaatcaatggttttccatctgctgcttatatgcagacaactatgagagaatcatggaacctttgcactaaacctgaagattgaattaagggcattcagatttaaccgctttttcaattaaaaaattcctctacagcagaggtcagcaaacttttttttgtaaagaccaggaagtaaatatttcaggctttgcaggccacgtgatctctgttgcacctcctggactctacagttttcaggcaaatgcagccacagaaatcatgtaaatatatagacatgcctgtgttccaataaaacattatttatggacactgaaatttgaatttcacattcttgtcacgtcatgaactgttcttcttcctttgatttttcccccattcatttaaaaatgtaaacattcttcttgtcttatgggccacacaaaacaggcagccagatggatttggtcttcaggtcatctttaccagcctctacgtcacagcatcactgacatgggtcatctgacgtcatcataaacacctctgttgatggggagttgattacacacaagtcagcaaattcccaatgcttcatttgcatttatcagaaatgtagtagaaccatattatgtgtgttattttttatcaaacaaaagacaaagaaggcccccaataatatttttgcagtgacatgattattattacttttttctaaaccagctcttataggcaatattatcttccaaaccactgtgtataattttcgattatctgcactgcaattgtaatatatattttgactactaccttcgtcaaataatactgcatcatagtgtttcgtatataaagcatgtagttttataactagaatttcagatgtcacgcataaagaaacctcatttgagtgattattccatgtcattcttggcttttacgaaattttagacatgtaggttgctttcacttgtttcactgacgattgcccttgtgcatattgttaaatttccaacacttatattcattcctttgggaagaattccagaagtggaattactaattctgagtatataatcatcataatctttgttgaatttactaaaatattatggtccctgtataagtggggacaatatacattaagtcctttatgtgggacaggcaatgcgctaaacactttaaatacattattacatcgaaaccccacaatagttatgtaaaaatataggtcattatccctgcttgtagaggtagaaacatgactgacattaacagttcaaattagaacttaggtctatctgactccaaagcctgtcgggaggcattttatcacctcttaccatttataaatttgcaatgctaatacacccgtaaggtagaatgctactttaattttttttccttctctctctttatcaggtgaaattcaacttaagttttaagtcttattttaacattaaatctgccacaaattattcctcaaacccaacaaggcagaatctactggtcattcctctgtgctcccacctattagaagtaaaggcttattccagtgtattatttttagcatcttgaggaaggtactgtggtacatttatgctgtgtccccctgaggtatcacaaagctttgtacaaagtcagagaccaatgcatgtccacccagtattactacagtgggtcaagatctgcttctggaagcttcgtttcattggcgtacattctttatctctgctataagtccagtaaatcaaatactttggtcttgtccttattttatcatctttgttctcttttctggtatttatctcacctctcaccaccctactgccctgaaaatatcatttttgtgtacttagcctccctcagaatgtgttcctggctcaactctctcaccagcagatagcatgaggctgaccaaggcctccatcctcacatattagactctgtctacttaggaaaactagagactgaaaatgagatcagggccactcttgtagaaattagaaaccttagcaaaccacaaatggcacagattttaactggcagattatttcttattaaaacattttaaaatagttctagttgtaagttgactcagatctggaaaggtatgtgataaagctattttcattgggggttctaagtctaaacatgtggctctgtggagaattaatctgctctgctgtcattgtcttagcatcattatcatcatgattatcacattgttgtagtttccagtcacctcttaggcactaattgaacagtaaggttgcatcaccgctgttggtgctgcttaggtagtattttcacctctttacacattgtggatcattttcttactgactttctctggcctctatattctacacatcttggataggatgtgatttgtaaaaaggaatatacaaattatgcccccaaaatgtagaaatttaacaatctgatgttatataaaaactgttgataattcaactttgtcctagaaaaattatattcaagttatagtctcattaccctgaaattttttattgagttttgtcataaatataaacagtgtacaagtcatggtatatatccagctgtatttcaaccatgaatatgttcttcaaattctagaaatctctatgcgtaaatatcaataatttttatatgaggtgtttattacaattctgaaattaaaatatattgtgtctgaaacttcatggtttgttaatcatgtatgtattatgtggggaagatatttgtataaaatactattcatttgcttcaattagtatagaataaaaacatttatagaattgcgttttaaatttagaatataaccttagagaatgttatttttatttggcataggtttttttcatatattagacaatttgtaattggataagacaatcttcagttgaataaaatactatagctgtattctttaccacatataggaatcaactcttacttaataacaggaagctgtatgtttgctaatgagaagattacataatgcaatttaagtttatgttctgcttacctttatgctgaacaaaactgtttgaatttacaaaaaaatcagaggaaaaattgctctgctaataagcccagtaaagatgatgaataatgaatgttggaatgttattatagaataaagccacaagctatgatatatcttgctgctaaattattttaaatgctgtctgataattatatacttgttttaagtctacatctgtacatgttaaaattgaaatcagagtttctaatcaatactaatttttccttcttggttgggtgggaggagaatgttcatgatagagaatatgttttacagttagaatgttaaaagaaaatcatatttaaattaatagatgtttgtttagggcaagtgttactccagggcagggattactgaggaaattttagaaaaacattgaagtaagactatgatgattaatggaattattaccctgatgtattctgtggaaagaattaagggggaaaatacattttatcattaaggaaacaaaatatgaattgcatatttaacacttcattaaatatgtagattgctgtgaaatctggtgagaaagttaaggatagtgagatgccataaagccatcatccaacacacgttcatttgttctatccatgataaagtgagaaaaattagaaaagagccggagagccagagttagacagacatgaaaaatgggacattggaaacaaaagcaaatcgctggggatacgtatttccaaaggtaaactagggaccattgtaaccactctgaaatacaaaatatcatttctgtaaactgtgaaatactgtaagctgcatttaatagtgaaaattatgttaaatattatagcaatgccaaatgaagtgattggccactgcttgtttcttgcatttttgatccaagtgcacatttcttattgttgtcttcccattcagattcacaagtggtcagacaacctctatctcagatatattacgtaaacttccaatcatacgcatgtctttggtggttttgatttgaattcatgattctacagtctctgttccccaggattatttaacttattaaaatgatacttgtaaatctatttttaatatttgtgaaagtcaaaactctcctttgtaatttgcatatttaactcttttttcaaatacaatgtaatactaacggagcagctattaggtgcttgacactgtggttaataattttacatgtatttttttaaatattaataataaatctgtttggggtacatattttatgattaaaaaattacaaaccagagaagttaagtaacttcccttgagttttatacctactgctcacagttctataaagcttactctgtacttaattctactattagtgaaaagacattcagtttttgtaaaatgatttattggagggtttgaggatccactcagtgataaataccctgaggctctatgcaaaccctattttgagaaagaacacaatttaaagattctcttctaagtgcctaacagcaacgttgtattttggaagttataagtgaatttattcaattatttcttctctagttgttgttatccaattgctgcatgagttttaaccaactgagtgactgattttaaaattttcagttttcaggttggcttgcatataaactaaatctaagagattgcttgagaaactgaatgccaatggcctaaatgcccttagctggtatagttgtgatgctcagtgctaattttactgtaatagatatagaaatagaaataaaaatagttttaaccattatattttggttaactcattaaccaattggcttttcttttcttatggaattgtggtatctgatagcaatgtaagcaaatataatttttcaaaaggggaaccagaatttatgtagatgcatagatagccccataatcaccacttctcacaatcacaatcttcttgcctgagaaaaactgttgttttaatggagaacataaagtttcattaagatacagattttttttcagctgattcttctttatttctgtaaaattcagtagtctagaaaaactttatcttggaaaacatgtagtaaacttgattgaccatattagctttgctccaccattaggccattataccgaaactcttagctgtcagattcaattcagactttaattaaattgccttgtggtctgacctgaaagagtgaatgtcacaggacttctcaggaattaacatgatggttattgcagaagtagatagaaggaatggaaaatcacttaaaactagttagtgtgaaagccctattttgggtatttcccatgttttgcaagcatcagctctttctgacctttagccttccaaaaatcactctaaccattttatctcccttttgcatgcatatctttgccaaatgcccctccttccatattcagtattcagtcattttcttgtgaattctagaacaaccaaaaatagttcttgtatgtctactaagtgctttaactcctatgctggacactgtacagatcatcgtgagcaaaacaggcattgcatccaccctcaagaagcttatattccaccatgggagacagatgttcatcaacacagtctttgcatatgtcataacaagttactataagtgctacaaaaatgtatgtgcaatatgcaaatacattggagggtactaggaaaatatgtaacagaggatcttatccaggcttttctaggaaattgacatttgagttgagatctaaatgaggcactggaattcactgggcgaagttgggggatggtggaggattgagtgctggtggtcccaaactggggaacaatatagacaagacctacaaaaggaagaggcaaggctttcagaaactgaaggatgggttttggggctagatcagtgaagcagagtgggggtgtgaagggagctagagagatgaacagcagcagttcccagaggccctgcaagtcattctaaggcctcaaatctgagctcattagaaaattctatgtgcaaccagccttattagggtcatttaatgacttcttagtttattcctcttgaaataatttaaggatacctagttgtaatgtgtttttaagtaggaatgctctttcttgtgaagtcattttctgttttagaatttctgccaattaggtcatagctatttttcctttggtttttctttgtttcattctttctattactttcttccaccttttctgcttttgaaaataattttcatgtctattcacagtcttcatctctcccctctgtgattatggcacttcaacgtgtcacggtccttttctccacgttttcttgctatacccgtctcatcttccagttctttcttcttggctggaattaagtcctgagtaatcatttttctcattgctttctttactttctggatgatggaatcatcagtgaggcacatcaggaacatatcagatgatgggctctcagctgaatcacactttgagcagatgcacaggtaactgaagcttcccatccctgaagtgccttccctgtatgccatttttaaatattttacagaaaagatggacccacagttttccttcatgagattggttagtattctattcctgtaataacacttttcatttttcttttgttttgttcttaaccaattgctttctgttgtgttttcttttaaaacacttttaggtttaactttattatttaatacatgttcaatctctagaacactacaactaatgattctaagtaatagaacaattaagcacagtgtaacaaaaccataatttgtaaatatttaatatttttaagaagcatttccaagttgatgaaaaactgtatacataataaacaggcaaatactagttagtttcaagttctatcaagttcatagtcagcaatttcagttttgtggggttcttcaaaatgttttgttaaatccacaacattgtttactatggcaaggaaaaggactggaaaatttgccccctgcttgttgaactctctacattcttatgataccacttgacattacttagttgtgggttatttaagataatcagttatttgttcagtgagacaacattgctctgtaagagggtcctgtaagactgggaggggagctcagtgatcagatattcaatcagatcttcttgcatttcccttagtaacatgatactctgggccaggctcattcctgtaatcccagcactttaggaagctaaggcaggtggatcacctgaggtcaggagtttgagaccagcctggtcaacatagtgaaaccccatctctacaaaaaatacaaaaattagccaggtgtgtgtggtggcacatgcctgtagtcccagctactttggaggctgaggcaggagaatagcttgaacccaggaggtggaggttgcagtgagctaagatcttgccactgcactctagcctgggcagcagagtgagactccatctcaaaaaaaaaaaatgatgctatcatcatcatcattttcatttttaaatatttccccaaacataaaatatcctgttttaactacttttaatatatcttgtaacttttttaaacctagaaatttgaaactaatggtaagtcactctattatcaaagcagtaatctaaaattatccaggaaaataatcttttttctgagatctggcacataataatttgctgatctaccaaagacgtatggattttaccgaaataatagttttcatgaggttaggagttttattttgttatcctttttgcaaaatagtacctttctttttcacagagaatttcttctcccattaatatcacggtagataactcagttgatggtgactgtcataatgctctttaagttctaagggcactctaagcgtcatcttggctctgacactgccaagtatgacttggattttctttgcttggaaagttcttgcatggtgctctctcaccacatattcccatcccctgaaattgcatgttttcattttcttagcaactttttctttattggtactcatcttataggtcttcccatttgttgggtttgatgtttggctcaatattgtcactaaagcaacaccaccagcgattttccaggccaaagtattacattaaacaaatggttccatagaatacactctcatggtgctgtagttgctttcattgctaagtctggttcctggagcaccaggcattagaccttaaccatgccatctcaacacagatttggaccacacgcagctccgaagtgtacacacagacacagtgcttcttttatactaccattgactaacttaacacgagttcccagagataagcacatcatatacaagagataaatggagtttgtggataatcttttttagttcaccacagtgtatgaaacagatacattatacatctgcctgcagggagcatgtgctgatgtaggaagacacacactgaacaagtaactgcaagttattgagtgtatacaaggagaggttgcgtgaggatatgtgaattcaggaggaaggaacctcacctgttgatgaacttaacttttcttcagaggaagagatattttaaagagacatgagagaaattccagctaaccagataaaaggactagggattgagaggcagagacaatagtatgggtgagttcaaaaaaccagaatgtggtattctacacaagctggagattttaaattcacaatttttgcatgtattttgcatagtaacataagacttcttgttgtaagcatttctttggctttcacccctgggatactatttgtgcctaggatttttgagaaggtagcaaaacatttctataatgcctcaactctctatagtgagtacattacctaactggagtgagatagtccacagatgatgcaacctttgcaagctggaaagcactttcctcttattttatcatggaaattaggtatttcattgtgacagttacatgaggcattatgttgagctgtcgctaggagcagttagtattatctttttgggctttaaaagcacagaaaacagttgggggaaagtggagctattttggaatagcacaaacaatctgggttggtcattgattttcttatgaatctcatttgactgttccagataaatacaaaatatttggagaataaaagagtacagattcatacgtatcactgaaaactgttcatcttaaagttcgtgttctttgttgtcatcattttcttgtaatgctggcagaatccagatgctcaggtcaaataagaccataagtgagaaataaactgtggtgacatttgagttgacagacataattctgacacgtagaaattattgggaagaaaaacaaaaatcgaaactcacaaatgagagcttaaaatgaggttatgctgtctacttcagaattattttatcacacacccagtacttttatgccaaatatgcctgggtttatgcaatttaaggacacaagagagaaagataagttcttcgaggctttccaggagccaaagtctggcaattgtaggtgcatctctttcagactgaacacatattagagatcagttttaatgacactttttggaaggatttactcaaataagtgattctccctaaaatacgagactagcttttgatcgttgtttttttttttttttcatttaaatttttttttcatttttaatttttttttgtagggatgggggtctcgttatgttgcccggtctggtcttgaactcttggcctcacgtgatcctcccgcctgagcctcccaaagtgctggggttacaggcagaacaaactgtgccctgcttaggttttaattcttaatggtcatcaggattattcggatagagcttccgattccctcatactttcctataaatcaacaaggcagagaagccctaaaatttgccttgctgctctacattaaactggcttcagatattgccggtgttctcccagtctgcagggtccctagaaatccacattcaatggttttaaattttgcaaatgttgcctatgggagggtggctctgattcccactatcaccagtcccatttaaggatttttggttttataatttgcatcatttggatctgtttatgtttggcagaaataaaatgtatgactttgaacaaataaaagcttagccactagaatattaacttcaatatctacataaatatttttcttcaaagtagttactttggaaaatgacttttaatgtttctggaattctgccttttagaagtggtgccagagtcagctcacaagctgcacagtgaaaacactgtcactgctttatagtcgaaacttattttccctataaatccaaacagtgtgccattcaactggaacaccaaactattcagtacctatggcaccaaattatttttgtttctatatgtttcttcttaaaatcgatcattctgaagtatcaaaatgtctcatagcttaagtatttataaacaacagactttaagaacaatttcaaaaaagttccccaaattgttttaataacctcagattctttacttgcataaacatagctggcaaagtgactccttgaaaaagacaacactcatttaagtgttaagctatgttacttatgttaaacttattaatgaataaacctaaggtcacacaatcatatgtcttaaaggcaatggttgcaacttcttttctcacttaccttagtacgaaaatagcatacattttttaatgtctgccctgtatcatgcactttgctaaagattttacataaccatgtttatttgtctctaagtttttattggtagtcattttgctaaaaataatgtggctagtcttgaagagatgttgcatagaaagatcattgtacaaactcagcttaacttggcttcaaagcgtatttttccttctaatatttgatggtaatgctgagagattttactcctctctctttccttccttgcatccatcctatcctaacgacaatagtgacatctgaggatgggctatcagctttcagcatttgcaaaccatttcttctgaaactcttagtacccagtgttttcaaagcaccataatgttaactttctcttttagcttttgttttgctcttttgattgcattgactttaaaaatagttttattgttattaaagaaattattaagcatatttttagaatcctattcaactcagaaagtggaaggataaggctagggaggaaggaggcaaaggaaaattatactggtttcaattttgaagacttgccttcctgaaacagttactgttaaaatgttagtacttacttttaatatttgcctctctacgtctatgtgtatacacatacacacacacacacacacacacacacacacacacacacacatatatatatatatatatatatatatatatatattatttggagtcttgctttgtcatccgggctggagtgcagtggtgcgatctcagcacactgcaacctgcatctcccaggttcaagctattctcctgcctcagcttcctgagtagctgggactacaggcatatgccaccatgcctggctaatttttgtgtttttagtggagatgacgtttcaccctgttggccaggctggtctcaaactcctgacctcaagtgatcttcacacctcagcctcccaaagtgctagtattataggcatgagacactgttctcagcctctatattcttaaataatattcatgaataggcatatcttttagatgttatctattgatttctattatggaaggtgaatattttaagttttctaccctcgcacttttctttcttcatgtgacttttcattttcatttgaggcataattaatatacaataaaatgcacacatctcaagtgttgagttcactgaattttgacaattttatatacatctgtaaatatcatccaaaataagacatagggcatttttattcctctagaaagttctcccatggtcctatacataagtttattattcccctctccctcatatacacatacaccattgtctgatttctaacaccattgcatagttttatccgtatttagatttcatataaatgggaatgaacattatttcctctttttttctggcttttttctttacactaaaaggtttgaggttcatccatggttgtgtgtgtaccaatacttcattcttatttttttgctgagtagtattcaattacataggcaagtcctaatgtatttatctactatctactattttgttgattaatatatgaacgctttctaatttttgactattattaataaaagctgctatgaacattcacagacagatctttgttagcacttatgttttcatttcttttgggtaaaaatgtaggaatagaattgctaggccatataaaaaacagatgtataactttataaacatctaaaccctagagtagttctacaacataactaaaataaaataccattttacaattcttccagaaatggatgagaagcctattcatcttcatcaatatttagtgttggattttaaccactagtcttaaatttctttatgtgtttcttgtgttacctgtttccctaggttcctttttactttttgcttgtctatttttcttgtaggaagcgttcctcagattctagcaattgcagactacccattcatatttaaaagtgaagcactaaaaatataattgaaaattgtgttagtaggcaacattactaaatgaggtttcactttagaacaaccaggtgaccatctggcttttgaggatggtctcctaaagagcagctttttaaagtctttactctggggtggctcagatttcccagagaaaaaaacacatcctcttatctttcactttggatctataaatgtggttcccaggttatagagcccggtggataaagaggtataggatttctgttctgtatacagattttatttttctttttgtttgccgtctcaaaactctgtcttccttttctgtggatttgttgtctccaagtctagggattttaaggttaagttctccccatgtgatacctattctctcctgtccaggtagagaaaacccactaagttgacgtatgtggtggagatgggaatagagagagcagggtgtgcctaacacaaaattccgaacaattgtcttgttttcaacccctgacttactctggtcttctgtattatcaggctgtcctgggatctgtagggtgggtcctttgcttcccaaccatgtcttaccttagtgtccttaggtttgtgctttttcagctctgctgaaaaacattctctacctgtcttctcttcacattccataatccttgattatgtgtgttttctactttcctgaaatgtattgtttttttctcgatttctgtgttttgggggcttaatgtgtttccaagttttaattgtacacgggatgttcagattacactgtacttgaggcttgagggcgatcgaattagagaaaaactgtatttgctgatgaacagcaaatgtagtgtttctgaagagttaagcctaatggggccatttagttcattttcaagaatgcttaaaaggctgcgttagaaaataacacaaaggaacttcagaacctcagaatagggatggcacccagactctcttcatcatgagggttttgagggtaaaagttcaaacaaaagatacattcaccttttaaaatgtaaatgaactgcaatatcagcataattttcttgtactatctttgaaaaaaatacaagcacattcacagtttttctttattctctcaagaagggctttgaaaacccataattatagaatttattaaggaaaaataactaataaatacttctggagaagaatattcaaaagcctaaggattgctagacaaaatatctcatttttagatcaaatcttggaaagatgcaaaagttgttaccgacaaagataagttataaattaagcatattggaaacaagaggaaggataaaacctgacaaattattgatgttgcaggaggtaaccaaggaaggctgtgctcaaatggcactttgatgacctggctttgtgtgtgatggttgatgtgcgggatcacaggaaaaatttcccgcatatatcagtaaacatatataatcaagaacctatgacatgcccatcactgtgtaggctataaagaaatatgagcacactcatgatttcaaacaaggttactttggtagaaaagacagtcaaataaagagatgacataagggaatagattctgagtgccaaccaagtgatacagacagtaagtgtcaccttaactcagaagagacagagaaaatcataggtaggtagagaattgagtcagcacagcaaaggccgaatttgtcttggtcttaaaaataaatcggtgcaaatcaaaatggatgatttaaattttacagcctataatggcacttggcaaacatggtatcattgtctctaagtgatttttttttttttttttttttttttttttttagctatattaccctttggctaaggctaagacagattcttgcagttcattattgtttagcagatagcaagctttttagacacttttatagtgaaagtgtgtcttctcgctttatttatatacttatagaatcatctttgaaggcataatcaccaactgccaaatttgaggaccttggcagatggagacagatttcccagggaaaatttgaaatggcggggagtctaaccagtgatgtgctgataagaaaaacatccctgatttggagaatttgccagtttctgtgatacaaatagtctcacccttgccaatttcaagctactaacttggggttattgaatcctgacttggaaagagttgagcatgatgagtcgacctgagctgctgtaggcttgctccagcacactgcggaagctatcagacattcacatttcatctagaaagacatggggagggatgctgatccacgcttaagtccttcccctttccattctgatcctcacttggtcttccaaccattgttctttttcagatatatggctcttgtgacaagattataaaggtcaaagatgctttatcccaatatgtatcttattcatttaggctgtcaaatataatttagtttgttatccatagcagcagtgcctcattgcttgagcaggcatgcggcagtgatgtgaagagcaggagagagtggtgtcaggacctgaaagggtgtgcacctgtggagtagctgtttattaggacttgttcctgatgcaagcatgtcaggccagggttcatcttccaaaaataggggtagcaattccagagtcctccactgatttatggagaaggacccatcattctgtaactctgaaagctatgccaagaacaggttattcatgtgagacttcatttcctttaatggatctgggacaaaacttgtagtcatgtttacaagccatgagtgcctgcaccactgtggtggcatcccaatactaggatatttacctagagctatatgaagcagaatcatcaaaccataagtaagaatcttgttagagtttgtttagccacaggcctactattagggaagtactaactcccttcatctaaatttctacatactctaatagtcttcttagttatcacatggcattgaccattttcttgttgtctgtattagctcctgctgcaacggcagttatgaaatctgactgagtttgtgccaaggcacagctgttctcactggtcttgcagatgcccagcaagttgctgggaatacccagatgaagcctaaagctgctccagatataaaactgtccacactagtacaacttaaatgtagtacaaatgctgtaagtttgcaatatccctcagagattttaatggaaaatccaagtactgttttagtttttttccttttcttttgctgataaccccttttacaagatttaaagatgagtccacagggttggactgagttcagtggtaacacattctctacccctttgccctgagatactttcctagaatcacacatgtgtgttttattcctttcttgggagtattctggttttgatcccttaacctattcaccaagggagctctaaataatatcatccaccactttcatgggccactcacatttcataaagattgcaaaagagataaaacagaaaactattagtggtacattagctacaactcctttctcttccttttcactgaacacagtgaacagaaagactcattggcttgagagccactgtgctgaaaggcttgtttatgagttcccaacatcttcaaataggaaaccactcaagagaagtccagataaaagtcaagggttagttaaagccaggagatacaacaataatgccagctatgaaaagctgagccaggtcatacaaagaagaataaaattcagagtttagatgttggaattaagaatgcatgtcagttaggctggaaaaatagttgagaggagagaccatgaattttattggagagcaagagactatttttatggagtaccagctaggttaatggagtcagatggggtgggatatgtgaactgtctagaattatttactttcagccagtcatactcatgactgcaaaaaggacaagttgaggctgtgcctctctttagaatgtctgcattttaaatatctatttacagcaaatgatatgttgctgtactgcaggtttattagaacactagcatatgtgttgacaaggcaaaggtatgttaaatatctttctggagagtcaatcctgataaagcaggacatgcacttaattatagtcatttaacagtggcttttctactttaattatagttttatataatctatgcatgacaagtctgaataataataaaggaggaattataagctgaatatggagaaggttttggaccctgcctgcttctgaactacactctcaatctggattatatataagcatatataaataacatacactcctctcaagaatgctgcattactagagccttacactgttcttaaatatgaaggagatttgttttcaggttattggagatacagagattcacagaactgccttgagggacacattttttatgtacaaatatagcttttacctagccagttggtaggtcaaaacccaatggcccagggaaatggtttatctcttagctcagaatttgactctgtggtgggtagactatagttaaaagaaatgatttttttgacattggtcagaaagttatttccttatagtgacttattttgtccattcacttgtacctagaggttttaaaagacagacacattaaacctgtggctagaggtggggcttacagaagcaagagtgacagtcttcaccatcaaatgcagttgacgtttgcaaatgacaggagacaaactggaaattgtattccctcaattcctagcagctgattccgactcattcataccaatattgtaactgttgtcactcttcagagtccctctgggacattagtactaggttgtcagttgtcctgtagttaggcatctatgacgtgaacaccaataggaacctataattgctagaaactcttattcatttgttttagtgtgttgaaatccattatatttgtaatggattttccaagtctcactatttgccagacaccctctctgcacccttgcttctcagcttattggaacagactgacgggaaaactatgccgctctcttggtttctagggtggaatttcaggggagaatgatgggagaggccaggtaataaaaaagcctccttccagagatgatataacttggcagccttaagctcaagagatggaggtgggatcaggatgaaataagagcatgggaaatcaggattcatcacacaaataaattttccattaatgtttgtggattaaggataataagggaaagaatgccagcaaaaaacatgtatattttatgcaggaaaggcaataaaatttgatattttgatttttacactccttatcccacatctgaatataattgtctaggattgcaggaattattttctgcaagtgttgctggtaattcttcatccagtcttcttccagtgtgggtacagttacgaatattgccacctagggctgacagctgctttcaactggacaaggttttatggtttctttgtctttcccccaacccacaaatgttctcaaacctcttgcatttatttatgttattttactttgcatgaatgggggaagaaacagtgttcagcaattcaatgatggctgaatggaataacagaatttcatttcctaagggaacatttgagagtgattgaatcaccctcaatctacaagccacatttttgcactatttttctacttgactaattgattatgacaggtgtcacccaagctttgcagcttaggctgtccccatgctaagacagagccatagcaagcaacttctattgatgaaatagaaaagctatgcatggttatttttccttattgattttctagtatatgatgtcagttaattactgagagccattcactgcatacatgtaagtagtcattataaccatattttcaattgattttttccctacaaacataatcagttatttgtttgagctgaacagaaatgtaaatatctgcagttgtaaaaaaaaaattggatgtgtgtgtgtatgtgtgtatgtattatatgggtatattctttatgggcatgtgattttatctatctatctatctatatatatatacacacacacacacatacatgcatatatacacacacatacatacacactagatataatcaatattatatgcccatcgggaatatactccctgtaacatatttacaggtgtgtttgtgtgttgtgaacagagaaagaacagcacatgtcatggccatgctaacaattttggttactataccaaaagggagatttctaaagtattgagctttaagtatattgcatttttagtttcgcaagacaatgaaaaaattagcctatctaccttatgtggagggaaagaagccagatacaccaaaaatttatttgtataagtctacttatataaaattctaggagatgacaactgaatatatagtaacagaaagaagatcacaggttgctaggaactggaggtggcaggagggatggaccacaaagggttatgaggaaactttagggttgataaggtatcttgtgtctcttgcttgtggtggtgattttttggttgatgtacctgtcaggattcatcaaattgtgtatgggcacagtttgttgaacagaaatcatgtcccaataaagttgttttaaaaatgaggaaatgtatgtctcagcatttgaacactatttggagaattaccacaaattttccatgtttctaataatattaaatcatttctacatatggcaggaacttcatatttctcagaatatactcttggaatggaagtgattatatccatgatatatattgaatgtccaggccctaaagggccattcggaagacatttgagtttttttctagttgacttgataatttctacttacctaggaagaggagagcaataactaacctttgaaaatttctcatattgacctacatgatagactgatatattcattttcaattagtgtataacaaattactacaaacttagcaacttaacataacacacatttattatttcaaaatttccatgtgtcaggagtccaagcacagctttgctgaatttgaggtctccccaggctccaatccaggtattggccaaggttgaggtctcatcagaggcttgactggggaatgatccacttccaatctctcagattattggcagaattcttctgcatgtggccataggtctgagttccccatgtccttgctgactgatacctgatgactatcctcagaactttgaggccactcagcgttcctggccatgtagcctctccataggaagctcacaacatgaaagctcacttctttgggatcagcagaagctcttctttcagtctgctatgacatagctttgtaaaatgttacttaactatgaaggtaaccacctttgccatgtaatgtaatctaaccaagagagtaactgttttataaattttgctatattgtattgactagaaatccaactgtacccagtggaagtacagtcatcttagatggcttgggccactttagtgcatatctacctcagttgttttatagaggacccttgaaataagtaactttctaataatatatttaataaagaaatatttgaataaatttatatacatatacttaataattttagcagaatgtcattcaattttaaataagcaagaataatattactatttttttttcaagacaaggtctcactctgtcacctaggatggagtgcagtggcatgatcatggctcactgcagttgctgcctcctgggctcaagcagtcttcccacctcagcttccccagtagctgggactactggtgcatgccaccatgccctgctaactgttttttttttaaatttttgttttgtagagacaggatgttgcaatgttacccagggtggtcttaaactcctgggctcaagtgatcagtccacctcagcctcccaaagtgctgagattacaagcatgagccattgtgcccagggagtagtacttttaaaatctggtctaatttatactggtttaatttttataaaaactctcaggaccctacctattgtgtcgtcagggatgtctctacatggtgcaccaggccatgaaggagttaatgtgcctctctaatgctgtcaatttccatcttcctcgtcagtaaaataagacctataatttgcaaaatgaatccacattcttgaacagtgactgcattaaaaaacctgagtattttaataattagctattcaaattatcttatggttgcctactattcataaagtcaaaaacataatataaaataacatagatcataatattagttacagatgtcagcttacttctatttttctgaagaaaaggtgttaatgaatttctctagaatgatttctgacataattgccaggattgtacaatatatcattctacatttatgccagcaaattagcatctgtgattcatacagtggtagctttcttaattttatcatgtacaaaatacatgttgttttgatttttcaaaataactcatggctctctgccttgtagactgaagagaatttacaattttgtcgttgaattggtgaatatttcaaacaatatgacagacactaacaatatacccttgggtttacagcagaataaagctgctactctgataagctaccaaatactgtaaatgcatcaataatttcagcctgaaaaatattacttttttaattgatgcatttttctcatgacaattatacaatacttagcacgcaatattcactttctaataccagaaaggcagctacagatggtgtcaatataaattgtttgtaatattctctgtgtttgtacgtactatatacactatgattacatccaagagctcaggtttgcagaccttttctgcccttgtatttgtgaccttgggtgtacttctgcactatccaatgtctctcataatgcaaaattacagtaatatccacttaatgttcataggctgctttgtacaattacagttacacagcgatcactcaaaacacagtgataatacaattcctcatcaaaataaaccattactggccaatgtttgtgactttttccggactaagccactctcctggggctggcaatttatggtgcaaaaagcagcagaatgtgctatttataattatgcagctttcttctgggatcagaaaatcactggacctcattcctaccttactgaaagaggaaatggtaatttatgttgtgttatttgtctttaaaatgaggaaatagggtcaaaggaaggataaagtgtccaatgtcatgcactggtaaaactggaattagtagttaccatctcatgatctgatttctagttgtttgtttggttggatttttttctttgttgttgttgtttgttttatcttgaataccttttttgtttaacaaaaacttattgtgcacctgctatgagtcaggcattctgtatgtgttttataaattttaactcagttgactttcaagcttaggagttagctgctgctattgtcacccacattttataggtgaggaaaccgagacactgagaggtgaggcagtttgtatgaggacacataactggtatgtggcagaggcagtttggctctggaatctacacttaaccactgttctttgccacctctccttctcctgtgtgacttgtctttatcctccaggtcagaaacgcatcacataaggcctatttcctcccaccatgatcactagtgcttatactctgtttaccatattgagtcagtcaccaaggaggatacaaataaagaatgtgagctccaaaaaggcagacggtatttatcttgcttactgaatccccattacctggaacagtgcctgatacatgaaaaatattcaacaaaaatattttgcatgaataaatgatcagatgaatagatagataaatggacagatgtatgagatagatatgtaccttgttttaagggagcttttagtttaagaagacaaaccataattcagctgaataaaacattttatgattttttattcttttcatatccttcaaagagtgtttctataaataaaactatttcagtcttggtgaaacagatttgctcagttttaaaatatatattagaaaaacatatgttaaaacccaaattaaacaagcttttatctgcatggctcagtgtcaactcagattaatttggtagaggtgaaaatgaattctttcgcagaaattatcttgccatattttaggatgatgtttccgtatgggtggcatttttatgagaggaaattgagagcagaataacgaatggagttgggagaatattgcaggtgtcttcatcttaaatatgcccccaaatataatagagtctgcacagagattacatgctggagttagtagaaaggattcggtagtttgttttcatatccttatcatttaaataaaacattgtcatgtttatattttttcactgtaggtcattcaatttctctcacacagagaaatatgccgaagtagggacacattcaggaagggaaactagtaatcaagagacaaaaaattgatttttgtataaagactaatatatgctgagggaaaaagagaaggaaaatgtcagtgtgtggtaatataggaggtttgagtgattgattaaagattggaaagggaagcccgacaaagggaatttcatcaaaatatataaaaccaaaaaagacatgataggtggctattgatttattcaataaattgtagtatccttcaccccaagaatctactcaaactttagaagagtttgttttaggatgagttataaataaattcagataataaactcagcgagaaatttaatggcacaagaagttcctcaataagtcattaagataagtgatgagaatttcagtacacatccctaaattttgcagttggtgtcagagtcagtcaaatgtttataaagcatgaatcctggttaaaaaaaattatgtcagagaaaaatctaccatactcattgattattgagtttataactagagctttcttcatgattattattgagacaaatgatgatgaaagtccctagcgacctctgtttcctgtttgttaaagggctaaaaaatagtgaaatgatttgaatatagggaatgggaaagtaagagaaccactgtgtatgagtgggtatcctccaaaataaattgggctatgtttctgagccaatacgtatgaaacaaagggtggaccagaatatatgtaaagtgaaatttaaaattatttatcataatcgttaatagtcaaagatggggaaaatccaggaaggcaaaaaagttgaaactgctagcgaaatgggtttcccagattagccagaatcctaaattgccgtaaaggacacactaaattgtctggaagttcatcctaggttttagtgatctgtgatcattttaccctggactagcatgaggagcgaactatgatgtgtaagattttggaaacactatttcagctgactggattttgtggattctttcaatgacacattcctttcatcagagtcattggtatatactcttcagtaatttttatgttttgttttgtagctttcttgtggtacattgttctactgctcacttcttgcctctctcctctccatggttgtgtgtttacaaaaaaatgaaacttcccacccgcaattttgaattgtattgtcctggttatgattacttttcattttcttgtcatccttgatactgtgaccagtctttctcagggaagtacattgaacaccaagctacctgtggtatgtccatatgctcatatgctctgaaacaaaccctgtccaacatgttgaattcctttccctaggctctgcctaagtgcaagccttgtgattcgcttagtccatgccctctgggaatttgctatgcccactggagcacaactgtcttcccaccctgccacctttaattttattagctattagctgttacctaagttgaaaaatggaatgacacaggaatgtagttgaaatccagtgcattactccctaggatgaaaaacaaagtagacacacaggctgactggtgccaggtgatacaaaagcgtcagcatgaatcataaatgctctggtggatgacacttctcagattgatggctgcagtctgaacgctttgtgtcttgggcctgtgtttggaagtcgggtggtgcacattcttttccaccctttagaattaatcttttcacactggctgatagatgttagctacaaacacagtaagaatcctaaaacttaacactgtcgttgttcctttttttaaataagttctttactcagaaacaaatgatgcactcctaatagataaacatccttttattatatgtcttcatggagtctactcttttttagacaaacactagtgctaaccacattagcgctgatctttaactataatttaagcaacagtccctacccctctttaaaataaacatttttatatattgtagaataattttacatttacatgaaaattgtaaaaatatagcagagctcctatataccctttacccagttttccactgctaacgtctcacatgactgtgtatttcaaaactaagaaatcgacgttgctatattactgtgaactacagtccagtctttatttggatttcattaggttttccattaatatcatttttctgtctcagaatccaatcaagggaacctccttgcatttatttgtgatgtcttcccagactcctttttctgtaacagcttctatctttcccttttttcttgaccttgactgtcttgaagaggattggtcaggtatctcaatctgggtatatccaaagtttttttcatcctttagactggtattctttttggaaagaataccacagaggggaagtgtacttcttgccacataatatcaaggatacgtgacagccacatgacatcactgaggataataacttttaccactcactaagtggtggctgagttggccagggttttactctgaaattaatattttttcatctccatactcttttctttggaagcaagcatatcaatctagcccactccccagcctcctcacctctttttttaatggctgcaatcaactctatgactaagatctaacatgattgtaccacattctgtgttaattatctaatacaactctagatagttaagaaggcagtatagccagtgtgctgacagctgtatagcagtgattcctccttttgagaatacaggttggttgcccagaaagagtttaagaataaaactcttacaatctccagatttcctatcccttacctctacccaaaagaattagacaccagaacagatagtttacgtgtttggctcatgacatagctggatggcagagaggggtgaagtcacctctggttcatcttgaggatttttgtcttattttctagtcatcccttagtgaatttctttaaatatcatgttatggtttgtgttcagaccctagagcagcaggaaaccagagacaagagtgagttaggttttgtaactctatcttcatgcttattgcagagtagctgcagaatcgcaaactacatgttatagtcagtaattttaaaatgtttcaggaagcgtggcatcaagttgtgaactttacacaggtaattttttccttctgtcaaaatatttacttatgaatgtgttatataatttactttttgctttaagtagccacaggtgcgagaatgattgtttccatcccatttgaagcttaacaaattttcacactttgaaggtgaaggccacagtgttttgtattcttatgttgacatttattatactgaaataattctctttggtggaattaataattacttggaggatgaagttacaatagaatattcaaagatattgaaatgaaaggtacatatgctgaccctttctattatcatcttttctaactgtagcttacttaccaccttcttctctttgaataggttgatatgtaacagctctgcatattagggatgttaatgcttttaataatatggaaaatgtctcagattgtcattcatatttccatctccctattatgtttcctcatgtagaagtttttgtttcaatacagtcatatttatcaatatttcttttcatgggttctggtttttacattttcttagaactcccttcccatttcaatggtgtattagtctgttctcatgctgcaaataaagacatacttgagactgggtaatttataaaggaaagaggtttaattgactcacagttccacctggttggggaggcctggcaatcatgatggaagagcacgggacatcttacatggcggcaggcaagagagagcttgtgcaaaggaactcccccttataaaaccatcagatgtcatgagacttactcagtgtcatgaaaacagcatgggaaagacccgcccccatgattcaattacctcccaccaggtccctcccacgacacatgggaattgtgggagctacaattcaagatgaggtttgggtggggacacagccaaaccatgtcaaatagccaatatctattcacttctgaatttccaatatatagtaaggtggtgaaatagtcaagtcaggggctggtgccatttgttttcctttatattttgagactgtacgtaactgaactcaaggtactttatgggcattatccactgtatttgtgtcttgatggtcatgtgggagaagagggaagtttttacaatgttttcagtttggaagaaattcaggaacaggagataatataataaggtcatatcatcaaattttattgcttttatcccctaattctcatctttttctgtattatgctatctttagaaccagtgtgctatatggtctgagtgtttgcgtccctctaaaattcatgttgaaacttaatccccattgtggtggtattaagtggtggggccttttgggaggtgattaagctgtgagggctctgctttttttttttttttttttttttttttgagaccgactcttgctctgttgcccaggctggagtgcagtggcgcgatctcggctcactgcaagctccgcctcccggttctcgccattctcctgcctcagcctccctagtagctgggactacagtcgcccgccaccacgccccgctaattgtttgtatttttggaagagacggggtttcacagtgttagctaggatggtctagatctcctggcctcgtgatccgcccgcctcggcctcccgaagtgctgggattacaggcatgagccaccgcacccagcccagggctctgcttttatgagtgcgattcatgccctaaaatgggctgaagggagctgtcttgccctttctaccttgtgaggacgcagcaacgggtgtcatctatgaagcccttaccagacatcgactctgatggttggtgccttaatcttgggcttcctagcctccagaattgtgagaaatatatttctgctgttgatagattacccagtcaaggatattattatagcagcccaggtggattaagatgcagctattacttttagaactggatagtgaatctgtcattgagttccaaattctgtcccaaatttggatgaattgttttcaactagaaaacaagggggaagaagagagaaagaaataaatagaaaaagaagaagtaaaatagagagatggaagctactgttgcttcatagcttgatagagccttagtagtgattttagggactgatgtacctgcacctggaaggtatttaaccagctgataactggaagagaatatagtcctttgtacttttataacaaaataccacagactgggccaggcacagtggctcacagctgtaatcctggcactttgggaggctgagatgggtgggtcacttgagaccaggagtttgaccagcctggccaacatgatgaaaccttatctctactaaaaatgcaaaaattagctgggcatggtggcacacacctgtaatcccagctccttgggaggctgagtcttgaacctgggaggcagaggttgcagtgagccaagatcatgccactgtactctagcctgggtgacagaacaagactctgtctccaaaaaataaaaataaaataaaacaccacagactgggtgatttatgaaaaaaaagaaatttatttcttacagttctggaggctgggagcacaaggtgaaagcatcagcagatgtggttgtctggtgagggctgctgtctgcttctgggatggcaccttgtggctgcatcctctatggagcaggaagttggtgtcctcacatggtagaaggaatggaaggggcaaaaactggggcaaactctttgccaagtccttttataagagcaatgattcctatttacgagggcagagccctgatgactcaatcacctttgaaaggccatacatcccaatactgttgcattggagattaaatttcaacctgaagggtagagggacaaaaacactcaattcatagaaagccttgtctacaaagccaattctataattctttttactttattcaagaaaaaaaaggtcactgattatacataccacttacatcttgatgagaattagtgaacataggaatacctgccaagcgtatgctttgcctcagctacaatagcaacaaggaattaaacttaaaatagatacatttgttatggtggatgaacatctgtatcctatgttttagtattccacatgtgctgtgttatagtttgaattaatagatgtattgatcaaccataattcaaatcaatatggatctttaggtaaataatacatttaatgatttttttaaattaaaaaagacttttaaaaagacccatcttttctagaggaattaatattgttctatttagagtgaccagggggaatactgactttgatgcacagccacaatttatgatcatataatgtgttttattaatcatctctggtgattattgtttttattgtcctactttatagatttaaggtgtaagtactaggttcaggtcaatatgcctcttctatggttgatagcttagatatcattttcttcactgcagtacattaagaaagaaaaagaatgagctacatgagtgatgactcagctgtggttgcaagtacatgctcaccgtcctccttctcagaaagaggactagaagtagtcggggcctttttctttctctctctctcagaaatatagaggcctggatggtcatacctaaaaacaaaaaggaatctaaggaaacatgcttcgtatacatattatgcccccttttgttttgcagtgacttcataacagtggcataatactctacgtctatgaacttaattggaataactaataatttatcttagttttataccctcttttatttgcttcatttttatttccctttaatttgttttggtggctataaaatttagggatgggtagcaaggggtaagagccaagtgcactgcacacaaatgcttaataaacctcactgccatacacagccagtacattcttggcctgtggtgccacctcacacacctgttattatcctgtctatctgaaacacagtgtttagtgaacctgtcattctgcaactctgattctcagataattttttttagattgaaatgaacatatcctagaaatgagcatttccacagctatcctgacaccatatccttgagtaaattattttaaaatttattgtaagtcctatagggagagttggaagttagccatcaagtatgattggagccattttaatgagttgcctagtatcctacaatggtaaaaagagctcttaaaatgacctacattactaaagagagtagcttaaacctttagttcttcttacttaagttgtattatcttccatgtatctttacttgagtttctcactggaaacatttagttgtttaacacacacatacaaaattaaactccctagcattgataaaattatttttttccttaacaacacaacttgtcagctattttactttagtagtgtctcataaccaaaggaaattgcagggagaaagcactgattcttaaagcctgacatactgatctatatcagcaacgcatgtgttctttagacgttcttcaccggcagaggacaggattgcctgccagcctgggacaaagcaccatatggctgggatgaggggaaggatggtgatgcacatgaagggtgggaggggagctgtcacagcctgtcagtctttattcccagaggaaactctggtgacaagggagtgattgaaatggcacgtttggggtctctgggcatggagaatggataaacaatgactgggaattcaatgacataaactcaagggaaagggtggaaacaaagcgagctgcaattgggtagaagcataactctcctgtagttggggaaagatgccaggaagagacattgatgagaaagatgattaaaggtggcctcacaaagccttggaatagtgacagatggaaagggtgcaatgattagtaagaaaatacaaagagaaaaaagagacctgaaatgaaataaagtcttataggagcagaaatatggaacaatacaattttttaaaaagaaaatgaatgatagatttttctctgcaacctgaaaagttaagtagagaaggatgtacaagtgacgacgtactttccttccacagacgaagcatgcttgtcctcaacttacttgatctaccagactcaaaactagctcagaacttcccaatgcctttttttttttttttttggacaaagtctcgctctgttgcccaggctggagtgcagtggcatgatctcggctcactgcaacctccacctcctgggttcaagcaattctctgcctcagcttcttgaatagctgggattacaggcaccccccaccacacccggctagtttttgtatttttagtagagatggggtttcaccatcttggccaggctagtcttgaactcctgacctcgtgatccacccgcctcggcctcccaaactgctgggattacaggcatgagccaccacgccccgcctcccaaagcctttctatgagagttcctacatctccagacagccattaagaaactggacgagcagaaataggctttctgctctcaagatctaaagatagacaaataacaataataacagccgtttattgaatgcaaatcatatgctaggtatggtgagcagcccttagactccacttctcattatcacttaacaactctgtacactaaatattttgtatccacttttaatgtggaaattaaggcccagagaggctaaatacctttccaaataacacagtcacagagtttggagtagggagcaaggttcataccatttaattgcagttcgctagtcaaatctatttatttacatacatgatgccctagccacctcgccaagctgcctgtggtacttgctgtatcttcataaactctttaaaaggcactttcctaaataagcaacttggaaataaagaaattattaaaagcatatgatatatgtttttacatacctacaatgtgcagatttgagcataaaacctttagttgctcacatattggttggccagtttatcagataatatttttctcctccttttttctgaaaagagctcaaactctgagagctatagttatcgttgctgagatgaaaatacttcccgaaattagtttctcagtttatctctttgtgtggccataggaaatcctttttagcatacaacttttatttggccatactctttgctgtatgattctgggataagaatcacactttctataacagacccgtaggtccccttctggatacaaggtcagcccaaaccaaattttcgagcttcctttttgcttcttaatgaaagcattatttcccttaggaagcatcgttatgtgaacacacctactttgtttggcacaatgtagaaagcttgccaccagggcttcctctagggatcaaggctgacaaactgtgacagagcaggctgtgatatatttccccttctccatttggttcaaaataaaatgttctcaccccaaacctgcatttccttagaaccttcctctgagcttggtttttcattctactttgtaatttatctgcaaattaataataatgaacataactagttggcagtaatgctcagtcttctcccagtgcatattctcaagcaaccactgtacagagttctgaaaaggagtgttccagccaaagtcttaacataatctcacaaatttgcaaagccttccgtttagctggaccctgcaataatttaatgtatacctgtgatatggctaacatacactgtgataatgatggaggattaaagtgataaacagtttagacttggttccttctttcacagagcatacaatttgtaataggatcacaacaacaataacaaaaatgaccggattgttggagtccagggaagtgccctgacaggagagtttgtcttgtccagatcctgtgaacacccaggtagaggggcctaagccaggctggagatcagtgaggtgacactctaactgaaacctgaaggaggcccccacgtcagggcagcaaagcaattggaggaaggtattccagctgagtttgcagcacacaaaagtagcagaggtgaaagcatgaggtcttcctggaattgagcaagttcagcatggagaactgagaggtagcaaggaggctgttctgaaagtaaagtctctgcacactcctgaaacctagctccgcactctcagagaccctcaactgtatctttcaggcttagatccttcaggccctgtcatgctgaagacaactgagaaagtatagctgatatggaaggagtaatgttggaggtggcagcaaatgcatcctggagggtcaagccaagctgagtagggggtatgaccaagctggttttccctctgggatttgaaaatggattgaacagcttctcacccagtgccttgcacaaagtatgtcttcaattaacattgaatggattaataattggatgcataaattcattttatcaaagagtacatacaaggtatgattcaattccatagcactattattatgatagttaatgtacaaattaaataggtatctggaaacagaatagaaatcatttagtgaggtggtgtgttctaatgtctaaataacttttctacccaaactctagaatggaactcatttgtaagcaagtgactgtctctaacttttccatagtcttacacaggtacatcttgagtcctcaaattaattgcctgttctctaaggtcaaaactcagggcttaaaaataaattattattagcttcatgcgtaacagtaggaacatgatagatattccatcaatattcattattcatttttatctaaaatgtacctatccaatacattattttatgtgtgtgagataatgcattgtcaattagattttaccatttcacaatgtatatatgcctcaaggtatcatgttatacaggataaaagcatacaatgttatctggcaattaaaaacaaataaataaatgattatttaatgagattttatggagtacattaagtttcatctcattaagattaaaaatggtttcaaataactattttataaaatctacatttcttactttttctaaagttcttaatctactaccacaaaagtcatgattctttccattttgaaaataatgtaacattttagaaaaaatattatttcattttaagttttaattatacacaaccatgcttctttttttgataattttatgaaataactttatgaactgtaaaaacttaactatcatttaggtttatccacttcttcatttagacaataaaaagctagagtttagtgtcaagggaacaacaagaaaaaaaaatcaaaaggagaaatgatagttgtttgctcttaggaaaattaagtgtttctgttatttcactgacaatatctagttacatattatttttattaaatggtgaagatgcagactaataaagcagatgcagctaataaagcagctagttgatttggtggctacatttgtaatattttagtgagcaacatggggaatgaaacaaggaaataggtctattggcttgtttgaggtttaatgtaaattaaacatttttgttgttatgagtaccccttatctttcatatacatcatagggaatgaaggtagtggactatcaataagcttagaaaaaaattcatgttcataaacactgtataataacgtgtgacagaaaaagtccttggtatctagaaaaattgaagctttatttaaaaaattaatccaatagcatcattgttaccaaggctattgcaggggacctaaacaaaatattattttttggcttcaaaactatgaatatttggcttttcgttatctataaaaattatcaccctttcctggatttggctattattaaaaaatttttaaagatgttcttaaaagaaaaaaaaagactgtcattatagtgtggcaaattcacctcctcttctccatgacaacagataaagaagctgtagctatagcaacagtaatgggccagagagattagggccagactggagattaggcctccaagagcaaagaaaagaagtcctgattggttctttattgagaccttatttgaaggcaagttactgttgagagaaagcatggaggattagtaagaacaaaattaattcccctgtataagataagaagccattcctttgttaaaactgtgttcctccgttttaatataacgcctgtttaaactgaggtaaagagtccgtgattaattctatgctgagctttgtgccatctgagtctagaccagctctgtgagaagacactccctgaagcctaaggagaaaagagggaggagcatctgcctgcttgccattgccccttgccctcctctctggcactccctgggtgggttggagatgccaattggtttgtgatgttgacatcatgtaggagtgagatgctcttggaggaaaaagattggaaaacttccctcttgttcgtataaaacttatttgtctaacttcttgaaaatttcaaaaagctttcaccaagttataattaattatatgtttaaaaatacgtttctcaaaaatctagtaatgttcccattttttaataactggtaagttatagaggtattacattttgagtaaatgtgctatctataatttcagattgatatactgatgaaggagggatttgttattttttaaataataaatttataggaatgagaatatctggcctgatgctatgaatttttttaaaaggattttgccacatttacttctgaacatgtagtgctcacacacacttcaactgagagcctgtgagagcgccacaccctggccgacatgagatattcaccttctttaaagtggtctccgatagaattttttcagactctgttttaatgtgtatttcttgcattatttgtcaagttgaaccccacttttcaataagacgatttattattttaaagatttaaaaacatgctttttaatattatgttacttggtttttatatattttctaaatactttcagtcagtctttccacgggaaacaacacctcaactaaaccaagagggaaagtaggagttatacagatgagtgagaggggcttgttaaggtttgggatctgcttctgtgaaggcctaggcaattgcagggggctcagcatgaggagaacatacttaatatagaagcatcaagaagccaaggagcttccacataagcaccatgagaacattggcttcgtctgttgttccccactctctcttctgtgcttagacaaggaggacaggcgatctgagctgttcgaatatttgctgagtgagcagagctactgaacgttgctaactgtgcacctctgcaagcctctgcccgaaggtattttctgtcttgctgtaggaacacactaggccattgtttaggaaaggcaaatcccctggaatcaccctcaacaaatgatggagaaggagtaggtagataaatacccctatccactactctgagggatgaataactctgaggcatgtcctgtactgactcccagagtccccgatgggatttgcccttccgtttcccacaggtatagccatatagataatgcactcttcagataggtccctccctgccctgtctcacttcctgattctctgcagtatttctgggatcatctcccaaatgtagtacttgaacaaaagtcctcttctgaagccttgtttacggagaaagccacccaagacccatggtcagcaggagtcaggccagcaagctaattaagaagtttgaagcttgccctgaagacgatttgtggaggaaaaataagtagtagagtgacacgaccagatttatatttttataagctcattctggatgctgcacagagaatatatttgaggaaggtgagtttaaggaaggcagaggagctgggggacacttgtggtaattccagttagagagtgcaatggtgtcaatggaagcatggcagtggagacgcaatagtgtgggtagattaatgagatgttcaggagcggggaaccctagcatgcggtgagtgaaggagagtcaggaatcaaggatgggcttcgggtttccaggctgcacagctgagaggacaacttgaatatcacccaggaggagaagcaggctgagggggagggagagaataaattcactccagtgtgttagtcttagctgcctgtgatgtgtggaagtaaaagtttttgtcaagaagcttaatatcactcatatttttgagagagatacgccatccccaggcatcaatcttttcctctccctcaccactctgctataaaagattgactaactcactgccactcttccatttatttaaaatactgtactgatccagagagcaaggcgaaattttatctacaaagaaatagtcaaagaatctatggagtcagaaataactttgaatactttttttttttttgccattctttaaaacctctatttctctgtatagctagtaagaattgtatatcgataatgtttctggaaccattagaaaatggggtatttccactacccagatgaatttttctagctagcagaagtttaactcatggcagtgataccactcagccagtcgctatacaaagtgaatgcaagaatgaagactgactttgataaagactagggaaaatggaccacaaaagccggtttgaagattttatatccgcaaatgggtacctgtgatttgtggctagagatcacctgtcgagatgaaacacgtattccctagacttgagaactttaacaaacataaagaaaacagagttatcacagcaaagctgaattatgaattcacacacacccaagcagacacacactacaaaatatacatgcacatatgtaatagaaaaccctgtcttacatattattaattcccccaatttgtgaaaagacagttttttaattgtgaataattcagagttgttcttatgaacaagtccatgaaaattgcttctactttttgttaactttcatcagcttttcatttctgctcttaattttctatggtcttaaaaaatacataaataaaccacttcaaattgtttccaaacaggctgggagaggtggctcacgccagtaatcccagtactttggaaggccaagacaggtggatcatctgaggtcaggagatcaagaccagcctggccaacatagtgaaaccctgtctctaccaaaaatacacaaattagccgggtgtggtggtgtgtgcctgtaatcccagctactcaggaggctgaggcagaaataaattgtatcagaacagtgtaaacatgtagacagatactgacaggaataaggttttgtgataactttttggttacctgaagcatttatgaatacaggtaagtctgtggctatgttatagaatattgaggtctccattggtttgacttccaaattagcgctttattaaactcggtgtcagtgtttgtacacctacttgggctgtatcttttctactatgaaacatattttaactgtgaaatgaatattttaaagaatcaccttggggccaggcatggtggctcatgcctgtatctccaggactttgagaggccaaggtgggtggatcacttgaggtcaggagttcgacacagcctggccaacatggcaaaaccccatctttactaaatatacaaaaattagccaggcgtgggggcacatgcctgtaatcccagctactcgggagcctgaggcaggagaatcacttgaacctggaggctgaggtttcagtgagccaagatcgtgccagtgcactccagcttgggttgcagagcaagaccccatctcaaccaaaaaaaaaaaaaaaagaatcaacttcgttaccattttttaatacataagaagagttttatagtatgtgatttttctttgtcagaaatcatgtggtcttactgtatgttaaaactatatgattacatttttttctacagtaataactgcccccaaccttgtaaaatcctggagattatggccctcttagctcttcttagaactgttaaaaatgccaataggttatctttgacaaatagtcactgtaaatttagatttatatttagtatatcttgagtttatcttctgaattgtaataccgtcttttacttcgaatatagatacatgtgttcattcgtttattcatttatccatatttttacttattcaacctctgcttcattccagaaacaattcagggaaatattaattacttaaaatgatttgtcttttaccaaagacattttctatcatcagttaaagtcatgagaggtgtaatccttttacaatattgaatcatattatccacagttctaaggtctttctagaactcaagtgcttgttaaaaattcacattgccaaatttctctccccttttcttccctgagcagacatttttttcccttattgtcatagatcccatgggtaatagaaattggacatttaagcagtggaattgtatacatgtcattagccacactttaaaacccaagaaatacaaatataccttttattccatttactgtgtgcattcccttggttttcttccttgctttagaatcaaggtgactatgacatggagatgcttgctaataggttggctctgccttcctacccaattcttacctatggcagcgacacctctgatagcctcctcttctttctccttagctatcccaagctccagtgtcctcccttcggctcccagagatgtggtccctgtcttggtttccagccgatttgtccgtctcagctggcgcccacctgcagaagcgaaagggaacattcaaactttcacggtctttttctccagagaaggtgacaacaggtaggtgatgctaccaataaaattcagcttaatcggtcatctctttaagtcaatacggttgggtaatggcaggaggagatcttgggcaggaactttggagaggctgtgaaatctctactatgtccttcactcattccccagtggagatgtgcacttttaaaaagcagtgttgttgacacagtctaatgaaattatctgtataaaaaatccttgaaaaaggtaagaatatattatgtcaattttttatttctttggttttcagagtcataaacagagaacagaattaggctgtatattagtagaacagtgtataaaagcactactgtggctagcttgtaatcccatttctgtcattgacatcacatgagctccaaaaaaccacatgacttctctgagcctcattttcctctttaataaggagaaattaataatacctaccttaaaatatacaataaagtgtataattggattgtttgtaatgcaaaagacaaatgcttgaggtgatggatgccccatttaccctgatgtgattatgacacattgcatgcctgtatcaaaatacatcatgtatcccataaatatgtacatctattatgtccccacgaaaattaaaagttttttaaaaacaaaaaaaaatcaaatttaaaaaaataatacttaccttgcaaggctttggctagcattaaattaagttgcatatataaatgtcatatcagtgtccagtacttggtagaagttgttattgtggatattactattgactaagcaaaagtgagctgtacatatctggtttcaagattacaatccattgcatttttttctcaacattttccccttaagatatttcaccatcttatgactttgaaatttgatgtttaagtctgaggtaaatgctggataagttccacttcaggagaagcagggattcatgtcctagggttctagtccctcaaatttgtgagtgctgtaaacatgtgatgatctttagaattcaaaaggggacatatacattggataaaccaaagtgttatttagttcaaaatgggacagtctggtgctcaggtggtgcagtacagctcctcacctgctgggtctcaaaatgctctcctttgtagttggcagcaagttcaagtttagccttttaaagtttctgttatcttttacaaattgaccttactttaaaatgaaaggaaagaggctgggcaaggtgactccacgcctgtaatcccagcactttggcaggctaagtcaggtggctcacctgaggtcaggagttcaagaccagcctgaccaacatggtgaaaccctgtctcttctaaaaatacaaaaaattagctgggcatggtggcgcgcacctgtcatcctagccactcaggaggatgaggcaggagaattgcttgatcacgggaagcggaggttgaagtgagccaagattgtgccactgcactccagcctgggcaacagagacgccatctcaaaaaaaaaaaaaaaaagaagaagatgtaggcatacccatattgccttgtgctcactaagattattcattactgtgaagaaacaggcgttcgttttagtgttatctctgtaactatttgtgatcttacgatgcctcctgagttccttggatttcagtgtgtgcagctgtgaaaactggaagcaatgattcttgcccagtcatcatgtttttacatggatttcctggaggtaccttaaattcaacctgcccaaaacatactcactttctcctccttatgtatatttttcctttcttttcttagtttatgttagtatcttccatccccgttgaccaagcaaaaaattcatgccatgttttactgactgctgcctcccaacactaccattcctcgtgaagtcttgtcaactttaccttggccatagctcagccatgcttcctttattctattattttcaacatctttacctgatctctgggaatcgctcctcacctgccaatccatcttcctcactgtttgtagttacctttttgaaatatagttttgatcactcactccactgccccaaaatgtgactggttcttaaatacaataaaactgctatacaaatatatgcacatggaacttcagacttctttcaatggaagtctagccccaatctatctgtatctatatctgtctatctgtatgcatatatgtaaaagtgtggtttctataatctataatggttaaaattttttcactcaagtcacaagagctagatttgaaaatggtcctactatttatcaaatgtgtgatgcttctgtatttaataatgtattaaatacgaataatacttttttggtaaaaggaataaaaggaagataaattctacctgttagcattgctatgaggactgagggaattcagataaagaattcagggcagtcactccacacaggaagaatggaagggctcagaatagtgtgagctcagagacaatgtggaaaagaagttgaaatttaggctcaaagtataggaagaaggaggatgaggaagagaaagggaaggagaaggggaaggagaaattgttgaaattgctatgtttgggtgaaccatttattttcataattgttcacaggcctgcttatcatacaattttgtcctttcctcttctcttgagcttgttcttacctttcaatcctaagcatcaatcctctatacccccttggctacttgctgccatggttataccatgaaccttgacaacaccaatcactgcaacctctcattatctgagtttcaaatcatattcttgcctcactctccagactcttgtcttactatcctttatttaggactctgaacacaacgaaactttgatttcatagagatctgcaatctgttgatcctatcccttatagttcctgttttccttcacttattccatagctacagttccatggccagtaaacacagcaattaaatatttgctgacttgcatcaatgttttgcctgctactctcatttcatattacttgcttagcaaaaaccaactcaagtaaatgtaactttctacctactctttacttgtgctcttgtagctgaatatagctagatggaaaggtgtaactgggctgattcgtctcactttaaattcatagctactaatctcctgttgcccattaatgctactggcaattatactacatttatcaggcagtctctctcacatacgctcctaatgatatttcatgactttttctctcttctcaaatctccaacaccttccgcctttcccccactcttagctgaccttgattttaatttcatgtaatataagaaggggaattctacatgctttcatatgtgacttttttttcacccaagtttgtcttaaagcgtataatctgtctttcctcaaatttccataaaacaactgcctgtactctttaaagcgaaactttcacttgtgcacaagatcccatcttttcttataaaagagcaaatcttcagccattctttctctcttctgtgccatcagtttctcccactaaggtgaattacacctatcagcatgtcagcatgtagtcgaatcttccattgcaacaaattttgcttcaatttcacttttctctcctctaccactccatgctctgttctctttcataggaatattccttgaattgtctaacttcactccaatgtcttacatcatattccaataattattttgttcctagaatgtaatagcaactgctcttatcaaggttcaccaataacctcctgttgctaacccagtagtcaattcctggtcttcacattacttggacaatcagcaaattttgtcacatttgatcatttctccttcggtgaaactcattcactcagtttcctattgcacatgctctcctcattctactctggctactcattttcaggctctttttactttttactcccaatttatctgatctgcacatatcaaattgcttcaggactcaagcctttcattcacttcttgactttatattctgtgaacatgctgatgtgttccaaatttgtatctctggtcctaacttttttacctgcaatccatactcatatacacgtcttcctacttgatttctcaacatcaatatcccacgagcatctaaaacttatgaataaaaccaaatacctgttatgcttcaaccccaattcctccccaccaaatacttcatcattccagagttccccccacttttgaaatcttcatatttctcattatcaggccaaaatctttgaaataattcatagctcgtagttaatttttaattcttattatgaaatccgtcatcaactcttggcagtaccatcaaaatatatcctgaatccatgaaatagtataccaggttttgttataaaataatattggaaggctggttatgattttatattctgagctgagttatggaaataaagtatttcatcatattattctgcctagttttatattgtttaaattttcataataaacaattaaaatcaaataaataaaaacaaaacatggccaggcatggtggctcacgcctgtaatcccagcactttgggaggccgaggtgagtggatcatttgaggtcaagagttcgagaccagcccggccaacataatgaaaccccgtttccactaaacatacaaaaattagctggacgtggtggcacgcacctgtaatcctggctacttagaatggtgaggcaggggaattgcgtgaacctgggaggtggagatggcagtgagccgagatcgtgctactgcaccccagcttgggtgacaaagcaagactctgcctcaaaaaaaaaaaaaaaaattaagaccagaaacaaaatatatactgagacctaccacttcttacccacttcttaagtacaaccaagtctcattggaactattgcagtaatctcctaattctagtcttaccatagcagctggagtaaaccttttaaaagataagttagggtatgtcattcctctgcttcaaaaccctgtgatgactgtttttctcattcacagaattaacagaactccttgcctttttctcatgttacttctctaacctcatcacgtagcactttccttatgtttcctaaatattcaagaatcttcctctattgagatctttgcgcttgctcttcagtctgcctaggatgttcttctcctcagagatccacatggatcattccctaatttctaccaaatctttgctgtaatgtcacgttctcatggaagcctttcttgatccctggcactcactatgtactttttatttttatttttctccatagcctttattaccttgtacttacaaattttgtttccctaatcccctttctcctcaccagaatataatattcctatgggcaaggctgtttttatcttctttatccactgagctattctcagcacctggaacagtgcttagcacattatagatactcactaaatatttttcgacttgatgccttagctgaaatgtcaactactgtgtggaactctccatagtcctccaactcagaattcatcaatttcacctttatctcaccccttcattttgattacattactgttatggccttggccaccttttatcaagtttgatgtttggctgagtacgtgtgtatttctttccctgatgattaagactagttcttattcataatttcatgctcaagtgtccagtatcatgcctcatgtaaacataaactgatcagaactgatatggtagaggtggcagagagatatgatattctcgatagatttttttcttacccagtaaaataaattgtgttactgaggaggatgaataagctgactacagttcaataaaaactttaattccaaaaaaagttgatattaaaattttattctaatatctccatttactttgatttttctggctttcaactagagccataaaatatgccactgtctcttagcagttagctgtgatgtttgtttgttcatgtaggtttatttagctgcttgacacaatacctttctaaaacgttgtgaatttaacatttatctcagattagcaataactttgtcaggaaagttattctagctcagatcatcacgaatctttctgacttgttaatggtgtagataatgcaagtgccataattcaaatctttttatccaaccccttggggtgcttttatttcataagttaaagagcagcatatattccaaaacatgaaagctagaattcacagtgaagtaattgcctcatagatatctagctatcccctcttagtacctaaaaatcattaggaatgaaaagtgatctttgagatcatagtctaacttcctgctacctaaacattcagagaccaatgatcagaggaaagtccatgcccaaggccacagttttatcatcaacagtgacagcaagcatttattgggcacttactctgccagatactaggctaagcatcttacataaagtatgtttaccaagatgagacttaaagaagaagtttatacctccattatacagctagtaagtagtagaactagaatttcgtgcagaccatagtccaaagcaggcactctcaatccctttttcatcttgcttccttagtggattaacctgcaagagaactaaatgttcttgatatttatagaattatgacatgcaattcttttatatgtttcattccaataattttttgacttaatggctaagttgatttgcattatttatttaccactaataaaacacactagtgaatttttattgttgtatttattttgagagatgaggttttgctatgttgctcaggatagagtgcagtggtgtgatcatagttgacttgcagcctcaaactcctgggctcaatggatccttccacctcagcctcctgagtagctaggactacaggtgcatgccgccatgcctggctaagtttttgtattttatatatataaaaagaacattatacctctcacttgtaactaaaatgacttatgaagtataacacagtatagccaaaagggtaaggctatgtggctgtggaattgaaccacctgggttcaaatcctggcttgttattttaccatctgtgtgactttgggccaattactagtgactttgttttctcacatggaataataatagtatctgatgtgtaaggttgtgatgagtattacatgaagttaaataaaagcacctaaaacacttgctctttggtgcacccacaacattccattcttattagctaatgccatgtgcaaatcatcatgtgggttgaaaattaaaataactgaaatacaagggtgtttcttaactcttatttagagaggactttattactttcataagcattcacacatttgatcctcagataaggtatttatgatgatctccatttcacaaatgagtatgcctttctctgttcagaaagactgaaaaatattgctaagaaaccacactaatagtaaatattagaactgggatttcaatgcaaggtttctagtccagtgatctcttcactgtgccatacaaagtgaaatacattttctgaaaaagctccatataaaatacagtgggagtgcagatgagagaattaaaacaattttatgagcatcattcaatttaatcctcacaataatactgtgaggtaggcagataagggactggtatcttcattttgcaaatgaagcagagaaggctccaagatagcccctgacttgctcaaggtcacacactgttttgtggcagaacaaaggctgaactaggtgttccaacttgcagcaatatatgcttcacattgctttatgctgcctcagaaaacctctgctcactgttcaggattagaaaccagctttttctgactgacatggaggattccttttagaattcatggtatattacatttttgatgtggtgtttacatattctttccccgctcttcagagttgaggactctgcagctgatggagcttgttatccatgagggaacatattgtgatggaaaaagaacaagactcagaatcctaagcatgacattctggccctggcttaaagcttggcaaagttagccttcttcttagagccccactctgcttctctgtaaaatataaaatcatggccctgtacctcaaagtgtttttaattcattgaatgagagaataatgattttatttctccagtggacttaatgcatattgaaaaatgaaacatgccatccacaaatgtcatatataaatgagcaaatattgaatgtgagttgactatatgtccatgtccagcagtgtattgaaaatagaagagaacccagcagattctctggaaggagttaatcttgaaaggttcgtcttactgatgaatgtataaccacacacttagttaagagctttagtggaaaggaacatgcttctgtgagagcatttatgaaatgtgtgcatgatgtctatgtcataatcagacttgcagtttcaaaagatgactatgactagaaagtggaaactagagcagaggtcagccaggtgggtgccagagtcattcagcaggctattgcagaagtccaaacaaaagatggtagcttggtctaagggtatgtcagtggagatggagcagcagagagaactttgtagatatttagggggcaaaactgacaggactgaataatgcattgcacatgaatggtgagggagtaggggttgtcaaggacagtcacttggtttctggtatattccagtgtagagatcattgtgcaatttgctgagattaggatgctggaaaggtccatatttgaaatgaagatcataaattcagtttcagacaagttgtgcttgacatacctttacgaccttcaaatgggaatgtccccaagggccgtggaaataggaatctggagctcaaaggagaggattgggacagagatatgtatcaggaatgtgtcagcatgtggatgctcgctacagctagagaaggttaagatggcccatcccaagaaaacagaatgataaaagaatccagaactcagtcacatttatcatgtggatagacgctgaaactaaacaaaataagaatttgaaatcaaaatctgtttcaccccaactcccaagatatagctcattatttgcagttacagtagccatttgttacgtaactagtctcaagtgtgtattagatgttgaagcagagattacaggaaagcacatttttaaaaagctcattcctagatttatcctttttaacaattcaataaaaaacaatttttaaccaaaacttagtggaaatacctctaaccaagagaggtaaacaaaaaagagacatttccagtcttcattatgcttttatctggcagtgaaacatcttgaaacctttctctctaagatagcattgatttccaaacctatggttttagggtaataaggaatgtgacatttgggtggttatcactctgctatcactttgagtcctatttcattaaacaccatgtttcagttttgaaatcttttaattgttataacattctggcattcactaaagaaataatgaatgaaagtagaagagataaaaaggagatgctaaaaatctttccactaagaataacgtaactccttctctacaaaggaaggttaatgtaactcttcctccctgaagcaactaattaggtgtttgacccctcaaggcagcatttgttgctcaactcacaagttgtaactaaatgttaacactctgaggcacttaggcaagatgatatgtatttactaaaaatgcatgttagagacttgctacaaataatccactaagaagcagaatcatgtttaatctctaaactctacttctgaaatgtaaaaatagaagtgctgaattcagctaacacaaacacttgtagatacaggagattttctattttttattcctaatgaagagtattagagtagtgaggtttctttaagtagatcccactctccattacggataatgaaatcaagacccaggaaggtgaagtgacatgccaaagatgaccgaaataaatggggatggaacaaggaatagaatccaattttctaggcatttctaaggtcacattatgtggagattttatgtaattattctcttttaatttcacatttatttatgcatttatttaaaaaattatgagccccagcaatgtagccatttttttatgctcagtgaatctatatgctaagtgtgaataaaatataaatggaatatggcttctctttttaaataatttacagtgaagtcaaagaaacatgcatgtccattaatacaaagtgatacataatacactagatgtataaacagaaagcaatgaaaacacaaaagagagcatttaatggtactgggtttgaagacatgagggtacgaagtttcagctaaacatttcctttgaattggattccaattgggtttcatttgaaacaagcttttgccaaacagagtcagaagtgtgagtcaggagaaggtaactccaggctcatcatcactggtcattgagaaatgcaaatcaaatcaaaaccaaaataagataccatctcatgccagttagaatggcgattattaaaaagtcaggaaacaacagatattggagaggatatggagaaataagaatacttttacactgttggtgggagtgtaaattagttcagccattgtggaagacggtgtagcgattcctcaaggatctacaaccagaaataccatttgacccagcaatcccattactgggtatatacccaaaggattataaatcattctactataaagacacatgcacacgtgtgtttattgcggcactgttcacaatagcaaagacttggaaccaacccaaatgcccatcagtgatagactggaaaaagaaaatgtggcacatatacaccatggaaaaccatgcagccataaaaaagggatgagttcatgtcctttgcagggacatggatgaagctggaaaccatcattctcagcaaactaatacaagaacagaagaccaaacaccacatgttcttacttacaactgggagttgaacaatgagagcacatggacacagggaggggaacatcacacactggggtctgtctgggggcgggcgggggggctaggggagggatagtattaggagaaatacctaatgtagatgacaggttgatgggtgcagcaaaccaccatggcacatgtatacctatgtaacaaacctacacgttctgcacatgtatcccagaacttaaagtgtaataaaaagaaatgaaaggaaaaggaaaagcaaaataagaaaagacagagaagctgacatgaacataggggtcctggggcaggacggctcattgcagatgactgtgcaaagctttgggccacatcgtgaaggtctttgaaccttgttccatggaggtgagatctcattaatctagaatggcagctagcacaaggttgtgggcatggagttgacaggttatgtgtgttaaaagggtatctttgtcaatagatgatagcaaaaattgagaagactaatggcaaaatgctagaaaaagctattattataatgcaatacatttaagtaccaactaaatcagggaccagttctaggcacaggagaatatactctaccagaattagatctcaatgtaaattgcacaatggtgcatcgcatgttgccatgcttgacttcatgcttcaaaagatgtcagtgcttaagagttacagggactgatctcagtaaagcaggaacattatggttagtgggtcaaactgcatgcttttagagtagaaacatttattttccaagacactttaatcaagtaactcaaagttcttaaaactagcattcacaaaaaattaacgcttcttattaactaactcttcttatagcctccttgtaaaagtccaagtggacaagttgtctacagactttttagcatgaggaatcagacttcgtatatttgatgctctatgtgaattttcattgagtaaatttgctgtgaatggattcaggcaggcacaagtggcttgattcctttacttcaatcgacttatcctgaatttggcttaactccaccacactgccaacttagagttagggggaaaggaatgaagtggagaagatttgtctgacaatccatctggtgttacagatcatgactctgagttctgcatatttgaagggtaattatgtcttcagattcacaggagagaacatcactgagagggaggaggcttggggtccctgccgcttccacaggagttgttaacgcagtgagaggccgaacaatacaagtttacccaaaaattgggtaaacttctcattattcactgttctcttttcttcagaacccagtgtgcttatctgcccatttacagaggggtatggactacagtgagcagagaggaaatccttaattactgcttcatggaaaatttactttaggtggctagtgttggcctatagtggaaccagagaaatcccacataataaactgcccttccaaactcagatgttacttagttgttgggaaatggtttgctatattttgtttacagctattaaagcctggaaagggtgattaaaaactcgtgggaatccttggggctagaactgaacaaatctgtgaaggataacatggcaggaaataccattttctcaatatgcttttgtataatgttagcaattagatgtcaccccattaaaacacagggaagccacgcagcagtttggcagcagacactcatccaccagtggggacatcagataccataagactatcaagctgtactgtggaactcagggaactcctatttcttctcagtgtccctcagagagcagtttccagccctttaaaaatgaatattttcattattggaacttgttcaatgtgtgtagttatgctcactctttttgttttgatttatctttgcaaagaaaattaatatgatagaaaatatcaataaagattttttttggagtgggggcaagccccaatgtcagggaaacctatctatgtagcttttttctatgtgattatatctctcattaagttatgtcctcagattcctggttttaaatactttgtggaaaagtccccttcttggacgcaatagatttatttcttatgaagttgtggtggtattttgttattataaaataatagcagtgactgccattatggcagaatccatattaagtatcaggtgccatgtatttttctttagatattttacctacagcatttcatttaattctttcagacattgtgatacaaaatttttatagcacatatgttgtacttgagaaatctggggctcagaaagtttaatgtgaaggccagaaacagcccccctgacttacctcagtcctgaactacttactccacagtctacataggcttttgaggtttgttttttgttgttgttgtttgtttgtttatttaaaacaaggtcttactctgtcacccaagctggagtgtaatggcatgatctcagctcatggcaacttctgcctccaggctcaagtgattctcgtgcctcagccactagagtagctagaattacaggctcatgccaccatgcccggctaatttttgtatttttactagagagagggtttcaccagattggccaggctggtctcgaactcctgacctcaagtgatctgcctgcctcggcctcccaaagtgctgggattacaggtgtgagccactgtgcctggcctacatagtgtttagatgcaaactccctttgatatgataagcagatttctggaaagtggcacataaaattgaaatggttagattaaaccatggtttaaaaccactacgagcccacattgtggaaaccagtgatcaacccagggcagaaccagcaggtgatcagaggttgaaccatagagttgtcttggaggtgtatttacatagcaagcacaatgcatttgcctgggttctattttacagatcaaaatcatggaaacattttcaaaagatgctttatttatactttatgtaagactgagaaagtatgaattgtccatatcaatgaatatgtttatacataaattttttatgaattattaattttggataatttttggaggctaatgaagattattaaatcttccccattatgaaatccaacatcctcttgtatatgtaagtgatattttcatttcatgatcttggacatttttacctggacatgtccagattttcttgcgtccctttcctttaaagtatacctgttcagcaaaagacataaacagatacttctcaaaagaacacatacaaacagcaaacatatgaaaaaactgctcaacatcactaatcgtcagaaatgcaaatcaaaaccaaaatgaaataccattccacatcagtcagaatggctattactaaaaaaaaaaaaataataaacaatagatgctggtgaggctgcagagaaaagggaatgcttatacattgttggcagaaatgtaaatttattattttaggcactatggaaagcaattaggagattcctgaaagaacttaaaacagatccacaatttagcccagcaatcctattaactggtatatatccaaaataaattaaataattctaacaaaaacatccatgcactcatatattctggataaagaaaatatggtgcatatacaccatggaatactatgcagccttaacaaggaatgaaatcactccctttgcagcaacacggatgtagttggaggccataatcctaaataaattaatgcaggaacagaaaaccaaatactacatgttctcacttataagtaagagcttaacactgagtactcagggacatatagatggcaacagtagacatgggactgtcacataggaggaaggcaggagggcaagggttgaaaaactgttgcgtactatacttactacctggtcatgacaagatcaatcatacctcaaaccacagcatcacacaatatacccgtgtaacacattttcacatgtaccccagaatctaaaataatgaaattatttaaaaaataaaatacagaataatacctgttcaaagggttatggccagcgtgacttggaacacagttatttcatccagtttatttagtatttgtaagaataaagtcaattatgaaagctgtccttccttatacatacccaaggtgtttgataggcaaatatggcctttgataacaatgttgcttgaaggtctagaaaagatgctttgaaatgattcacagcagatgatagacaaattgatcctctcagcagtctctgagtgctcattgtcccctttttccctataggacctcatgtcttttacccaaagttcccatgatccaaagaagttccttatttttccactattgttgaatgatatcaatactagatttagaggaggaagttccagatttcattcttaagtgtgatacccactaactgtgaagcctttgaataaatcatgttgcttttctaaatctcactttctatatgtaaaataatgataacaaaaccaccctatctatatcagtaaggtacctgaggcactgggtataaaaattcttctgctaaaacaaaaataagcaaaaatccccatctccatgtgctcaatctctttgagctatatacaacaaggcatacaattctattatgagggtttgcttttaaaaagcaatttgctgacctaaatgatcttagtttggtagaatatagcagtgtggtatgtggcaaatgggagcattgttccatatttcttagccttacctactttagattactattgaatctcatccagacccctactctcctagaagtcggaattcagccttccagaaacttcatactgcacttctaaaagaatgcctaaacctcaggctatatccagattcatacagggtgctttttctctattgtggtaaaacatatctttcattttacaattttaactatttttgagtgtacagttctatggtattagcacatgtaccttgttgtgctaccatcaccaccatctgtccacagaatttttcattgtctccagttaaaattaaaaaaggcaggggttgcaatcctactctctgataaaacagactttaaaccaacaaagatcaaaagagacaaagaaggtcattacataatggtaaaggcatcaattcaacaagaagagctaactatcctaaatatatatgcacccaatacaggagcaccaagattcataaagcaagtcctgagtgacctacaaacagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaggacacaacataccagaatctctgggacgcattcaaagcagtgtgtagagggaaatttacagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaattgaaggaaatagagacacaaaaaacccttcaaaaaattaatccaggagctggttttttgaaaggatcaaccaaactgatagaccgctagcaagactaataaagaaaaaaagagagaagaatcaaatagacacaataaaaaatgataaaggggatatcaccaccgatcccacagaaatacaaactaccatcagagaatactacaaacacctctacacaaataaactagaaaatctagaagaaatggataaattccttgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactagtaccattccttctgaaactattccaatcaatagaaaaagagggaatcctccctaactctttttacgaggccagcatcattctgataccaaagccaggcagagacacaacaaaaaaagagaattttagaccaatatccttgatgaacattgatgcaaaaatcctcagtaaaatactggcaaaacgaatccatcagcacatcaaaaagcttattcaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaagaacccttcatgctaaaaactctcaataaattaggtattgatgggacatatttccaaataataagagctatctatgacaaacccacagccaatatcatactgaatgggcaaaaactggaaacattccctttgaaaactggcacaagacagggatgccctctctcaccactcctattcaacatagtgttggaagttctggccagggcaattaggcaggagaaggaaataaaaggtattcagttaggaaaagaggaagtcaaattgtccctgtttgcagacgacatgattgtatatctagaaaaccccatcgtctcaacccaaaatctccttaagctgataagcaacttcagcaaagtctcagcatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaatgaaatcaaagaggatacaaacaaatggaagaacattccatgctcatgggtaggaggaatcaatatcgtgaaaatggccatactgcccaaggtaatttacagattcaatgccatccccatcaagctaccaatgcctttcttcacagaattggaaaaaactactttaaagttcatatggaaccaaaaaagagcctgcattgccaagtgaatcctaagccaaaagaacaaagctggaggtatcacactacctgacttcaaactataccacaaggctacagtaaccaaaacagcatggtactggtaccaaaacagagatatagatcaatggaacagaacagagccctcagaaataacgtcgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagtatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggtcatcagggaaatgcaaatcaaaaccacaatgagataccatctcacaccagttagaatggcaatcactaaaaagtcaggaaacaacaggtgctggagaggatgtggagaaataggaacacttttacactgttgctgggactgtaaactagttcaaccattgtggaagtcagtgtggcgattcctcagggatctagaactggaaataccatttgacccagccatcccattactgggtatatacccaaaggactataaatcattctgctataaagacacatgcacacgtatgtttattgcggcattattcacaatagcaaagacttggaaccaacccaaatgtccaacaatgatagactggattaagaaaatgtggcacatatacaccatggaatactatgcggccataaaaaatgatgagttcatgtcctttgtagggacatggatgaaattggcaatcatcattctcagtaaactatcgcaagaacaaaaaaccaaacaccgcatattctcactcataggtgggaattgaacaatgagatcacatggacacaggaaggggaatatcacactctggggactgttgtggggtggggggagcgggggagggatagcactgggagatatacctaatgctagatgacgagttagtgggtgcagtgcaccagcatggcacatgtatacatatgtaactaacctgcacaatgtgcacatgtaccctaaaacttaaagtataataaaaaaaaagaaaaaaattatttacttattaaacactaacgtcccattctcccatcacttagctcctggcagccactcagggtgcatattttaaatactagcagtgctagttaaaatgatggtaacccgtataacaaataagccctaaaatatataatggctcagaactatttctgactctataaggtatggaagggatgttactgattgtcagttcttttcccagctcttctctagaattattacaaatgttgattgttccatcatcacccatatggcttctaaggtcatcatgcttccctacctcaagacaacaggtggaagaagagaacatggtgaattacccatgtgcagtttattttaggccaggcctggaatcagcacacatcacatcacatacactcaacctcttgatgagactcagtcacaaggcctcaactagacttcagggaagccggaaaatacggtctagtacatgaagcagaaatttcgggtttgaggataagcgagccagtctctgccatcagtcatattaagagtgtagatatgcccaggaatcatcatcattcatgcacttagaacttttactttttgaaaatctaattttccctggcagaaaaagatattttattttaaatatgtccaaaaccaaaacatatctgaatggcaaaattaaagtgtacgtataattccactgagaagcaagagatattatctagatatagaaaccttgagaaacaattgagaatcttagaggaagtgccttcttcactcagttcaatcagctatatgttaagttccaatgaggatatctagaatgttcagaaggtgtagaattatgtgtgtccttaaagaatatttcaatagttaccatttctaaaatgtcagcatccatatccaaacggtttgtcatctcttaatacgcactataaatgcaaccatgatcagtagattaattcattagtttgcaacactgaggaagtttttagtttataaatgtattgatattgaacacatagagatgtggcttgaagagcaagacaaacaggcatatgttacagtttctcttcacgcaggaaggaatctacttcctttcactaattgcacttaaagtaaccacagggactcaggctccatacatagaacactaagcatctgcgttttcctttcatacaatgagagaaaatgcataaatgcatttgttggcaatactgacaaagaccgatttgtggaataattgaaaccttgatttctgtcattagccggatgtttacaaaactcgtcttcctgtctacattccagatgtttctccttattttaatagctccttgtttttcatgggttttgaattccaaattgtaaagtgtcgaggaaaaagactttcgtttgcaagtttcatggaaaatgacataatcttaaactccccagaatccttgcaacatttatttgtaggtccttccaattagtttattttctatagaaagtctgaggtcttgaattatgtcccagagtcaacattagatgagtgagcaaccttttggttcacctcactactcttgcacatcaaatacagattttggctgaaggtattctttttggaataatctttctctgcaactttgatttctcagggaacgagcattgaatacaacacagcctgggtcccttcagctcactgtgggaaacctgaagccagaagccatgtacacctttcgagttgtggcttacaatgaatggggaccgggagagagttctcaacccatcaaggtggccacacagcctgagtgtgagtatgaaaaggaacgggccacatttaaaaagtatttattttcctctgcaatatccttgaattctttcacagaacctttgcgaagtgacaaaagcgaagaagagttttttttcttctaagtaaacttatataactcgaggacttttaaaagataacttgtaaatagaatggcctcttcacttaggccacataccgtaatggcaaattaacctctataaaggcctaatctatctatgcagtctacttattcatttcctaagaaagtgatttactcttcctgacagtattttatcctcatcattgagtttcagcctcctctgttgaattttcagattttttgagtttgtaaagagtgtaacatcaaaggtaaaagaacaataacatacaatttctaaatccagggactaatttaaaagcttgaacacgcaccgcatgcactgaaaaacctactaaaagcaaattgagatttgaggaatatgagagataacctctattggataatctcactccctctaccttgaatcactagattcagctatgtttttttttcacaaagtagagcagctgaatgttctttgaccaatgtataattcaatgatttcaactttgataaaggaagagctccagaattacatatcgaaaactatttctgtacttgacaaaattttgttttttcttgtgcatttctaatgttttttgaaaagattagttgctgatgagtcattcgccaaatttgttttgtttcgcattaaaaaacgattggaatttaaaatcaaaatgaaatgcatggctacttgttaacaagctgccttatgttaaacacctaactgtacctgtttcctttttatataacaaaatttgtaatgatattttgatttcctgttcattttacgtgaaactgtaaagaggtatatcaaaatcacctcttgtattttgggaataaggtgaagtagagattggaaatattttaactggtaattgtgagagagtaacctttgtattctatcacttcttgggtggtttaaatcagcaagtcgaagaagagagagcaggagatacagtctgagtgcactttccacagaatctccatcctttctttcatttggccagggctacagagacaagatgataacaaattggaataaagtattaattgaagggacggaagagggctaagttgtgcaagtactacaaatatttgcctcacagaaataaaaacctcaacaacttcaaaagcatagtcatgttgaggttccagacaattatttggaaatgcaggcccccaggcataataataatttgtaggacccaaataatttctgtttgcaaaataaaaacacaggggcacattgttaaaaattattaagattatgggatggctacagcagaacgtgagtccttgcacaacttcaccctttgctgcctatgagctggtcctgctcccaggtttctgttctgggcaatgttttgttgctgtactgatttaaatcactaaacaatgccaatttcctcttcataatgtctatattaacataacatttcaatcttctttttttatttttgggacggagtctcactctcttgcccagactggagtgcagtggcacaatcgcggctcattgcaacctccgcctccaaggttcaagcgattcccagctaatttttgtatttttagtagagacgagctttcaccattttggccaggctggtctcgaactcctgacctcaagtgatccccctgcctcggcctcccaatgtgctaggattacaggcaggagccatcgcgcccagcccaacatttgagtctcaattgctttattgactttctcttcatagatcatctatgtaaaatcaataacttttatgactattttatatttttgattaaaagcaaattaggttttacatatatataatacacacacactatatatggtatatctcatgtgatagataggtcaacaatttaaaaactcttgaaaaattccttaaagaaatccttgataaattttccagtattggaactagctttaaaagcatgctcattttcaaaagatcaaatctccatggattatctgaatttttcatctcctagttctaaaattatcgtaaaattgttatactgtacttttcagagctgactagtcatgattacattgcatttctgataaaaatcctggttggttagccttgctttgtaagaatgagcattttttttccccttgatcaatactattgtttctaagcattcaacttaagaaagcaattttcagtgttttaaaattttacttcttttttttttttttttaacaccaacgttcccaagccaagggacagtaaagtattttcgtttttgacactggctaagaacactcattccataaaaattaaaaaaaataaaaactatgataaaatgatacaatatattctgctattttaatataattaagttaaaaagaataatgatttttttgtatcacacatatggccttaactttgtaaaacacaaacaatgacataattcataagtatgtttaataaacatttattatgttcctaacactgttccaggctgcatgaggcatgttagaaaagcatatgtgagtaataaagcagcagtatttatggatctcagcagatttggggggaagcaggtattttaaatatgtaacaataacaaaacaactcgagtaggggaacttataagaagttggtaaatggaatacaaacaatctgagtcacagatttgctcgtgggcccatgacctgtgatggctgcagcatattacctagttaatttcttatgcccagatcatactgcatccacctcctcaaatcagtcttgtaatccagttacaatgacagccatgtctatgctttatatatcacacattccttcccattcagaaagcagtgtgaaaaatttgtgcagagcacctcactggacccaagtctctataagcatttactttgcttaacaattagcgtaaatgataaggcataaaataacaaaagcctaactgaataaaacatgctgattgttggtattgttgtcacatataaattctattctctaagaaatgaaaatgaagaatctctctgctttagaaacatgatgcagccatgaatctttttcattaatggcagcaataacagccttagaatgctaaccatattttggcctttagtaacagcattgttctattaaattacccattttcttaccagtatatggaataaggatacctttgcagatcattgtttatttgcactatgatttgattctgtttcactgaacattgccactggataattcctcccttactgagtagataagtagttaggaataaagtagcctgcataaacaagacattcagaatatcctttacatgtgcaagagagttagccaattgcttcaattcatgtatattgagtactactaaactcacttgccgtctttcttacggacattagaataaataaattatattatcatgagtgataggcattgcatgtgtattttatcttctgttggtaacataaaatgccattttggcaatttgaaagtatttctaggataaggagcacttacttcatcttctccaagcctgctcaataagacacccaattactgaagaagatggaatataccagagatcctatggttcctttcctttcctttcccattccttcctcccttcctccttcccgccatccttccctctttgttataagcccatctttctgtccttaagagaaaatgcgagggctggttttatgacttcgctagactatcagaatttagtggcaagatcaggttaaagaaaacgttttcatcaatatttcttttctgacaaaatgatcttatcttttgaaaatgggtctcagctgagtatgcatttggttgctgcttttatcaatgttttccaaatgtgatgtagtaattgtacactaaaattacatagcttgtatacaaattgaatttcaagtttttcatattatttgaaaatatcaactctattatacaaaccatatttgcaaagaataaaactgatggaaaatatgtctgaaatataaatcagccagcaactgtttctaaaagtgcatacattttgtagtaatcatttaaagagatcgacagcccaagatccagtttatgaaataattgctcgaaatagaaaggcttgatttatatgaaggtttgtgtcctctgatggtatcttcctttgctaaacccttgcccattctcccctgcctttatggtatgtaatttctctaccatattatcagccaggatttaagtccctgtctgcttaagacttgtctaatcttttcataccacatgtggagattttttgaattattatttgcagtcctttaagatcctgttaaggcggtttaatcataaaggatgttaaaatggaccacatactggcttgagggcttgagttagaatgggaagcctatttgcaagaccacaactcaattacctacaaaactcttttagatttaagagttgtaagtaatattcttagtctattatattctttacactaaaaagatgagtgaaagcaacccaccaatttgagtgactttagaatatattatctagaggaatagccatatttgcttctttcctccttcatgagattttaaaaattctaatatggctctacttgtatggttgttaggaaaagaacagagaagttcaaataatgtctctgaacattactacctgtatcctagagcaagtttgtcaatcatcgagacctcagtttcctgaactataaacgggagtatcatttattcctcttcttcctaagttgcaaaaatgaaatatgataacacgtgggcagccactgggtcttgcctggcatctcatttaaaaaaaaaaaaaaaaaaaactccctgatccaacgggatcaaataagaacataatttcaactgctctacatttacaaacaaagtgggatactcatcagggtaatcacttgggtaaataaggctaatataatacctcatttatagtttagaactagcttgatcactatacagtcagcacatttacatactctgctactttctccctaattaacctctccttagcatttggcaggctgttatagattgccttgtctaaattttgaagtcttatgaacagaaagtgctacattatcccgtaagatgtatcacagcattgccattttataaataaagccatgtgtcacttaaggaaggaaatacattccaagaaatgcatcattaattgtttcatttttctgagaacataatagtgtcttacacacctagaaggtagagcctactacacacctaggctctatggtatagtctactacacacctaggctatatggtatagtctactatacacctaggctatatggtatagcctattgctcctaggctgcaaacctgtatagcatgtgacggtactgaatactgcaggcaattataacacagtggtatatgtttgtacatctgagcatgtctaaacatagaaaaggtaatgcattgcattagaatgatatgatagcaagatgtcactaggcgatagaaatttttcaacttcattatattcttatgggaccaccttggtatatctgggctgttgctgatcaaaacattgttatgtgacacttggctgtcattggttggttgatgctggtagaatatggtttgggaaagatacaaaatatcagttatatttattaaagtatggttacataaattaagcaaactaagttgatcacagctctgtctagctcattacttttgtcacttgatttacaatgattaactgcactgcactgagatttgaataaatatttggggtgaccactatggcaaacctgtccactcgacaacaattcagttgtctgatcccgtacatggccagacataaataatggaaagaagtaaagataagcactggcattacatcttttttggtagcatacaaatacattattttaaaagtctctggatgtaaaaaaatgttttcaggtgttataaataagagatggggaacgttaaaaatttatggtttagtatcctctgtgaccaaaggcttaaggaattcatttagatttaatggtcaattaggctaggtatgatgtctttgataatgacatatattagtggaaggattacaggtgggcttgagatgatgggttgtttaatcacctctagaagacttcaaagcaaatgtgagtcactgtgttctttcttcattcatttaaaaatatttattttgtgctaagttctagaactacagtttccagtacagtaaccacaagccacattggtctatttaaatttaaaagtattgaaataaaataaaatttaaaattcagtttgtcagtcacaatagccctattccaacttcttagtagcacttaaaatttaaataaaattaaaaaccaaaaattcaacttatctctcttgtgagccacatctcacgaattcatatatgattactggctactgtattggagatcacagagaacatttccattatttcagaaagttctctcagacagtggcagtctaggcactatgctggtaaacgaggatacaaatgcaagtcagaaatggtcctaactttcaaggaactggtagtctagtggaaacaactttaaatagaattcactaaaaacagctttcacagatttcatctccctgaacaaaattgttcagttttgttcaaaacaaaaaagttaattatgtgctaaaataatagacatgattttttaaaggccacagaatctagacctgaagatatgctgtttatttacttaagttagttaatcacattaaaaatccattacctggaaaaatacataagcatcttccgaagttcaactgaaagtgaaggacatagcttactagttgcttgggttgaacagtggtatatcgtaagtgtaatttccctaagaagcttctgctggctctcttattttctcttttcttttgagcacacagtacgattcaggcttcttcagttggtataaccaaacatctagaaaatttatctgcttcatgagaaattgcatagaaagaaagctaacttctcatagatagacataagggagtgtaggaaaggggataagaaagtgtcataataattattggttttcaggcagcacggtcaactagtctaggagaaagaggttccctaagtagatctgatttgggtttaatcgcctagtttggttatatgccctactaaacgtgaaagcggttggtttgctaagctgaattagagcaaaagccagcatgaacatcttcggggatattgtcgtcatgctggtgcagctgaatgaaactctactccaaggacatgagctgagctgctttaggcaaccgctttgatggagagctgatgaacaccactgagaaagggtaaagatagaaaggaataaggcattttaatcacatgtgtattgaagcactccctcatctttagagcatatttttctatgcagttcataagtatttactgagcaccaactatgtatccagccttttataacatgcttgggatagaaaataaaataagggcagaagtttctttctttgtctgtttctgctgttataacaaaacacctgacactgtaatttataaaggatagaaatgtattgctcatggttctggagactgagaagtctgagattaagcaggtgtggtgtctagtgagggctggtctctgcttccaagatgaggctttgttgctgcatcttccagagggtatgaacggtgtgtcctcacatggtggaagaagtggtaggacaaaaaagaggagctagctgttccctctagccctcttataaggactaatctcttcatgagggtagagccctcatggcctaatcatcttttaaaagattattataatatttgcattggggtttaaatttcaacatgaaattttggaggggacacaaacattcaaagaagtggaatcaaatttactttctctcttttttttttctttttttttttgagatggaatcttgcactcttgcccaggttggagtgcagtggtgtgatctcagctcactgcaacctccacgtcctgagttcgtgtgattctcctgcctcaacgtcccaagtggctgggattacaggctcacaccaccacacctggcaaagtttttgtatttttagtagagacggggtttcactatgttggccagactggtcttgaactcctgacctcattatctgtctgcctcggccccccaaagtgctgggattacaggagtgaaccaccgtgcctggctctatttcctttttttaacctaaagttagtgttacaaagtttcattgtgtaattaatgcataatctaacgcagatataatttgatgcacaaaccatattgccttttagtataaaatattttagtatattttagaaattatctgatctaacactccaccaaaattaagtaaaactcccttttaaattactgtactattttatggattcttttaactgcaggttatattctgcctgctgtaatatatggtgaattttacatgttacataaaaagtcaataatatgactttagctatttttctttaactccaatgttcttacattatgttactttaattgcccaatctttcctccttggggaacccaagatcccatgcaatgaggagttgagttgggacagaatttctgattacaggctattctgcagggagcggagattaccatgagttaaaatagaaagattttaagcctatgacaagcaattactgcttctaattgtagctgttaaagtcaaagctgagatggtgtcactcatttctggaaggaaatgaccacagatttgtatcaattgaaagtcaagcaatggaactctaagcccatggtcagtgctagtaacttgtacattgtcctcttatttaaacctataattggtgttataaattataactctgggtacccagagtctgacacatttcccggtgccctgaaacataattttaaatccatcaacactttaagatagtagattccaaccattgaaatgtgcaaccaataaacctggggaccagagcttttaaggctagccatagaatacgtcagtgcattagtgagagcccaaggcctatgtctagattcctaagtacaggcatgcttatcctaaacaatgggcttacaataatggcagtttctcttcctgaaatggaaatatcactttaaaaaataagcaaaagatctgtgttctagactgagatttatctgtattctgctgtttgtttttggggaagtcagttacctggtctgattctcaaatttttataaaataaggatcatactgcttgttttgggataatatgaaggggcactagaaaagcctcattaaggaacactgctaactgatcttacacaatttacctcaatttcattgatttttcaaatgtctcccttagaaataagtaagtgaacttgttaacccatttgggtgttgcattatttatctagggctaccttaacaaagtgccacaaacttggtgtctccaaacaacaaaatgtattttctgacctttctggagcctagaagtccgaaatcgaggtgtcagtagggctatatttcctctgaaaatgcttcagaaaaatccttccttgcctcttcctagcttctggtggcttctggcaatccttggcattccttggctggtagctgcataatttcagtctctgcctgcatctccacatggccttctcctctctgtgtctctgtgagtcctcttctcttcttataatatacttggaatgcaccaaaatccagtataaccttgtcttaactaattatatctgcaaagatatgtcatcaaataaggtcacattctgaggttctgggtgtacatgaatttttggagtactattcaacccgatatactgccctgtgaatcttagtaagaattcttacagattcttagtacgattcaatgtcatctgttggaggactgagcaaactatgaagtatatattatgtttgtatgtatttatgtgcatgtatatatatgtgtgtgtgtatatatgtgtatatgtgtagatatgtgtatatgtatatatgtgtgtgtatatatattcaggtcatagctgttaaaatcagagtccagatattggcattagtgtctggaagaaaaacattttagggattttatcaattgaaggtcaaacagtagaaatccaaacctgtggtcaatgttagtaagttttcacaggcagcttaaaacatagcaatgccaacacaattttatatatatataaacttttccatatatagtgtatatatatataattgtatatgtacatatagcatatatgtatacatatagaaaattaaagtgtatgtctatacaggtatatacatacattaattagcaagctatatttttcattttaaaaaccatttcagtcactgcctctcaagcaaagtagaaatgttggtattaacagacatccctagtgtccttaaaatcatatttgctatgctcttaccttcttcatctcttcagaattctaaccctgccttgtaagttgtaggacatagcactttctgaatattaaggactgcaaactgcttaggtggcctgaaggaaactaataagtgaatgaagttagccaaataacagattttgctgaaggtgcctgtgagatctgttacagacattgaccacatgcttggatttctactgtttgaccttcagttgataaaaacccctggttttcttccagacactgatgccaacaacaggactctgatttttattttattttattttgagacggagtttcactcttgttgaccaggctggagtgcaatggcacgatcctggcttactgtaacctccacctcccaggttcaagtgattctcctgcctcagcctcccgagtagctgggattacaggcatgcgccaccacgcccggctaattttgtatatttagcagacaccaggtttctccatgttggtcaggcaggtcttgaactcccgtcctcaggtgatccacccacctcagcctctcaaagtgctgggattacaggcatgagccgacatgtctggccaggactctgatttttaacacctgtggcctgaaacagtaattgtgtgccatcaccttaaaatctttcaacttcagaagaatagcaatactttgacctgtaaaatatcctgtaagcaagaattctggcccaacccaactcctacattagatatgacaaaattaaatgcaaaaaaactaatagtgtcagagccagagtttgaacctagcataatattcctactacactgctaactctgtgtgtgtgtgtgtgtgtgtgtgtgtgtgtgtgtgtgtgtgtgtacacaaactaagattagccatgatcgtttcaggaaaaatgatcaaacattaattaccttttgataacagttctttaatgagttaaaattcttattaattcaccattgataaaaattagttcagaaaacatagcagtgacaacataatatttttaaaatctcagcagggcgtagtggttcacgcctgtaatcccagcactttgggaggctgaggcgggtggatcacgaggtcaggagatggagactatcctggctaacacggtgaaaccccttctctactaaaaatacaaaaaactagcctagcatggtggcgggcgcctgtagtcccggctactggggaggccaaggcaggagaatggcgtgaacctgggaggcggagcttgcagtgagccgagatcgcgtcactgcactcttgcctgggagacagagcggactccgtcttaagaaacaaacaaacaaacaaacaaaaaatctcagctttggtgagattaagccagcctggatgaattatactaaccgtcatgccaacgaccatgctaggcacataatttctactatctgctataaatcacctatttgattttaactctcagttgaatttcttgattcaaagccctctcctatggccttgcagtgaaataaaaaataatgattactacttctattcttcagaggggttaattggcttgtagttcagtataagctcttcacaaaaatgttgaggactcccagaaatgagtagatgttaattttgatggtatggttcattatctaacatattatttaagagcaaaaacaatataataataaatttaacatatcacttacatttttatttatgccacagagtgtttaaattaaacagcttgattaatttttatcactttggatataatatgttttgtattttctttataacctcatatttttatagtatttttgccaatcttcttaaaaatatttaattttgtagtattacaactaatttcacttatttttactttcaatgtgcctactagaaaatttaaattacatgtatttgtagcttatattcatattggacagtgattgcttatatgtatattgcttgtgtcttatgtccagtcaaaaggaagtcaagaaggttgacaatctgaaattaaattgagttttcgagttaccaaaatacagtggttaaatttaactcttctcaaataactgtttctaaaagttatctaaataacattcatagttaactgttttccttattttactcagtgtttactcagcatgataacagctcttgagcatgagtcagtcattttttttttcctgttgatctggcactttgtgtcaccaatagaaataaaagcaaaagtggggttggctagagaaaggggaattgttgatccagagcagcacaccagggttcccgtattcagttttacctaaagtcattctccagcttctgtgagacgatttactgctgaagtctatttgtcttcctgctgctatctctgaacaagcccaaaccttccatgtggttaataaacttcttatcttttgaatactgaaaataaaataaacttaatcctcagggtggttcagtcagccgaccagaagcctttgagatgcttcttagagatacaggaaaactaggttttctgccctgtgtgattatcaatctttccattgcatgcatgtatgtggaagggcgttaaaggtgcttctcagtgataaatgtcagcgaaatcgcaaagtgaatattaatttcagtattgtcaaggtcagatgtgtacctgggttcattgttactggaatttttattgttgctgctattgggaaagatattttatcttgggctcattttttcaagtatggagaaagagtgagaaaaattcctcaatgtacatatacattgctcagaaaaaaagtactgtagcacagtctggtctgttaattagggaaattattttgagtccctaaaaaaagatcaaggtgtaagtttggaggagttaagctaggtgggaaacagagcaaacagatgatcacgagatctggagactagctggtcttcctgaaaagcagctgactatcaatcaatagaaaaagcagaaaattgaagaagaaataaagaagaaaatagtttgtgatgtgcccattaatagaagtagggtgtgaaattatctaactgggagcttataaattaaaagaagagaagataggggaagatgttaggttatgagtgttcatacaggaatgaataaccagctggacatctctgtatacagtgaactgcctcaaagccagtgtggtggcaaacctgtgaattcactcacccacacgtctccacctacacgcatgcccagtttagtctattccagtgtttcctttctcagtgaacaacaccagaatcacctagctatgcaaatctgtattgcaggagtcattcctgatgcttccatcaacttcactctcttaccaccaatccaagtcctgttgattttaccgtccctatagctcttaaatccctgcccttcttttcatctccatggccagccattattctaattcaagctgttttcctctctcttctggactatggaatattctaccaattgatatctcaacactcatctgtgccccttcaattcactgtctgtgtacagtagacaaagtgaaaaatgcttaaaatgggaatttctttctgatttttagaataaaagatccacatcctcccaaggcttttaaggcctggcatggacctgcccccgagaatttttctcacctcatttggactcctctcctccctgcaccttagggtcctgccatattagactgtgagttctatggaagtgttcactctttcccctcaaatccccgcagtgcctggaacactgtaaaaatagttaacattcattgagcatttcctttttgccagatataattcatatattatttattattaatcttcacaacaaacttatctggtaagcactgcccatttttttttaaataaggaaatttaaacacaaagacattaaatagcttgatcctagccacatagcttgagtgagtcttctggatttgaaccctaaatctctgattctggagggtataccctttactgctggtctctgttacccaagatgtaatagatgggatttgctggcatcttgggcatcaaagcatcccggaactctgacttccgtgaaacctacgtgttaggagaatagagtgctaaatttcttctttaatttatattccctcccaaaagagccagtttactcaaggcagttccttatcttttaaagccttgaaatagataaacaataaattgattccccgaagagatggtatcttttaaggtaggatctttttttcattatgtagaaaaatctgctcacttgactgtctgaaaaaagattacttgcttccttttcctctaataaatgacagcagggcttttttataaaagcaatctatacctgtcatttattgctctattaaaactacaaacatcagatattgattgttcccatattgaccataatacaagccaattttgagaaaggttgctgggtttagtcacattatcaccatgggaaacactctgagttgtgcataagctgaagacacctgcctctggtgcatatctatttatagagaactgagatttttgcatgcagaaatacaatcttgagatatatacaggctcaaatcaatgtgaagtaagcaagaagccagtgaatgccctttctgaaggtttctgcttgggagtcttctaaagaattaaacatcaatttatggtttgtagagtatggagatataacaacaaatgaaactcgatgtggattatttatgaggaggttaaaaggctccatttatatcggtgatgtcacatgtctggatcatcctggcttttctatcagggactctgttggccaggtttggtggtggtggttttttgttgttgttgtttttgttgttgtttgttttttttttagatggagtcttgctctgttgcccaggctggagtgtgcaatggcacaatcttggctcactgcaaccttcgcctcctgggctcaagcgattctcctgcctcagcctcccaagtagctgagattacaggcacgtgccactgcacccagctaatttttgtatttttagtagagacagggtttcaccctgttgcccaggctggtcttgaattcctgacctcaggtgatccactcaccttggcctcccaaagtgctgggattacaggtgtgagccaccacgcccggcccaggtttggtttttaagcataatcttggtcagaacttgggccacatccttttaggcatctatggaatgctatgttttccatctaccctttgcatacataatctcttcatgttcttctaacaatactgacagttaagaagattaaatacttcttcctccaattgtctaatgaggtaaccaatatttgaaaaagcttcagggtcttgatttcaggtaacaatattaactaacatattatattgaacacttgctttttcatataatctcatataatccttatgctagctctgcgatacagaaataatgaatacctgagaaaatgatgctctgagtatttaatacttggcccaaggatacactaatatcaagtaggagaaggggttttttgactcaggaatcaaaactaagatgtttcaatcctacctgaaatgttttttaaaaaagcactagttatcttagagatagtttctgacttttctatgtgattttgtcaaaaggccttgacaattcatttgaaaattagagttctgtgaatacttgtacctaaactgaattttctgagacaagcatcttgagaaaaatggatgattttttaactttctttgagtctcatgaaagagactacatttttctgagattggcaaaacattatttgatttgttgatggtggttattaggaaaacaacttaatggtaattccatgctttggggaaaaatgtggtttcctcaatacgagatgaaatgtgcgatcattaatttagttcatcttggaattattctcattgtttttacttgaaaacctcatatctgaagccttccacgaggtatagggtcgtttttgtctccatttcccaacttgtaagttctgttctggaaaggctcatgtcaagtatgttacccattcaacccattcctcctgatgtgtcctgtctcgtcggattcatccttcattcatccatctatgcaattcttaattgttcttcaagaaatgttcttaactaagccctccgttatcatcccagattcctatgtatctcatcaatagatctatttctggaattcctatatgtttggttgtccagataatttttagccttgattatatatgatatattgttcatttctaggtgttttctgtgcattttgtccttcctaagttccttgaaaatttctaataaaagttcatagttctagagaaagcactgtatgctgaacacatagaaattattattagactttaaaatcacgtggtacttttatctaaacatttcaatcacaatggggagtaatgagacccaggctaccgtggaattatttttaagtcagtgtgattaggtgtatatgacatcaagctgtcagtaatgtgtacatgtaacatttaatatgtaaacctaagcacatttgggtgaaactttaagtttttatcttccgtttggtgtgtgtaggtagtttttgtagatcacaaaaacagttgcatttgacattacttagaaatcagcacttgaaacaatttgagacttccaccatgcagtccagaatcttcgttgttcactacaatttgcattactaagcattgcttatgttttccaaagtaaaattcaaaaagctctacattaaaaacatattctacatacttcacaaggttattactacttggttgtgttagtgaaaaatctgagctgtcttcctgaaagaccttatctggaggtcaattcttgtaatccctttattatccaactgtttccagttctaggttgaattacaagaaatctgctttgaagattattttcttcacagggagtcactgaagtttttttctattaagctgtcaaaaatattcattaatatctaagcatatacatatgtgtgtacaaaggtaatatatagattacatccatcatctatatcacacattatatatgtgtgtgtttatccatatctgcatccgttctatatatatttatacacacatacgtaatggcgcagtttagaatattgtgtgttagcagatagaaaatattaaaactaaaggtaaaatgagcaggtaataactgcttcctccaaccaaatgttgccagactcctgtggttttgtaatagaaatctaccctatagtttgtgcttcttcctagccaaattactgtcttatctcctaactatgtacagttcagtcaaggagaggtttcattatgttaataattacattgcctgcaggctttttgatgttgcattccccatacagaatagaaacagatttcatagaaatatcattaaagctgttaactacaggagaaaaaaaatcaaagaggcaatcaaagcatatactttattatcaataaatgtaagtagtttcagaaatggcttgcatttgaaacacgttcactaagcagatcatcagcaatggaagctgctgcttaaagggagagagctttgtggtctaaatccatttggatcactacagatgattacttaggtcctttgctattcatttttaaatataggctcaagaatcatttttaaattagcaaactaataaagggatagaatcagccacagaattctgacctgaattcaggctatgtgaattatatataggtcattactgcaatgacaacacgtgacagtttttcttcaaatccacttttattttagtttttttttttttttttttttaacagtggctgttaaattgatgattttggaacagtagaactcattgtactacacagtcatttaaaaaagactttaaatattcaaatgttcaactacatattccctgacactaacatttatcttcattttggacttccagctgagaaacatcagtataatggctcggagacatcagcctcgttcagtattaggaagatagtggcatgccttgatccttctaaagctttttctttgaaaacctcatattcagattcttttttgaaaaggattaattaagttcccaagatttttaaagaaacatatatgaaaaatcataatttaggttttgttctgattattgcaaatatcaaatttcttacagtaaagggaagacaggaaggcagatgtttagatagttgaatgaaaacagagtaagagaaagaaaagataaaaagtgtattaattcatatatgctatgtgacttcttgattatcaggagccccaacatcctataaaacctaaaatatttggtgaattaaagcagatgaattcaaatgtctttgaaataccgatgatttggaaaataaaatagaagtctatttcacaaacacattttagctttgaaacagtagcatttgattaaaagttgaagatagctctttaaagtgaaattatgttttcctgttataaagtaattaacaatcactatgaatgatttgatgataaagaatcactgattttcacaaccaaaagaaaccagagatagctaatccattggcagctaaaatttgggggatagaaatggtagaagctcagatacaatgatagaagctaagaaccctactcctcaaaaaatatacatattacaacttttaatgtgcagataatttcaggggcttgttcatggaatctttgatgctaatgacaggtttctatcataggtagagtagggataaaaaaccacacatcctgtcatctataattaatcaattataaatcattaaactgagcagctctctctctctctctctctctcacacacacacacatacagacacacacatgcacaccctgtcttcaatatgattatatgtaatcaatcatgctttgttaaagattcggctaacttttatatgccgtttattgggtttaatatccaataagatctcattataaagtgctctgttatactataaatttttatatatagtcagaaattactgttcccagtgcaaatagtgacatgtaatacatctcatttactccaacataagtacttaatttgttctgagatacaggtgttataatgaatttccactgtaatgaaatattgaaatttaaaaaaggtagttggataggctgacattgattgatgagttacttgcatagattatgcatctattctgaaatctttccattctttgaagaaataggtaacttgaatggagatggggagaaattagaagcagtttgccacaaaattattgtccaactgaggggatcagtgaggaatattaaagacatcttcgaaatgatgagcagttaagcccattaagttccttgactgacatactaaaatgtaatgaaatggaaggctgaagctgttaacggtattgatttcacatctaattcccattgttaaaaattttttttctttttcttttttttttttttgagatggagtctagctttgtcacccaggctggagtgcagcggcacaatcttgcctcaatataacctctgcctctggggttcaagggatcagggatcaagggattatcctgcctttgcctcctgagtagctgggattacaggtgcccaccaccacgcctggctaatttttgtattcttagtagagatggagtatcatcttgttggccaggctggtcttgaactcctggcctcaaatgatcctcccacctcggcctcccaaagtgctgggattacaggcataagccactgcatccagcctcattgttgaacatttttgagtctccctttatttcattttctcttgcagctcatgtgcatgtaatgtatcacatatgtaaaagtatgtaaattatactaaaatatactttatggatatggagctgaataaatgtataagtatatatatgtacatgcatacctatacatatcttcataattaatgtaaataatatattcttcatatatatgtaagaacatatatatatatatatgacctataaatcaaagggaaaatattagggaaataatgaatttgaatttctggcatttttgtgaagatgagtaagcatttaatagctcaagtgaaacacagagcctcgacactagccaggaatgcagtaaacacatatctaacaagcaagcactattttggtctatttcagagcactgatattttatatatgaaatatatgtatattttgatattcatatttattcaaatcatacaattatgaaatttttattttaacatatgagaataatttgaaaatcagatcataaaataaattttacaacgaaagagttgaagtagaaaacaatttagtaccaaagggcagtcatttctcaggaaacaaaaaggcagttggaaactttacaccaacaaatcgaatgttctcatttggctggcaattgataaaaacgcatcctgttgttgtgaatacttaaagtaaatgatccagaagagtgcagttgatgcccagggtattgggattggcagtaccagtgtaaactgagtgcaaattatggtacttactgcctgatatttccccgccaatagtaattaagctacgtagatataaagaaattatcagatggggaaaagtgcccacaggctcacatgcacaccaaacacatagacacatgtaccgattttagttcataccagatgtgtgaagaaaacactcttttctgatcccttttagtaacaatgatgaatcaacaaaatcaaatgggttagactacataaagtgccttaggcctgtgatttatggtaacatttgtaactgtatataaaatcactcatttggctgacatttaatgagtcccttctatgtagcaacattgtgcatatccttgtggaaaagacagttgctgcaattacttgcacaactcaatggagtgtgtactggccgttctcctgggacaaagaaccaggacactgagcagccctggctaggcttagcaggagaggagtgtggcctcatgtttgttcttatggggatactgctttgagctgcagatattcctatagtctattttcccccatgatgcctgacggaagtgtgtgtgtggttgtcatatctgtttcccagaagtttccaagcctcaatgattctcagagtcatggtcaggtaaggctgtgcatgacctcccgctccagaccatacacagcccctacattgctaagtagctctctcagattgctcttccatattctcataggtttcactctggatgaacagttcatttgcagcttctcttccgtgccacacttggaacctcagaaaactctgagtgatatgggcacacctcacactccttccttctcagcaaatttgccacctactatgcatgtggtggatcagataaggtgcattttcttctcctttgccccttgaaacttggagtccatttgaattgtgtcacatcaccccattgtgctctagtgggagagatgagcagaaacttcccacacactgcctccctttcccttcccccagatacccactcatctcccagtcctcctggagtggttctgtttgggaaactagggctcagctctcacctgctttgaatgtgttacaagtcacaggaggagtgatgcccttggagttgggtcattttaaaatccaaatctctgctcccagattgagccatgttcacaacaaagaacaccctttccatgtggccacaagagagcaagaaggaacacattcaatgagtactttacttatcaactgggccacatgtttatgcactgtctgcaccatatcacaattctggatccctcacatacggcatatatcttaacaggtcattcagtctcaatgttctcgttcctttctctgccttctgtagaggaataataggttcagaatcagaaatgtcccctcttgaaatatgtgcgttgtctttgtgaatatatcaataatagtataagcatacaaattatttatgtttttttctttaaaatacagtactgtgaccatccacttgaacaatattagtggacacatttttggtttgctttgtttcatttttttcccattaaggaaatgtctgctttgttataacacaatactaatgcatcactgtacactttaagactcctcgttgttcaactttttctcttaaagtctcctttttggaacatagagctttttcatagaaaaagtatttcttcctggaagaatattgaagtggagacactcataaagtgtctgtgaaaatacaactctctaggagtaagggttctttctgtgaaataacacatcaaagaggaatgaggagagcaagacaaaacccagtagagatggattggaatgggatgcattactttggagtcatgaaacatatgtactgtctgtgtatatgtatataaacatttgtgtaaatatatgtgtgtgcgtatgtatgcatgcacacatgtttcttagctctgttcaccaaaaagacctagaagcaaatgcactcaagtagcaacttatacacctaggattcaaatatttgtctttataccattccccactaaaagaaccagaaaaccttgaaggaatgtctttttctagagctgaggcaagatcaagatgagcctggaacatattatgccaaaaagaaaagaggtactccaataaacaatggggcatgtcacagggacagagaaaaacgattaaaaagagcttccctagttgaatctgggtaaatttgaacaccagtataattaaggacaataatgaattatagattataaaaaggaatccatgtgcccattgaaataaaagattcacaaaagagaaaaatatggacttttgcttatagtcaaatgctaagtgtcaacaagtaaatgtagagaaaggaatgctggaataggaaaaaaaatcattattttgtaaccaccatgctagaaatggactccatcaagaaccattagtagatgctaaatctatgggaaatgttgataacaagcatatttatatggtcctaatgttatctccccatgggttgcttattagttgtaagtggtagagtagagggctgggaaggcgtaggggaccttcaaattctgcttggccaagtactcagttctggaatcataaatgaggccagagagagagcttgtgcctctggatgtgatgccctgagaacagatcatttacatttcatttgtctgaatgcataacctaagtctaacatgagacagagacacattcaaaatgatgaacattttatttataaaaaggggctagattctttaaaaatatcagttgcctgaaagtcaatgtatttagtactgttccaactcacagcagcctggaaagacatggcaacaaaacctgaccctaaactggatcctaaattggtgaggggagtgctacacaaatgacattattggtcagttgccaaaatgcagatgaagattagataaaagtattgtgttaatattaaattcactgaagttgagaactatactattcatatacacatttatttttaagaaatatgtaccaaagtatttaggattaaggagaaatgatttgggtagcttattctgatgatatatagattctcttgtgtgtgtgtgtgtgtgtgtgtgtgtgtgtgtgcgtgtgtgtgtgtatgtaattatacagaaaggaatattttggtatatatatttcaaagtgttgacaataggtaagtctggataaaggaaacatggctgttctatgcactatcctcattcttaaaatttcctttggttttaaattatttaatacctttttaatggcaagaaggaaaaaaaacacagtaatttgtaaagataaaaaaatacagtgttaagaacaaggaatctcaaggttccaggactgatgggaaatatgtgaaggtgacattaatacatgttctgccatgaatagaaatatttttccaaatgaatgtatgagcagtgataccataaggggcctgggttccatggaataaatcttgaaaaatgatgcagagttacgctgttaggttccacgctgatctaagaagtgtatcaacagattcatgccagtcagtttttcctatgccatttttgctatggaagttcaaactctcagaactgtattacaggcctacaatgtatatctgtccaaagctaggtgttatccaagcctggggaaaatacacagacaacattattaagtaaggctgtagttaaacctggaatggtggtatcatttgttgattttaggtaaccatagtgtggccattgcatttaccatttacaagctatatacaggtccatatgcaggaatacaaaattatgaaaaaatacaaaatttgcagagaatcaaaatggaagctttttcttaacacattctgtatctgaacctgacctgacctcatgctaggctattcatagtctctaatgagcccatttggcatgaatatcatatgctttactgcaaatatatagttacatttgattaacaatgtaaacaatttgatatgagtatcatatgctttactgcaaatatatagttacatttgattaacagggtgctactacagaccccattagggaaaaaagaaaaaaaaaccctgcacagatactatgttacttttctaaaatctgaaagtttcaaaatcttaagatacctgggctgggtgtggtgtctcacacctgtaatcccagcacttcgggatgccaaggcaggaggatcgcttgccaggagttcaagactgtcctgggcaacaacatagtgagacccagtatctacaaaaaataaaaataaaaaaataactggtcatgatggtgcatgcttgtagtcctacctattcaggaagctgagacaggaggattgcttgaccccaggagttcaaggttgcagtgagatgtgatcatgccactgcactccagcctgagaaacagagcaagactctgtttctggaaaaaaaaaaaaaaagtgttttaggtaaacgattgtggatctgtgctgtctaatttcattagcagacaagttatttatccttcttaagtaacaataataagagaaaatgtaatactaaaaagtggaattgaaaatggaacactaaaattcatttaatgaacccagaatcaggcaagattttaaaactctgacttaaagaaagacaatgtggtaaattatccatagctgtgcgacctattttaattataagtagaaccataatatacaagtactccaaatgtactttctcttttccttctgcagttattagccatgtgcaggcaaagacatagtggcatagtggcaaatttttcagactaagaatttagattcacaatcccactctttgctgccattatcttagtcacttgtactcctttaccagtttctctaaatgtaaaataaaataggcaattttggttaatgtaagctttcttatgaattttaaaatgaagcgattctaaagcttccagagtttatatttttatattcttattccatattattctaaaatacatactcctagaattttattgaactgtaaaaatgtaattttgtttgttttgagaacaaaaacccacttatcctaatcacttttctttctttctttattatttttttatacagtgcaagttccagggccagtagaaaacctgcaagctgtatctacctcacctacctcaattcttattacctgggaaccccctgcctatgcaaacggtccagtccaaggttacagattgttctgcactgaggtgtccacaggaaaagaacaggtaggtgaaggaatggaccacactgcttccatctgttggatgtttccatccattggatagctctagggctggagaaataggaaaagactcgcaaactcttgaaacagcccagtgttaacacattcattgaaaagctgattagttttaaagcacttgttattggaaactttacacaatttaattaaattctggtggtaagaggtaaatgggcaataaagtgaagtcaatagaaaggataccaattttttggttgagtctgcagtggcctggcgtgtgtgggcaaccagatttgtattaactcacctggtcgtggaaggcatttgcagttttattccttagactaaggggtgattgccctcctagtcaatggcgtttgccaaactgcttttttcattctaagacatttatatctaactcccttccatcatcaggatgtgtcctaccattttttaatgttttcagaagaacttactctgagaagcctagtctccttctccttacattttgctcctacccaatggttagcatagacacctgaaaagaagcaaattaactgttcaggtaaactaaaagtaaaaaggtctttagggagacacatgaaactgaaaaattctatttggtgatacatgcacacacatatgttaaaaatagaaattgagtttcatatatatgtgtatatataatatgtatacctatataatacatatatattacatatatacgtatatgtattatacatgtataatacatatataagcataatacatatacatatattatatattatataatacatatatacatatacatatataatacatatacgtatacatatataatacatatacatgtgtatatatacatatatgtgttatacataatacatatataccacatatatgtattataacacatatataccacatatatgtattgtaacacatatatacatatatgtattgtaacacatatatgtatatatgtatatatacatatatgtattgtaacacatatatgtatatatgtatatatacatatatgtattgtaacacatatatgtatatatgtatatatacatatatgtgtatatgtatgtgttatatatagtatatataatatataatgtatatgtattacatatctatgtatatacatgtattatatataatacatatctatgtatatatacatgtatgtattatataatacatatctatacatctatatgtatataatacatatctatgtataatatataatacatatatgtatacatatatataatatatgtatacatatttataatgcatatatatatgtatgactgttgaggtatttacttccagattctcaacttcatgtaggaaaatatatacagacatgtatatattcaatagttaaatcaaaaattggccccaggatatgggagttcttattatttgttgtgaagcttgtcaagcatagaaaggccttcctgctttcacataaactgcatgatcagaatttttacttaaaaataagaaatattttatattcaaaaatagctcaagcccagtcccaaattatattataagataagcattacaagagctcctcctatgtaatcatgggttgtatttttttcttgctatcttcaagctattttttgctcttgttttttcaactttctgttttatctgcctttctatatattttagctcttcaacgcattttgccaaccaatttaaataaattcaaaaccatcatcatccaagatagatgtgagtgtgaagatctgattcctcagtaaccttcacctccagtatctcatttactgcagccatgagaggctcaaataatttcaaccaatctaacagcattttgggagataaaaattgtggcaaagtgtctgacagtttcaagagctgtgggtatatttcagcaagagaagcacaaaatctattatttcttggtgaattattccattttgggtacaggagaaaatctctgttcccatggcgttataagctgccttctgcctgtgagggtttaggtgtgggtagaataacccaaaccattcagtacattgagtagtgttaaacaaattggaacttaatgactgtaaaaatagcatgtgctgttttaacaaggagtctacagattagttggtttttagtgggggagtctgtgtcacaaggtaggttttatagctcattagaaggctggagtgtagtttgtaagagtctaatgtccaattcactgattgcacagaatgagtgccatttctactttaatgtgcttccttgataacagttttggtgttttatgtctccagaatatagaggttgatggactatcttataaactggaaggcctgaaaaaattcaccgaatatagtcttcgattcttagcttataatcgctatggtccgggcgtctctactgatgatataacagtggttacactttctgacggtaagttaaaaacagtgaaactccttttacatatttgacataatattgacaataatgacatgatattgcacatatatcatatattccattttcaaggcttcctgactaaaattttatggactattacagttaaatgtaaactttctatcaagatacatactcccagctggatgtggtagttcacacaggtaatcctagcactttaagagactgaggcaggaggatgagttaagcctaggagttcaagacccacctgaacaacatagtgagaccctatctctgtaaatgttttttttttttttttttaattaactggatatggtggcatgcacctgcgatcccagctacttgggaggctcattctggaggatcacttgagcctgggagttcaagactgcagtaagctgtgatcgttctactgcactccagcctgggcaacagagtaagaccctttctccaaattaaataaatatatatgtatatatgtatatacatatgtatatactcttgagtcagtatatactaataggtaatcctcaaaatgtgactattgactaagagctaaaactttgtgtattttttatttctttacattttctaatacacatttgtgcatgtgtggattaattttgattggcatgttttattcccccatctaaaagtgtgcagatgattaaaggtgtaaatgatagacaatccccctatatttacctcttaattagaaaatatatcaaaaggaattaggccaaataagctgatattaaaatttaaagtattaaaattgagcatgaaaaatgtgtatgttgcctactaaatggaagaatagacacaaacacacacatttgagacaagaagtgcagtgactcaattgtgcttcactacaccctttattcctgggctcaagggcttttcttttcttttccttttttggaaacggagtctcgctctgtcacccaggttggcatgcagtggtgcagtctcagctcactgcaacctccacctctcgggtttaagtgattctcctgcccccagcctcctgagtacctgggattacaggtgcatgccaccacccctggctagtttttgtatttttagtagagacagagtttcaccatgctgagcaggctggtctggaactcctgacctcaagtgatccacccgccttggcctcacatagtgctgggattacaagcgtgagccactgcacccagcctcaagggattttcctgccgaagcctcccgagtagctggaactacaggcataggccacagcacccagctaatatttttattttttgcagaggcagggtctcactttgttgcccaggctagacctgtttttgaatgccataaaagagaggaacaaatcttaataaagagaataaatttgacaaaataatggccaggggaaactagaaacctaactgctagatgatcatgaaaggttgggaaattttataaaaagtgaaaataaaatacatcaaagtatatgatgtggggccaacgaaaactcaggcaggtgcagaaatgtagcgataggcccttgtgaatattaaaaaaggccacaagctagctcttttcagcaacaatttccatttggtgtgtttaattctataaattatttatctttttaattaaaaaatgactttagcttgtgatttcttgacagatctatcattgtttattctgggaaagtacctgggtgtacatttcacacaatatcagtgaaatgaggaagggcatgcatattattaaggacagtacaaagagaacacaggaataatgctcatttgcaaattcaactttaaaatgtattttatacgtaataccactttggtatcatttttaatgtaattcttaggcccatccatccaattctgttattgaagacagaacagaatatttattggtagaataaattacttcacaacttataattataaaaataaaagaaaaacaaatgaaagtgaatgttttacataatttatgtagatttcattcactctgaactgtaatactgtggcctgattctccactttggttttaaatgtcataagtgagaaagatagattattattcattagtccaagaattatcttctggaaatgttacaatgtttaggacttagacagtgtctgtcagtataaaaaaagtatttcgtgaccctaaccccaataaacatcactgtgcaaaggacaccaaattctctctctcaaatgcactgaaaggagatagcaaggactttataagcttcttagagtggacaccgtgacctcgtttgcattcatttttacaatcaacccatctcttttaatgtccaacacaaatgtgtggctcttggctttcatttccttattatccagttcctttctgtctacttcaatctcatgtctcctcctctgtcctgaagctgttcatgctgaggtcatatatcacattgagttgtatttaatcacatttaatagtcacctgcttcccagtcttcagtcatggagcactcttcttcgttaactttatgtatgttgtaacaggtggatgttgtgaaaattaaatgggctgatctgtgtaaacatctaacaaagtgtatgacatttaagtgtttaataaacattatctctaccaaagtgcacttcactttttctcattatattaatattaaatacccctaaatatgaaggatgctgttatattcacctctgttttcttcctgagtaaatatttatcgaattaattagacagctcagtcaaaactgtgcaaatttctgtatgcaaaggcttatctttaggatttcccatttgtggaactaatttgatatattaatttaatatatgactgtgtctaaatgcatctgtattatagtgaacataataattcttttcatatcaggagtcttaccataaaaaatatattgagacatagaaaaatttttaaaaaagcaaaagttaagtgtaaatacatttcttccaatttcattactttatgtttttttttccctgttctactgggatgcttgtaaagatctttgtccagatgagctgtcatctctaatttagctcggctttattttctgagtagaaaccttattttttattcaaattcctccacctagaaaaccactggtttacaatgagccatttttttttcacaccactgagattatacagcatatgatcatctaaataattttgccaatttgttccaaaatactgtctcttgcactagttggtaagtcactaagagcttttatgaacgaatgaaccattgaaagtttccatgccagcttgtcctgtgtccaaatgcagaaggacctgatttcataggcaacataagaatgtgcttattatttttatgaatgttattaatatttcttgaatacttactaatggaaggccctgatccaagtactttgcctttacctttcatcctcacgatactactaaaattttccctactttacagatgacaaaactaagtcagaaagagttcacaacaggtagtaagcagcagagccagaccacataagctagtaaattcagaggcaagattcattgtggaaacatgtttcttttattctatgataagtgcctttaaaggaaaatgcttataattaaatatgaattactggccaggcatggtggctcactcttgtaatcccagcactgtgggaggcccaggcgggcagatcacaaggtcaggagatctaaagcatcctggctaacatggtgaaacccactctctactaaaaataccaaagaattagctgggcgtggtggcgggcgcctgtagtcccagctactcgggaggctgaggcaggagaatggcgtgaacccaggaggtggagcttgcagtgagccgagatcgtgcctctgcactgcagcctgggtgacagagcgagactctgtctcaaaaataaaataaaataaaataaatataaaataaatatgaattactgctgggcagtaattacacttgtaatcccagaactttgggaagctgaggtgggtagatcacttgaggccagaagttcgagaacagtctggccaacatagtgaaattctgtctccaataaaaatttaaaagttagccaggtatggtggtgcacacctgttaccccagctactcggaaggctgaggcaggagaatcacttgtacctgggaggcggaggttgcagtgagcctagatcacaccactgcattccagcctgggcaacagagagaaattctgtctcaaaataaattagaattattttggtctataaattctgtgtacatggcagcatacatttgctgaggggaggaattcaagtgcctgtgccttgggagactcatttacaattatggggacttgatctgtcctacaaaatacctcatctccatgagtttcaagccaacatccttctccatattgagggaagtttccagccccacctctcattggcttgaatggacctatttattataaataataaattatttgacattttgaagagaaaagtgttctttcacttctgcctcatgaaacaagaagcgtcttgggaagacaaatatagaaaagaacaatcgatatggattctcttcactttcacctagccctagcatctattgtatctatctatctccaaataatatggaaattgatagtgagaaggagggagtaggaactgatcactaaaaatactgtagaaaaaattctctactctcctccctgacatgacaacaatagccagtgtgctatcagtggaaagttagagaagaaatgtgcactgtaaaaaaatacagaaaaactacttcaataccattacaaaaggacttttagcagaattgtattttattgcctttcaattcttgttttttttttttctttttttttgagacagagtctcactgtcttgcccagggtggagtgcagtggcacaatctcagctcactgcagcctccacctcccaggttcaagtgattctcctgcctcaacctctggagtagctgggactacatgagtgtacccacacgccaggctaattttttgtatttttaatagagatagattttcaccttatttgccaagctggtctcgaactcctgacctcaagtgagccacctccctcgggctcccaaagtgctgggattacaggtgtgagccaccatgcccagcctgcctttcaattcttaatacagaaaacagccctgatgcttataaaattgtggtagctacagaaaaaagaacacatatatatctatcctcttaaagttttcttggctttctagaaataaggagttaaatgccacttgtaaactcaaatgaaagtgacatttaagggttgcatatcagctagaacagtacctacaacaaaacacatgataaatgttaccttctctttcttccaaaattcaattatctatcaaaaattcagttagtaattgatattatgtttggatactaattgatcaaaaagttagtgtaatattattagaaacatatagcatgacatgtcagtattacaacattaaatataaactagaaatattctttcatgtttaagaagtgactcggccgggcgtagtggctcactcctgtaatcccagcactttgggaggccgaggcgggtggatcacgaggtcaggagtttgagaccagcctgaccaacatggtgaaaccccgtctctactaaaagtgcaaaagttaactgggcgtggtggtgggcacctgtagtcccagctacttgggaggctgaggcaggagaatggtgtgaacccgggagacgaaggttgcagtgagctgagatcgtgccactgcactccagcctgggtgacagagcgagactccgtctcaaaaaaaaaaaaaaaaaaaaaaaaaaagaagtgactcaatatcacttaatattaagacattatttccaaactttgcttttaaaggataacatttttggaagtttgtgaaattatatgatatagagcatgttattttattctacaaatagtacttcaatttaaaaaactaaattgtaatttttatgtcaataattataacgtttagaatagattaaataataatacaagtacaatttatactttaacttaaaaatttacaaaacaaaacttgggaccaaaccctgaatatggaaccatttttattataatttataaactttttattaatatatttattcagcaactatttactgagtgtacaccatgtgccttcaactcttcctgatactggtgatacaacatcaaaatgaataaatatctttttccttattggggttacattctgtatttaattttaaaatcagaataagaatctcaaaaaattaaataacattttataaattgtggaatatttttgaaagaatacttgctgagttaattcatgaaaaacaagcagatgagcattttgtcagaaactacactggctgcaaccttcatcaggcactaagatcagaagttcaaaatcaaaataaaaaaaaaagatttcattttctgttattcccagaaaggtctagaactatataagtaagtactcatttgctcattcaatcattaattcagtaaatattaattgaatgtcagtttggaagataaaagattaatcggtggcacatcatgtcttcatgataattactatttagaagataaattcagagtatggcataaataaattcatggtcagatgtaagtactctatagaaaaacatagatttttttccaaattctagtaaaagaaggggaaagatgtcaaaaatggcccttagattcttgaaaatgcctgagaacttttctattaaactcatctatttgtgaggaacaaggatagggactactcactttatagattaatatgtgttaacaatttattgaatgctacttctattcctattatggggcaaaaagctttatttcatttatttttcatcccagacatctagagtagttcctgacacataaaagccattcaataagtggttgtttttaaattactcacatgatagaatattcacttttttggtagagtaaatatttattataagtattaaaagagagctgtatatgttcttccttctataaaggagtagttaaataaaaatgtaggcaagaaaaacaaaataccgtacctagaaactctacaaagaaaaatatactgctgctttgctaatagaattgactcatcaagtgctatttgcaacctgcttgtatttatcacataaggtttaattttacacagctaaaagaactgagaagtatttcttcttttcactttttaagagctaataaagtttgcattacagggattaagaaacctggctgaccattagaatgacaaattttatcataaaattatgcagattctgaaatgcgcaatatcttaagcctttaaaactactgtaagaaatctcctgtgtgtttttattggtttctctgggaaagttatcacaagagggctgtaattaaatggtggtgtttggtatcactgcccgcgttctcttgcgtaacagttttaggggctccctacataggtaagttaactggctagcgaaatgagaaaaaaaaaatagacaaatacagttatttttcatctctccaaaaatttttgaagtactacctgggttaacctacctaattatcattataaactatataaacaaaaccacactctctttttactagacaggtggtatttttctttcaagattttggcagtaactgtgacaatttgtttgattccttttagtgccaagtgccccgcctcagaacgtctccctggaagtggtcaattcaagagtaagttggctaaatgttcactactccattacctatcaagattacctatcatgtataaccttcactcacccaactgctgtcttgagtacaggatagtggcttccatgtgcagaaatgttctggaacaacacagcaagtgacattgatcccacatcctcttccatcagacttaagtaaattaaatgaaatatttgtctacttctaaacaaatattttgatttacaaatattaaacaaacattgattttgtgaatgttttagtggccaaaggctattccataaggaaacaaagacatctgcttcgtctatattcaccagtctatcatatagcaatgatgatgtgctagatgaggaaattgaaataattaggagaaagaaagactgtttcctaacacattacttagaattgaatatttcgtcatcatccccattcttcctttataaatgtagtcattgaaggccattcttgaacttcaatacagttatatttatgtagcgatgttacctagttgttagaactttcctggcctggaatgttgctatgacttccaaaggagctcaacttaggctagtattgctgaagtagcctaatgccagaggtcagttttctagaaacatgtcattatttcaagtgactcagggttggaaataagccaaggccacctagtagagtataacaaatgaggattcacctggtttgaccctgtcaccacctggccactatgcttggacctccagttaggtacttctcatgtgaggaaattggcctaaatgatttctaagctctgggagacagcagagaaatgatacaggtcttagaaaaagtcatactctgggttttaaatctagctttctcttttcataactatttggtcttagcaaagttttcaaccttagcaaacctctttctatgtttaagtatcctaagaattactatcttccttattgacttatcatgagaaagtaatagtaaaatgtatgcgatgaatctgacttgatagtgattccttcattccatgtgcaaatgccttgtcatattttgtaaaaaatctatgaggaagccatatcttgtgatgttaattggatttgtctcagtcaaatgaatttatcttttgaagcaagtgaatgcattattctcttatacttttaggcaatatgttggataagaactattaaagcaaacataaaattagaagaaaataactaaacttagtggaaaaaatgagctaaaggaaaataatcaaaaattaacataaccctacaaatgacatttttatctgcaacaacactgctttagagatgtgccacttaaattaagagattgccaagtcaaagtcaagtagatttttacaattattgtatgttgttaatgaatgaaatttggaaaacatattgtaatgtctcttgtttaacaattcatcattgttagaatcctcactcactttatgtttttcctccaggacagaatatagaaattgatatacaagctattttgtgtttgtgtgttcataccctttaagagtgtactccaggaaaagatgaatgttttcacttgaaacgtgtatagggcattactgaatgaccctggatgctaactgtatttgaatatggatgtactttactgaagacggaattcctggattgcaaaattgactatatatattatacacacacacacacacacacacacacacacacacacacatatgtatatacacacacacacacacacacacacaaatatcacagcttctactcttctctaatttgcttgcttgcagcaagcaaatacaaacacttctacttctatcctcttgtagttgatatctggaacattgcactgctagaaagtttaaattgttcattcgcttttcagaatgaaaatactatgcccaggcactggaaagtcacactccctctctcctttttctctctctgatcttatttcatagcttctaagaaattatgaattataaatttttatatcagactgttttcaagagaaaagaaactggatgatcaaaacaccactttttgcattctcagtgtattgattcagacaaaggcaaatgtaatattctattttgatatttgtgttttatttgaaatagatgaaaagttttaaaatatattaatatttacccctgactgtgaccatttcaaggggcaaactgtatttaaaaagaaacattatagttgaataaataatgtgttcttttttaatactaacagaattccagggtgtttttattttttttattctttagagacaaggtctttctttgttgcccaggttggagtgcagtgacacaaccatgacttactgcaatcttggactcttaggctcaagtgatcctcttgactcagactctagcatagctggtactacaggcatgcaaccaccatgactgactaatttatttttgtgttttttgaaagacagggtctcattatgttccctaggctggtatcaaagtcctgacctcaagctatcctcccaccttggtctcacaaagtgctgagattacaggcatgagtgaccatgctcaattcatgaattttttacgtaatttattttacttgggattttaagatggaagagaacacactttgaaaacgtattctatatcatatttgtaaatatagagcacaattgatttttttattgatagtaaatgaaataacttggtgcaactaacatttttgcagaaagattattaggatctctgtacataaaactgaggggttgttataagacatatgatcacaatctaggtactcgttaaggttttggtcacccgtaagccagttggacccagaaatcatgttccataataattaagcagagaagtctttacacatctagataatgaaactaagaacaaaattctcttactgtatcattcttgaaaacccagtatggtagaatatttttacaaagctgtaatagcagaacagattagattccttttctacaagctaactatgaacacaagttttttgttgtactaatggcttgacttacacatgttacatgtcaggtgaaactgggtcatagtgaggtggttatttctcatactaaaattttgttacaagaaatagtatcttttccagaaaaagataatggtttatgaaatggactttaaaatgttacgttttattaggaaaactttttataagaataatttccttaagaatttaatttgaaattcaattattattcaattattattgattcagttattatatatttcaaatacatactacaacttaattagttggctggaacataaaggatacatttacagaatgcagagagctaatgttggggcacaaatattaatacttccctatgtttcaatctaaaagttctgatgagtaataatgtttagaggatgatagaattcaagttgcttgggtccttttattaactctttgaacctgtgaaaagtcacgtgtctcagttttatttattcaacacttactctgtacctgttttaatgtcatacataataaggaatgtgatctagaatttgccttcatgcagctcacagttgggtaggaaaacgtgaaagaacattcactgttcctctagccactttaatctgttgaacctttcaaagttgacattattttctcattttaaaatgagagagctggatagagaatctctaaaatctcctgtggcttcaaacatctgtgcctgtgtttctaaccattataccttttctcaaccattttactgttaaagaattagcgaaaacacaaatcaatttcagtataccagtcaactcactagttcagatatatattgactgagcactacagagtgattgcaaggaatgaagtattaactcccctttccccccaaaaccccagtatattatgaggcatagatcattgttcagatttaaatttttaaatgcaaattgatggattcctctcattatatcacctcacacctctctgctgttgaaatccttattcttgaacaccagatgcatctatgtgaatgtctttttgttgcattcctaaaagctggtactcagtcactcacaatctgatattgtacatggtgccttcaaagcaaccgaagaaaaagtttctagtgccttcctacgtcttaaagtgtctcactctcccttgtttcagcacaacttggcatgcttaaataactcaagcctgagttcagcaatcatatgatttcctttatgcaaaaactatacagtaggagaacagcaagtttctactctgcaaagcaaactgatcatttttaacagatattttaacattctttgtgtgtgtttgtgtgtaacaagacagaggaaatctaagtgtattatgggataactgcagaaggacatgcttttgaggatgtggtgcaacttgttggattttgatggaagtctctataccctgtcattgggctggtgttgcttctcttattagccaagtccatagccaagtgggtggctgagtgagtcatttgcatatgactcctagtgggaagggaggagatggggaaaagctggaggcaaggaaaaaatgtgagttatgatattaaattgcagatcctctgtgtctggggtatgtgtatgtgtgtattcagttttgttttgtttttttctgaaattggggttatcttctcttggttattcagaaggggtttcagttcacacacctccctgctgcgtgacaatctctctgaaaacatacttttagaaaaggggtctggacccacttctctgctttcaccattcttctagtcaacgttcatttctctcctgtatgttgtatggagtcataggcctcaggcagcccatggaaaaacatgcttcttcatgtctccctaagtcctttataaaatacactttggctgctgagttcctggacccagagctctgagccctctcctcacaaatgtagtaggtttaaaaaatggatttagtgaagagaaagaggatatatatgagactgcagatgattgtatttatttaaagataaactagaaccagcatttgcttattaatgaacaatttaaatacaacaatgttgactctcacaagcttaacaatgacacttgtcctcaatcataacacagagcatttctgcctgagcatagtatttgccctagttatccatccatttaattcaagtaggtgtagatctcttatatttattttagttattgattccttcatctattcattacatggtgatttttaagcatagataatgtccaggggcctatgattgaaagttttaggaagggtggggagtaggagcataattgtaaggaaggcaatatttcctgggggctcttacagtctagtctttctgtttggaatttgtaggaaagactagactggatataaatgattatattacataagaatcagataatttgtaagaatctgtgagactcccttaaggataagattgtgtttggtctataatttgggtagaactcatcttcagatctcttccatcctgtctttttacttaatagatccttttttattgtggtgaaacaactttatataaaatttaccattttttaatttaatttaattttttaaattaaatacaaatttaagcatttgtaaatgtgcagtttaaatgtggtaagtacattcacattgttgtacatctatcaccagcttccatctctagaatattttccatcttcccaaactaaaacttagtatctattcaccagtaagtccccatttccccacacagtcatagatgtttgaagccacgagattttagacattctctatccagccgtctcattttatcaatgagaaaataatgtcaactttgaaaggctgcaacagattaagtgtggctagatgaaaagtgaacgttctttcacatgttttcttacccaactgtgagctccatgaaggcaaattctggatcacattccttatgtgggaatgtgagagaaaatggggagttattggtgaatagatactaagttttagtttgggaagatgagttctacccaattacagaatccctggcaacgactattttactttttgtatcccaacttactttataaatgagcaaagaaaccaattcataaaaaaattaatttcccttttgcttcatttaattgagaaataaaacagttttccatttttagatcccctttcttatagagaaatgaaaaacttaatgaatcagtggtcaagaatacagacagatgctttaattggctaggaagagatgcctcacttcccattattgtcagtgctttcagaatacttctgttccaaaattccacatttataaattgtttttagaaaatctgctgaaaaagccaactgtcatatttaataagaggaaaccagaaacataaacataggattgttccaaagaaactgtaaaagacataattttgtctcatattccatcagaatttagaccagagctcctgaccagttgctaaattgattcttagactttttttgaagttccaaaaactcaacagtttacgtcttttttcagtgaaattacagtcaatgaataaagatcaaccatgaattagaggaataataaaatagtaaattattggataactagtttttaaacaacataaatgcatcattccaacttaactgctttctgtaattaagttgaataaaagaatactctgcaaatttgcaaattcaaagcatatctttgtattacactatcactcattttctcagagcagcccttcctaaagtctatttgagagaatacttacctttttcttttttctttttcttttttctttttttttttttttttttgaaatggagtcttgctctgtcacccaggctgcagtgcagtggtgtgatctcagctcactgcaacctctgccttctgggttcaagcaattcttctgtctcagcctcctgagtagctgggactacaggcgtgtgccaccatgcctggctaattttttacttttttttagtagagacggggtttcaccatattgtccaggctggtcttgaattcctgacctcgtgatctgcccgcctcggcctcccaaaatgctaagattacaggcgtgaaccaccacgcccggcctatggtactttcccaagaaacaaggttgctatggcttaaaaaattgtgagaaatatgtgaggtttcctattggagatattaaaggctatgagaagtatttgtttaactcagcttttttaccaattgttttttctacaaaaacattttagatgaaatacagcctttaaaactctgtcaaagttacttaatgtcattgtaacattacaaatgagaacaatgtactccataaattgaagaacctcatcttcctccaaaaataccttcttatctcaattaatttaaaataataatatatattaagtgaaaaaataaatttatggaaagcagaagtgaatcaaggaatagttataaaggacatttatgcataactagaataggatattgagaaccttctgtgacatctgttagaagatttgaataagttagagacatgattaaatctccatgtcaatatgaatttttattaatgtaaataggacttaggaaaacattttctagacttttctcatctttcatatttcatatacataaaatacatcatttttctgttgtgttttgagaatgttatatttttgtcttttccaatttattgcagtcactgccattgagtatacttgcacaaaggattttgacaaaaagagattaaaatatatgatagaataccattctcttttgagttctagcctcactttaatattaccttataatttatacttcatcacacacatttctaatggctccatttctgcttggctctgaaggcaaagctcactttagcctttccatgaagtttaatgagatttccctcaagtcatacatttttgaaaagtgggaggtttaataatgggcttaaattaaatgaacctaggtctagtgataaggtctctgattttaatttagttcatggaagttgcccttatagttggaatggttgattagttagaagacatgaataagttcagccctaccagtaggtaaaagcagttgctaactatgtgatttgattttaaagatgttgaaccattcacccatgtgcaaaaactttattcagtagtatagttttgaatgttatttatattataaaacaacttttaaaatgcaagcactttattgaaagatttaacacattaacacgagctattttagtcaatattctagacacacattcaatgaatacctaattataactgtaataatggcagtaacctttcccaaaggtattttgtgcctggcaatgtgctaagcaatgaaagcagaatttcatttattgcttttaataatcctataagatattataaaactaattctgaaataccaattttgaactgtgcttgttgctggaaaggctataacaaaagcaatcaaatgccttcttttctagagcttacttatattctaatacatggaaatagactaataaacaaattaacaattgacacaagggagtggtaagttctgtgaagaaaatcaagaacagtcatgcgatagaatttgaggacctcatttaaatcagattgtcagggaaggaactcttaaggagatgagctgaggcgtgaatagaaaaggatcagctttgtgcacactcagagtaacatatttcaagtgatgccaacaactagggcaaaagcagtaaggagggaactatctttgcatgactgtgaagctgaaatgagaatagaatagaagacggattgctgggttccggccagatctggcggggctttgtagggtgtgataaaagttgggatttcattctatggacaatgaaaagcatattgaaaggagagtaatcagattcaccttttttaagaattacactgactactgtgggaaaattatcagggggtggaacgtagaggaagcaggaagaccagttcagagacaaccaagtgctccatgtgagatcatgtagcaggaacctaggagtcataggaggtgatggagagggaagtagaaacaatcagggtctgtgctggatctagagccaacaaaattggttattggattatagggcagaaggcagagcaagatcaaggatatagagtagatttttggctataaaatgtaagcagattgtggagctacttaatgagataagatttggtttaggggacaatcacttttggacattttgaattcgagatagctattaaatatacaattaggaatgtcaatcatgtagacaagttggtatatgataatagttctgatgacaggtcatgccaggagatataaatttaggagtcactgtcatattgataacacttagggagagactacagttagaaaaaatatggcagaaatttggaatacttaacatttagagattgggcagatgaggaggaatatgacagggataaaaagaggaagggtgatttcacagatgtcatggtggggaagaatgtttccaaagggtgggagctgttaactatgtcatatactaatgagagatacagtaaatcatgtcagtaaggtgaccactgtgggagggagatatgacattcgagagagagtatgaagggattaagtagagtgactatagattatatttgtgaggagttttgctctgaagtggagtgaagagatggatagtgcctttaggaggtggtaggcttgagggaggtgttattgtttgtttcatttatttttgttgtttcatttttgaacatgagagataaccacaacttttagaaataaagcagtaaaagagacacagcaatgatgcagaagagagaatagaaaattgcaggaatgcaatcctttgaggaggcaagaacacacaggatccagtatacaaatgaatgggcacagacaattgaatcttggtaagttgagcaaaggcagagagaacaggtctggatgctgatatattagtcaatttgagctgcagagacgataagtgtaagtaaaggtcatcagagtatgaaggcttggaggaacaagtattgaggatttcaaaacagggaaaaaggtggaaaatggttatctcagattgtagaaaagaagtcataatatacatgacattatgattgctgagtactgtggactgaccatttgagactggttgtcatgaatttaaagtgaaactaaccaacacaatcatgtttgtttttctccccatggttgattgctcagttgctggcttggggtaggcagatagctgggttttattcagtttgatgtttttccagggaagaacgggtcagggggattaatagtttttgcaaaggagtgattaaaaagaaaacccatggatctaagctacctatggaagaaaaaaatgggcatggggcagagtggtgatggataacagaaaaatagtaaggccagtgggctgcattattatcccaattttacagagagaacactgaggcttagagagatgagataatatgccccagtgtcacacagagaagggctgagtagcagcacagggacttgagccccagccagggctgttggtcatttggacacaatgtttcggatagggcccaatgctaagggaagggatgcaaatcagaatacaaaaataagccttgcattcaagtggcttaggttctcagtgggaatttttcccagacaaaggtaaggtctagatcagcagctaggagacatcagaactgttggtggaaactgaaagttttggttctaaaatgtgctgagaaaggagagctagaagaggaaccaaaataacacatttccctgacttttcggtttttttcctgtagtgaacctacatggaagattctgtacctcaagctatgtatttctccccatgggacttaaaaagcacatcagcgggacagcaggtttttaagagagcacaactgatacctcaataaacttcagtagacaaccttaaaaacttagggtatttttgaatgtaattctgacttttcttcaattccaagttatataatatatttgttattaaaagttttaaatgggaaaattgagatccactgaaaagggccttacctcatccctcaagggttgttggccaaaaaaacaaacaaacaaaacaaaaaacaaacaaaaaagccgacctctgattatttagcaacagagttctgcaaccattaggaaatttgtattaaattcagagaaaatgcaagtcataaaactgagcatacattttataatcagtcattattaacttaaatagtaaataaaactaaaccaaatatatattagttaagtatagaatagatgtcagataatagtgtaactgtgtgtgtgtgtgtgtgtgtatatatatatatatttttttttttttttttttgaggcagagtctcgctctgtcacccagggtggagtgcagtggtgtgatcttgactcagtgcaacctctgcctcctgggttcaagtgattctcctgccttagcctcccgagtagctggaatacaggtgagtgccaccaccctagctaattttttgtatttttaatagagatgggttttcaccatgttagctaggaaggtctcaatctactgacctcgtgatctgccacctcggcctcccatagtgctgggattacaggtgtgagccaccatgtctggccaatctgagtatattttaagatataacttctttagatactaaactgaatctgatatatttttatctggaagttattttagtttaatctcatcaaatgtccaccagcatcatacaatcttaatatatgtactcaataacactcaacaatgaaacccacttatttcatttattatgttgttctttcacatagaaaatgatagcctccattagttttccaaagctgttcaaaacattacccagtctactggaaaactctatgtaaaactgacagaatctaagagcatcatcttcacgtttccctagcattttgtataaagtgtatgttgcatacaaatggatttgtcagatacattgagaagtatgttaatagtaggaaaaagaaagtattaaggaacaattctgtatcttcagaaaattaacttaagaacatattatgtatctaatcttaatgcaactggtggaaattaccgtgtcttctacaaataactttgttccagggtaaacagtaagaaatttcactttcttttttttgtagtaatgcaaggtcctcttatctaaacatttctcatctttcagaggagtctacttgacagaccattttgtgttttagctgagaggcagtagctattaactagattgctgtctattttatttttatgtggataaagttgaagagactcacacaaaagggatttatatgtcaagaaatgccttatactaactttaaacaaaattgatatctttttaaaatatgaagctgactgtagatttttatcttttatgcatagataagtctaaatgttgcaaagaatatatatttccatgtccatgactacagtatcaacatgtatttctctagagatgcctatatttcaatatttccaagttgggttttgttttcttatacttcaaagaaaggaaaatacatttgtgtttcttttcaatgccaatacagataattcccttgatgaaatcaaatataatggcatttaaagaaaacgttgttagtaaaaaaataaaaataaaaaataaaaaatccagatgctctcttaatttggaaggtttatcagagaaaagtcaatgaagaatttaaaggttatttccgttacaatcttggattatttctttcattaattagtttgtttgtttaatgataaatattcattgaatatatgctgtgtaggagtcactttctaaacacttcagctccgtaagagtcttccaaattatttgtcagccaaaaaacctcagcacttctatgaatgtcagcaatcagtgagcaactggcatatgataacacctgggcttgcgtagagtttctgctcttccatggggaattaacttctctacctatgataaaggtagcagacactttccccttgtctgtcatttagagaaggttgggcattttctgactatacttaactttgataatagtcaaggatttcggggtttatgagataagaggtctatgaagctgaaccttggagaaaggaaaagttgaggggccccaattaaagttctcaaactttaaggaacataacaataccttaaaccagttacttgtttaaaatgccaaagatttttccctattcccctaacacacactcttctagtgcattattagttgcagtgttatctgacatttcttctatacttaactaatttatgttcaattgttttatatttctttattatttaaattaataatgcttggttgaaaatgtatgtccagcattatgacttgtattttctctgagtataatatacatttcctaatggttccagaccactgttgctacttctgattcagtaggtctttaagccagaaacttagtgttttcaaattgtagtccaaatagtataaagggagatgatctacagatcccactataataaagtctaattaaataaaaggtttccacacttttgtaatggaataaaatcttttaaaaacaaagatttatgtgacatcctggtataatatgcaaaggcaaagttatgcaaaaacacagattggtctccttgggatgagggtaatggggtactggagccaggttgtactgtcttgcaagaatcaattgttaatgttttaagaattttgtgagccctatgttaaacacagcaattattaaaaattcagttacatagccttataattaaacaaattatattaaaggcaaatgtatcaaatatgttacatgtaacagttcctcattcttttactacattttactattatctatgccctttaggttattcatatcgtatctgtggggtgaaaatacacatctcctcccagctctgttttcagtgacattatgctggcagcttgaaattggccttcttcggtgtatttgcaccacagaactcagcaaatgctacaaattaaagattttttcacctacagagccagattttgaacatttaatagcttacttctagagaagggcggatgctaggattgccagtttctaagcatctctctcaattccctctgtaggctctaggacaccacaggaaaaaaaaatgtagtttaaagaaaggaaaaaagctgacttaattatattgtggctgtgaacatgcaaaggtaaaaagaagaaatcaaaagaaaggtcaaattctttagcatgaacacatacatcttacaaatttggttatgagactataagcctttattttcttccaattccttggaaaaataacaatagactagatccaaataattattctacctggctatcttgttttgcaagctcctttacatgaagatgattacaaagatgaggctgtataatctgtgtataagtatctccagattacatctttattgtttagctcagaaaatggttcctccatcttcattgttattgatgaatgagagacacctctgcaccttctgtgaaatacaagtgatcatcttgcacaacagtaccacatttagcatttactttggcaaatttaattatagacatttatcctgcttactgtctataaactatgcttttatctgtaacactaacatataatttgatatacccccaaagtagaagaattgcacagtgcctttaataatatctttgcaatgaatataaataatttcattagtgatggattatttcagcctttcaaaaatgaaatgatcagaattttttaatgtttgttagaaaacaaagttctctttccttaagggactccagcgtatcattttaaataataatgtgtatagtcttgtgtctgtcattcagctatttattcatgaatttaattttcttgattcatttagtcaacagctattatgtaactattgtttaaaaattagatactgatattccttaagaagccttatttttaaataatctgaaatttaaatcatcaaagtaaggtgtctaaattgtagtataataggctaattagaccagttagtaattttttcccttactttgaattatatgtaaagggagcaaatgctggccttaagaattttcacttcaaagttataaagtatttacaaattccatagatggagattcaatttagaatactagatgaaaactgtgtttcaatcattcacctgtatgattgatttttctctatagttgatagtaaattcagtgattttttggaaatatgtatgtgaaggaaggatgtaagtctgtgacatcatgcagtttgaagtctacttttccttggggtattatgcagatatgtagatttgcctattattttctttaataaaattggtgtttttttttctgagactattttccaggaatgtagttttgatcttagaattgattttttcctccagactgaggaggacgcagatgtcaagaagtttcctatgggatatggcttgacagagggacacacaacaggagtcggaggttacaataagaaaatatacttactctatgacatgtgggtcttgtaaggaactgacattgatgggaagtgatgctttttagccaaaggaagaagtatctatcatgctgtcacatcagattcggttcaaactaagcaaacatttgtgttatggtactattcttgggaaatatatttctgaatgtgctcttggctctttagatgaaaagtcataaatgatcataaaatacataaaatggtacctgtcataataagcaaatgataaaataaatttatgcttattataactatcaacatctgtatgtgtaaaatagataataaagcaagtgtctgaacaatgcagcacatactagcttcacctaatgcaagcaatcagctattctttgcctgtctttgcagaagattgtgaccaatgatataatgagtttgaggaggctgtttttatgattaattcataaataagttaatctagacttatttcaggtctgggttttacatttgatgactcattttcagagcccagaaaataatatttaagggagtattaattggattgaaacttttaactgtgtgggtgttacacaaattctatttaatcctcagtgtgttagattaattttccagtattaacaattttaattcattctacctttatcagtcttcagcctcttcttatcgcatgcacaacagaaaaacagaatcaccaaaaatgtatctttagactgtaattcttattttgctgactcaaaatatgtgccaaaagactgataaaagtctgattttccaatagttcatttgacgtttgagtccttttacgtcatcttcaagctcatgcttgaacttttctaatgacagggatatttttgtctttaagcaaccatttttgtcatatgtaggtctaactttcagaaatgtatattcaaagttctgtccctctataacgtctgctcatttgtcataattgtttcccctgggactataaatacatctcatgagtttagtgactttctcttgcggcatgacttttaatatttggggatgtctgtcaagggcccccctcccccttctctccaccaatgcttctcttctccaagtaaaatattcttagtttctacaaatatttctctttgcttgtcagctccctacttgacttgtcatcctcctctgcatagttgcaaatgtcatgtgactattagacatcccttaagagtacctctctcatcttaagcacagcattattattcagatgtgctacaatcacattgatgttgtgggtggtcacattatcttatggacttattatggatctgattttccatgaaaacctataagtatttcatgaatgatgctgacaaactgcatgtctttcattctcttcatgccaggctctgtctgactcacatgcaagacctcttcatgtatctttgttacattttatcttacattaaccccactgctacaacctctcagggtaccttgtgtcttcatgcacttattcaacatcaataaatgaaggttagttgtacacctggaatgtgtccggctaaatcgaaaatgctaattctgtggctcaattatttgacacaccattccagcaatcttctctaccactttatttcatccaccatacccaggccatattttaatcttgttttcttctcctcgaagcgactttcactaaaaaccttaaacttcaaaaccatcctatatgacagcccctgtgttcatctgaatctctaatgtctccgctctcaataaactgattagctgataagcctcataaacactttcaacttgctcctttcttttttttttttccccaggtattattattcttattttctcactctccttttaaaactggaccttgtggttgatcaagtgactaaccatattctgcaccctcaagatttattttatttttgcctttatactatcatcatttatctcatatagtcctgatgaactaccttgcctgttcttaaggtcaagctaatcagtgctatgggagaaaatcctataatggctgaaaagcatagatatgaatgaccctaaaaaagccactaaacctttctacatgttgacgttctcccgttctttacatgtgtcatcataccagttattaatccaattcacctgtagtgtcctccctatttcttcatgtaattcacaaaaataattcaaatattctgctttaccccaaaatacacatttttttgcctatatccaaaaggtcaagtaatatgcagggatagatctagctcattttcattcaaactaaaatcatatcaagaaacagttttcagtctttctatacactttttccctagaatatttgaagccgatttttttaggtaattattccaggtttccttttcatcttatttcctgcggtttcaaggtcaacatatttatcatattttcattcaaagccataacaaaaatgagtgataaacagaaaaatgattttcctgcttgacttcctgtttattctgctaaactataatctgattttacttaaaactcttccgagttacctttgtgaataattcaccaagcatgtgaaccactgcttatataacttcatgattgttataaacaccttttttatgtggcatagttcaaggctcgaaccaaaagtgagatacaggaatgaagcaaatatgtttgtcactctttctcatctcaaaatgtattggccaggccaggtacagtggctcaagcctgtaatcccagcactttgggaggccgagttgggtggatcacctgcggtcaggagttttatatcagcctggccaacatggtgaaaccttgtcactactaaaaatacaaaaattaggaccaggcgcagtggctcatgcctgtagtcccagcactttgggaggccgaggagggcagatcacctgaggttgggagttcgagaccagcctgaccaacatggagaaacaccatctctactaaaaatacaaaattatctgggcatggtgaggcatgcctgtaatcccagctactctggaggctgaggcaggagaatcgcttgaacctgggaggcggaggttgcagtgaactgaaatcgcaccatcgcactccagcctaggcaacaagagtgaaactccatctcaaaataaaatgaaataaaaaatacaaaaattagccgggcgtggtgttggtcacctgtagttccagctactcgggaggctgagccaggagaatcgcttgaacccaggaggcagaggttgcagtgcgtaagatcacaccactgcactccagcctgggcgatagagtaagaccctgtctcaaattaaaaaaataaataaataaataaataaaatattggccagtcaggtttttttctgcttcaagaccccagatatcactcaacccctggcccagtgtctcacacaagtcataagtaggccctgtgaaaaccctcactctcttaaacagtgacttagggtcacgtgtttaaaagaaaattagttataaaatcacccaagcccctcattttcaagactgtgtaaaatataggcacatccaaatcccttggcaatttagtgacaaacctgaaatctgactccagttttttacctaaaccagtgcttactctggattatatcaaaagaaaacactgaggaacacacatgtggattctcagtgaagtgataatgccttttaatagctagatctcttgaagaagtaacaatttgttctgtaattattgatttaaagctgaagcttttgatgactagatggtttgttcctttcttcttctcttcctccttgtaaatatattcattttatcacttacacaagacaaatatgtgtcacaaacggacagtcatataatttttgtttgaaaaacctcatgaggatgggtgccctctagatagccaatttccattcttttcattctaatgttaatgatgttatttaaagttattggatacacagcatcaaatgtcattatttcaaatgacttcatgacacagggttcattgtgtaaggaatatcaagtagaggttctcaggtgttgtccctttaaaatgcaaggggagaaatgcaattgctattttttatttagttacctaatgcctgcccatcatgtctttttgaatttggcccaataacttataattaaaagactcattatccctgctggatgtgggcacaaattcacattatttccatggaagcctgtctgctgtctcactttaatgaaaatttaaaccctttagaatgacatgtgatgcttggaattatttatcttttgtctgagtagagttacaagaagaaagaactcctagaaaaataagtcactatttctttctgcagattcttgtcttccaagtaagcattcttttttgtttgtttctggaaagattgacagagaaaactatgaaagtatcagttagagcagaaaaaaattatggactctcccacctgtgcacttttgacctggtatttggctatcttttgtacatgtagtaaaatatacataacacaacatttaccatttcaactgtttttaagtgtacaattcattgacgttaagtatattcatagttttgtaaccatcaacatcatccatctccagaactttttcatcatctcaaacagaaactctacacctctttaacaatacatcgccgttcccctcttccctaagaaactggtaaccactattctactttctgtctctgaatttgcctattccaagcacttcaaacaaatggaattacacaatatttgtcctttggtgtctggcttattttgacatgtttctgagatccatgcatggtatttaatattatggtaaattttttgttaagtataattccattgaatggatacaccaaagcatctttgatgaatattggattgtttccatttcaaggatattacagataaaactgctgccacactgttggaaaaggctttactggacataaactttgtctcgtgtagatatttagaagtaaaactactgaatcagaatttagatgtatgtcttacttaattagaaataattttcctaaatgattataacattttgtattcgcaacagaggtatatggaaattccagttgtccaatcccaaccaacacatggaatttgttgacatcttaattttagcaaatctaataggtatacagttacatcaccttgtggctttaatttgtatttctctaataactaaaagtgttgaatattttttcatatatttgaccatttgaagattcttttttgcacattactttaggttgaattgttaatcttctaaattatcaatgtgtagaaattctttacacattttaggaaaacattttaattatattttggtattgttaacattttctacaaattggaggcttacctctgtaagttggaggctttggtattgttagtattttatacaaattggcggcttacctttttacttttttaatgctgtcttttgatgagcagatgctgtttttattttgttaaagtcagagttattgattttgaccttttatgatctacttaagaaagttttgtttaccccaaggtataaagatattcttctatgttttactagcttttacatttaggtctgtgatacaccttgaattaatttttgtgtatagattaaggaaggggccaaggttatttatataggtatccagttttgtcggcaccatttattaaaagagttctctttcctcattgaattatttagtgcctttcttgaaaacagttgaccatatatgtatgcacatttgtgtctatttctggatcttattctgttccattgatctatttgtttatccctatggtagtaccatgtggtcttatttgctatatctttatagctcatcttgaaatcaagcagtattaagtactctaatatggttcttttttttccaaaatggaatgtaactatttatatatgtttaaaaccgttactctccacaaatatatatatattatatattctactgagagtacagatctttatatatatgatcattatatgtatgatgagatcattatatgtatgatctggacacccagtagaatctagctcattagattgtccttcacagttaaacaatgcaaagcctatagaagaacattatgctaaatatgtgggtgtgtgggtgactgagataaaatagaaaaaaaggctaaatgtttttggggtacctgctatctgccagtattctgcaaagtgttttatatatcttggcatatttgaatttaattttcacaaaaattctgtgaagtagttattgtctccattagtggatgaacaaagtaagggttagagaagtaatttgttcaaaatatttaactcgaattcctttcatctttgatggtcacagccaatcagtagtcatattgagtgctcatgcagggtgcctgctttgtggttgacagctggattttcagctagtgacaggtttgctatattaacctagtcagttgtcacactgactaaacatacaatttagagcgtagttttaataattctgtgacaactcagtataccttccataaaaaaatgcatctaaaagtacattatttataagtgagttcttgtgaaagaaatcaaattataattcccattgttttacaaaatcattattgagtatacaaagttaaataaaaataacatttatttcatcaaaaaatgtctgacaaaccgagctgctggcattaagcattactagttgtgaaattatgtgttagtcacaaaatcaatttaaataaacaactagattatcatcttgccacccctgaaaacaaagaccttagcacagaatcagatttaatcttcaaatctattacttaccaagaaaacctaagaacacaatttgtttgaaacctttaaacctattactttctaaaagaatctcatggagcactgtgcttgaccttcacaggataaactttgtagatgtcaggggttcaaagcaatttgtttcttatattccttgaatttatctactatatgttgctgattatttccttcatgacagctgtttttacttatgacacacagaaatgcattacattttggagaattgcacttgattctactcttccaatagatattctaatttattatctgatacgtagtgttgggttctaggtgaatcatgactcctagaattattcaatgtgaacactttattgatgatagatgttacattaacatatggtagttgtgttccataagactgtaactattttagaaatatgttcacaatgagacattaatcttttagttatgcatattaatccttataaagttttatgatatacacagaattgaaatatttccattttcatttaagatgaagaaacaaagaatcagagatattgatatttgtccaagcactcacacatttcaggggtccctttttcttataagctttttgtgtccaagctcttataagccttatgtgtccaagctctcacacatttcaggggtccctttacttagaagccttataatactagtaaacactgaaaatgtaaagatatatgagaagtatgagaagtatcattgcaactaaggaactcagagcctagaggactgagacaagcagccaaacatgtaaaagtgaaattgaaaaatgctgtcatacaggtatactaagaggagaggagaacctcattgtatgggtaaattttcctacataaagtgaacccagagcaatcagacagctaatatttattgaaaggaacaatgtctgttatgtgtcatgtaaattagccatacctagtattatttaaccttcacaaaactccagcaaactatcgcaaggacaaaaaaccaaacatcgcatgttctcactcataggtgggaattgagcaatgagaacacctggacacaggaagggggacatcacacaccggggcctgttgtggagtggggggaggggggagggatagcattaggagatatacctaatgtaagtgacgaattaatgggtgcagcacaccaacatggcacgtgtatacatatgtaactaacctgcacgttgtgcacatgtaccctagaacttaaaatataataataataaaaataaataaataaaaaataaaaatgaaaaaaaaaaaactccagcaaagtccattactgttctccattttatagttacagaaactggagggaagaaaaacctaaagaatagaaaagatgaaataaccctttatggttcctcccaggtagatcattttggggtttttcaaaccacagagtcactgcaccatgagttacttcagttttcttccttgtttccagttaatcatattctctgctctaagctctttagtgatagctcatgtcacaaaaggccaggatgagagatgatggttgtgctgataggtgagtgaattcacggagcagagacagaaatgagggagaacgcacccagagaaaggtgcacaggggcttacatcactgggccctttgattggtgtttttgacatgaacacaaagaaaaatatttgaaaatgtcaaacaaaacctcactgattttctaccttgagtagaagaattcaaatgttttgaatgcttaatatttgatcccaggaatcagagaattgtgggaaaagacctccaatttttcttggtttcaattcaagggtgttcaaaatgatatacagtattttacatggcctattcaaaaaattattttattttgaataaccaagggctgataatataattcatgccttttatcttagcatgtaaaagtgctacataagtagaatggtagcataatacacattttaatcagaacaagggcagagcaacgaaggcaatgctttttatttttgttagaggagaatggtgagaaaatataaaaaaacatttagacattcaaaattctagttctagagttaaaaaaaaaaaaaaaaaaaaaaaacaacaaaacactttttccccaatgtgtaatatgcaatcaaaagcactcatgcctctactgttttccagaagaataaatatgaaagttataattactatgaaagttataattacttttatattagactagatttttttctggagatgtttttaaaaggggaagaaaaatcagataaacttatagacatgctcatatttaaaaataaatgaaaaagccacaaaaacagtcaatagcaagcttccatctttactccttacactgaatattttcccatttctgaggctgcctcaattcatcttatgtcttatcaagaattgtgggatcaacaatcatctctgtgattgtcatagttacaataaattttatatatgaaaagcagaggaataaaagctaccaatcctgggtttaccactggaaggatcagaaggagctgtcccctgttatccaggtaggaatatttgtagacaatgtattaaaaagtgatcttcaaggcataaaaggtcttggtgtcagactcaatattaagtccctcttttcatttgcttgactttttatagctaattaacaatctagccattgtttcccttatctgtaaaatgagactaatactaggttccaactctcatgagattgtcgttgggactaaataagataatgcctctaaatgcacagcacctagaagaggttgtcattatcatttttatcatttaatatttccatttttctctgaggctatggctacactcacaaactggcttgtcagattctatttttaaaaagattgcatttagttgatccatttttcagatatttgtaatagttacagataacattttcacttttagagagtcttgttgtactgtttgcatattgtttaaatgcatagaagtattgttagggcactagcctatgctcttggtgcagaagagccactgaaatgtgctggggagttggaaagtcctcagcaatattacttaccttcttggtaaccgagatctttgagcttctgaaaggaccttagttcccataaacaatttgaccctgaggctgggaagtaatgttattccaggagaatggatgagagtgatcaaaggcagagagatgaggaggtgtaaggtgaagtctaaaggtggggcttgagaaggtggcttggtatcttaaatttgtgactgtcaagggctaggctaagctggagaaatctgatctgcttcaggtcagagtagccattagctgatcaagaaaacaagccgagatgaaagtgacagtcaagcctttaatcactgaactgcaattgtacaaggaagaggttaaccagagaacacacccattctccccagtcctgctttcccccacggagcagcacctgtggagggtcaagtggaccaacatagacaaggggttgtctccctgatgagggagctctgaaccaaagcttcccgcagtttcatggtccctggggctggagaggtggagaggaaagagctaagaatgggaaattactgcacactgagagtggagaaaagtgtcttcaaggttttcttctgcttccgccataaagagaaccaggcagaggtacctctgcttgaaggcccagacaaagaacctctgaatgatggtgcctgggctggaaatacagatgtgcataagagcatggccagccagggcgaatgagtccttgcctgcaacttcctttggaggttgcagtggctgcgcactaagtctggtatggggaaggcaggttccctctgtgtgatctgccaggcaaagcctttttgactgaccatggccaggtctggaaaatcacacatggagttttagctagaagccagactcctcaatagaaggtagtcctatagatctccagtaatagtattcaatcaggcaaagaggaagtcaaattgtccctgtttgcagatgacatgattttatatttagaaaaccccatagtctcagctcaaaatctccttaagaagaggacttcttaaagcatgcgcagtctttttaaaaagttttcctgcttctctttagttgcaacaaaatttttcaaacagggaagaaatggtgggcttgtagtaaagaacaaacaggaagactgagtcttaatcaatcactggtaacaaagggaaactacagcagctgcaaatttcaagggaagacaagtgtgttaaaacatttgatttagaaagtaaaggagagctaattggctagtgtagacctgtaaacaacctacaaaaagacctatatgcttaatgatataagtttccaatgggacagccaggaagatattactttgtagttgttctaatttgcatttaggactaaatgaattggcatacataaaacacctaacacattatctgaaacatagtatttgttcaatcgatatctgctccattttcccaagtaagttgaagagggggtaaatatacaaaatgacctactcagtgactatatattagatacctactactgtaagctttcttcatgataaggtaaggccattgcctgtaaagagtatttattcttattggggacatagaaaatgaaatttaaccctatcatgatagtatctaagaaccaaataaatgcaagaaagtaataggataccactgtcaatgacaacctgttgttggcattaagagtttacacatctctacaaaatatgctggacaggcctgatacacaccatgggtcagttttccaaaaaaaatgtgccagtatcacattatccaatctttcacatactttttataggcactgaataaaagtatccttatcctccctaggggataaaggtgtccagacctatgatgacaagtaggtgtgtgtgtgtgtgtgtgtgtgtgtgtgtgtttgtgcatctggccagtgaacttgcagggtgcaagctctcacttgtcagtgctcattttgagatatggcagtaccataagtggtaggtgagaggaccccaaagctataaaagttgtctgattatgattcaagaaggaacatttttaacatgttgaactgatgtgactcaaagctgtgagcatttctggattgaaaagaaaagcagaatgatgagaaaacagtcctattttggtttatgtggcatagatgctggcaaggaaggaaatgtcgcttgagctatcaaggagtcgggtcctcattaggagtgtgaagacaacatctgactgtattgtggattttctgggggaagaaagtaaacacctctttcttaaagaagaagaatcatgtagcacagctgggaagacacttcaaaagtgaccattgagaaacatatcaatccaaaccctgagagttcaggaaggaattggtgcttggctgctgtctttagcaatcacgttttaaggatctccttgtgccagacattgaaaatcatttcaaaggcttaccaaggagacaagtattattctctaacccaccagaggctaacaaatgagatgaggcagggactagttgcctctttgtttctgaactgttcacagtagcttccatattagtttaatcaaaggatgtaaacttggcaaactcagagtgctctctgggaagaagaataatttgctggcagattatgtggtttaagaagctgcaaggaaacttaatgctgctgaacgcttggaaactatcatcaggattcaggctctacctctgagattatcatggagtattaacgacataatgtttgtatacaaaacagggtcactcaactgaagtgaagggttaagaacaacagatctgactccccgattcagctgattcctctgaagaaatggaaacataaaagtcttctctttctttttattaaatattttataaactcaacacacaaatcttctcgttagccaaaaaagcaagcttatgaactgtcctcagaatttaacttgacaaatgcaatgccctaaaattctaagcaatcatcaaaagcagcagataggttcccagatgattatgaaaaatatgagtttgcttctgcataatatacacagttttgtatcattagatatcaggctattatactgcagcagatgtaaccagatgtgacggatttttcaattcactttctcttgtcacactgagtttttttctttccaccatggaaaactgaatgttcttcactggaagtttgatactttattatcttaatttcattttataaatctgaaaaatatttccctttaaaatagggatcacctacagaagggatgatgctctacttccagtatgttattgcatggacttacagttaaaaaccagtgatggggttccttttaccaagtagctccatgcaatcctcaggataattttataggatttgaaccaagtgtcctagtacagatatgttttggtgatctattgttatggaacataccaccttaaaacttagtggcttaaaacaataacttattatcacttgtgattttgtgtgttgactgggttcagctgtgtggttcttctgctttatgtgacataagcaaagtctatatctagggatttgacttgactgaagaatacaagatgacttacttgcattgttggcagctgatgttggctttgtcgggaactcatttgggactgttcacttatgtgcctcttatctccacgtggcctctccttgaggcttggacttctcacaatatggcagctggatttcaagagggagtgcaccaagtggaatgggattacacaaagctatggttcattggggtccctttgtagaggctagaagtcacaatttggaatctggtttacatattcctaatttatctttaccccagaatcacagtgtgtgatactgtctatgagatacccaaatttagattgcctatactatattaagtcattcatcctgcctttaggggataaaagcaatatatcctatcattttaaatgattaaacattttaatattctcaatctaaatgtgaattagcatcagtggtggcttagttacttgtgatctttaaattttctcacttctgtctgaacctcagtttcatgagaaaatgtaattagagtcatatatttggatgccagaaataccatcttactatagtccatgctagaagaaatctaagaattcacctaattcaccccctatatttttgcagaaaagaagctgaaacctgtgaagttatgatttgttcaaatcttccttccccatttcaatcagagctgcttctctgtcatctgctttatatattgtgactcaggtataattttatttggaatctaagtccgataaaataaagtttgagaaagaagcagcatagttagtggttaaaagcacagactatgaagacagactaccttaggctgtgttctgtatgctctgtgcctcagtttactcatttgttatgtgtggaaaagtaacatcacctgccctacagagtttttatgtgtatccatgagcttatgttggtaatgtacttggaactgtttctagcatatgaatagaattatgtaagcactggtgaaataaatacatttccttgaagtaatgagagatgcagaaaaacatcagatatgtcggtttacagttcaaattcaggccctaggagtataatgtttctcctttcgatggtatatttttaggcatggagtcagtctccttaagcaagtctaatacagatatctaatatagatttaatagcaaaagatttaacagtaatccttgtgtatcagttagaataccttagactggaaagaacaaaaatctcaacagtcttaagcaataaggagtatcttattttctatctctatgcaaacgtcaaggtcacagtcataccttgagttttacttgtcaggctttcgtagtttagtttatattttcttcatcctgactccctggctacctcaggttgtaagcctctcagagtgactccaggagttggctgagcattttggataccttcacaggtctgcctgggtgtcagctgtcatgctttctcaggttcctacctaacaccatgtctgctactcagagcacacttacggtattgaatagttctccctgagacttgcaatcatcatgacgtttacccagggatgaaagcataggtcccctcatttctcagatttctccttaaccttttggatttctgttactggccactactgttcttagaatcagtcaggaggccaggctttagcacccttctttgagattcattaaaatctaatctatttatatttcagctgaggcaaattttattctcaagcaggggtttcctggctatttactcactttctttcaaatgtaatatttatagccctaactattaactggcttcctaggatttcatcttttacatattaaaatattcagctatcttgtgtgtatgtgggaggaggttgtcagaacatcactacttggatctgagaaagggtcaggcaacaaggaaatgcaatgataaatatctcagctcatatttctttattttatctggactaatgcagtcacttagtgaagaaaaaaaaaacaggtgaattaaaagtaaaaatatatatatttaaataaaccagtacaacaccatagacaatgttgcctcatgggcatttattattaactcaaatatttatgcagaactgctatgagaattcagaatgtatttcaaggccaagttggtcaagaacagtttcccaaagcaggatttttatataggtcatgaataatgactataagttgcatgggaatggagagtagaattgcatggtatgtttttagtagtagaatagccgaattagttacataaagcctgagtattataaagtgcgtttgaacagtagcagatggaacagttgcctggagttgggaattcatggaaataagtccaagctagggctctaaatgcagttagaaaagaagatgaactttagtatagcctataaatgatggttgggtttcatataaggtggtgggaaccaaggaacttgagtgttctaagtaaaggaaacattggagatctagtcaaagaaatgggagcatctgggaagactcagagaatagagcattacacttctactgaagtaaaggctacatggcagagtatcatgagccatgaaactatacacacagtttggacttggaagaggacaaccttagattacttaaaaattggacattgtcatatgttatttttaagaatgaaacctagaagtggctttttcttctgcccacattcaattggccaaaatacggtgagattcttcttgatcctaagtctaaggaagctgagaaatatgacccccttgagtgtccagaaagaagacaccgtgtggtgagtaatattgtttagacatcccataaaatgttgtatttaaaatttggtgcaaaggtggctatttccaggaaaattatatgtgcttataaatagtgaagattatttttacaaaccgacattaaactcctctactttcatagcttactcttacgaataggaaagagcataggagagtctctagcacaatacaggctttgacaattaaagagaaaaataatgtcatggttgctaatactttgtttatttgtttagagtgtagcaggagtcacataaagatgtagattgatttaatgtagctattaaacgtattaaatacatttttatagatgttaatttttaaaattcttactgtttgaagttaaccatttgccaaatgatttaatgcacactcttgagtgtgggcttttgagaccactcttgcttggaaactagtctatttggtttggttacccttagaagttgaagcttcctttaaagtctattgaacttcagaaaattctttttattttcaacagagccacagaattcttttcctgtctttagccctaagtctaagtgctttaatatccgtgtggacatcccatccaatactctagtttcataatttcttgactttctcaagtcccatgacctttcagccatacatgtcaacccattaactgctccatgtctgatctctttgaatcccttggtttagcagaatgtcaggaatgttcaggaatagatgctcaataaatgtttactggattaataaatgggttaatgttgggtgttccataaatacagaataaatatatatgaactgtttgttgactaacagccatcctgctcttgtctttcctaacagcagctctattttgatcatttatctatctcttcccccatctctttatgtatatgttggaagatggtgacccgacctgaacattcagagatgggcccagattaatttatgacaattctggaaatcctaaacctttgtcagtgattacccccagaatggtcctgtgggcatactgtggccaatgagacttaaggaaaggattactagagggtcctaggaaagttcttccccatttttagagggtagcaatggaaaaccactttcactctctcccactggaagtgatcaagaacacatcttgtccttcttcccaactggtagtagctaatttgtgatcatgaagaaggccagattgaggacaatccttctccataggagataaccaagcctggaaaatagcgaagaacgaaagccagagctggctcctgtcatgtgtgacattcccctgccacacctctgcaattccagttcattcagccaattaaacactttgttttttaatgccagtttcaataaagttgctaatatgtaatatcaaaagcaccatcctgatacaaaatctctagccagagaaattggatgatggctttaaaataagaaagtaaaatcatctattcccttattatcccccaaggattgacaatattctttctcgtcagtacataaacacaaaaattgttttaaatgcaaatatctaaataattcaattacattggcaactatgtattttagggggaatttttgtttggcatttaagaacaaataatatatttgcctgaaagttccaattttaccttatgtggatggaaaatcaggatgactgctctggttctgtttggcaccttctagagttagtctgtattcctttcacatgaaaaatgtcagcatagaaattttactgctttcctgctgagtttaacttgctttaggacagctggatcaggctaggcatgaacgtgtaatgtggattcccatagtttttaatgagctttaggaatttacacagtttgcagagttggttcactacattgtcaattttgttacatcatttagtaaaagtatgtgttttttttatttgaacaaacaaatattatagctatcttctagcaaacaaaaataaattgccaatgtatgtgttgtaccccaaagtgacctaggtgggtaccattctaagagaagtctcaggctaaatattgatggaagaggttccatctagtcacgtgtttttgacatttttacaattagggttttatgacagatcaagggctatgtctacgacctcggggtagtagaagtctatttcatgaaaaaaatagggattaaaacatatgtgtaaaattgatgaagataaagtagatattattgccctggaaatgtggggtagaattaattactcatttgttgtaccaaatttgattctgaactgcctaccatctaagacaaaaataaacagtgaattacatacttttccttgtctatggaataataggaggcgtaacagtagaaagaaatgtgttccctaagaaccacattttaaaaaacaatattatattgttagatttctttcttggaaaattttagccaaaatgcaaccatgtggttgtatatagtcagcacttatttcaaccttcaataaaagttaatggcatcatgattaattgtaaatctctgaagacatttataaggaagctaatgtaatgccttccaggtatgttgctctcttataatcagatttttacagtcataaaatcaagttggatttttaatcacagaatactctgctcaaatttaattggattttggataggagtgaagacagaatttgaaaataaggctcttcgtgaagatctgaagttcagatactctatgatgttgaaaagacattaatacatcttaaaaatcagactcttgatgcaattctgcccttaagagagaactgttccgtttttttaaaatggggtggagttgaatttccctcaagaagtagctttaagacatactgatgatcaggttaagtggcttctattactataatttcttaaaggtgaaatattcactatatagattctgtactccacacgggaaattataaagttttaccatgaaagcttccatttcagattaaaaactaatttaaaaaaatgagagattttagtttatttcagttttcttttttaatcaagataaatgactgcaccctgaattgtgcttggggttgcagctctactgtagtttcactctaggacaagtgacttggcaatcagctgtctctaaggaatctgactttctttactatacctagggtccctctgccttgtttcactctgatctggtgtctgcccagctcccagacctacaggcaatatctgcccctagtctcctcccctttcttccacaggcttctggaagatacatccttcctagtgtccttcctctcctgtgttccatctcctacagatttctcaggggtctcactctgattgtctttcctctcttatatctttaactgcccactcagtggcttttttctcattttcactggactgtaatcaactgtctaccatattaacaaaaagttgctttaactgcttactctctgttctttccttcatagcaatatttttgaaaatgttacccatgttcaggatctccacttccgttatctcccttgattcctgaaaccctactatctggcttctgctgcatcattttcctaaacctgttctcatcgaggtcatccgtgacctctatgctgttctttccgaacagatgagccttgttgtgcatggtttaccattcccttttcctggaatgagtttctatatttggcttcttgtccttctctccatctgtcttgcatcacctttgtggcctccctttctcttatagttcccttaaatggagactccttcgtctcttacaccatcatctctagtcttattccctgatctgattattagaatctatcatcggctccccccaacccctgctttctgacagatgttgttaaagcacctctgtgattctgtctgttcaccgcttaaaaattcaccatgatttcctaatgcttacaaacagcctcatcttatcctggcaaggtaacattttccataatcttgttttcctactgtacaatatctgtcttttgttttgaacgtaccttcttacctattccacattggactccgctcacttttgtatttctttatctttaaattagaattaagccatttaaatggaaatgagcattgtgttatgtcctatggatataactaacaataacacaaatatgatttgtgcatttatatgctaaataatcaagaacttgtcaaatcatacctgtaactcaaacctcagctcaaatggagtcttcttacatttatctaattctaatcttttcatttagaataagtatggattctctttgaaatcacatactcttttttgggttttttaaaaagttacatacagcactatcaaattgcgtgtgtgagtgtgtgtgtgcatgcaagtagacactgtaccacataggtataggaatggccaataataagaagaatagatgctgaatatcattagtggttagagaaatgtgctcattgatgaagcaccatatcccaccatcattcatgacttgtcatcttcagtatattgaattaggtgaataaatgcatcctcccatgttttcacttccgtatattgtccttacccctggatatcacaaaacactgactatttccagggtgttgccactacctttttctgctgaggtctcttcatttcaccccactgggctggatctagaataatcccaggaagatgttctctggcatggtctgatcctccacaatatgtatgtatccatgtatgtttcctatatttttaacataaaatcaatcaagataggatctaagaaaattttgtcagatttaagtcaaatgattttgtctaataaaaacatcaattacgctgcttcacactcttatactctgtatttgaccttcatttgttgcaagaaaccccttgaaatactatgtcatttaggtgtttatgtattttgcatgtgctcatttacatactgcataggattttagacgatctacaatacagagacagaataaaatagaaataaagtattacaccacaataaaaatagagttaagaaaaagaatgaccccaaagaaagactgagacttaatcactctgggggtttaggtggttcatgtgacagtatgttgacagaaaaatagttgtcaaattgggtttcataaaaatatcttaaatttaatacttattaccaaaacaacacatttattttcaaaccccaaaaggcaatttaagaatttctagttagtgcaatctaaagaagattcaaacattccatgagaaataatgaaattgtgctagaccaagcaatagcaacaatgaggtgtgaaccatcaccaagcatctttcttgttactactctatgctcagaactaggagaagggctgttcaagattaagggagaagtggaaggcactgagttcaagatgttgacttgtctatctggagagcggagcacataaaagacccaattattgatcaaaacagaacagactaaagccctaagttgggttaaatgagcaatttggaaaaaaatgtttattttcaaaacaatttatggagatagtttgcatttgtataatatattttgactgcatccaatgctgtaattttgctttaacaaaataagtttagaaaactaaaggatagaattataacatgcttctccaaagtcacatagctaatgatataataggattagcacttatatttcctgactcctgataaattactcattttattcatgtaccattttcgtattaatcaaaaatatcattgtatgtcagaatataacatatagatacataaataaatatgaaaaaaatgagcttaattcaaccacagatgtaaatgatccaaaccgagacagtcagtaggatccggaatattttgaaaatctaacaacacagcactctttcttttatatatttctttgtgttgttgaagtttccgtccaccccctcttcctatactaatggtgaatatttattaaaagcttattttatgccaaccatgattttaagcatttcataagtattattttacttaatactgaaaaatccctatggggtagaagttgttattatctccattttgcagatgaggaacaggataggacatgattaaataacttgtccaaggccactcaagtattaaatattagaatcacagcttcaattaaaggtgattctgaatgtcctcttaggttgaaaatgtctaactctaaaacaagtggcgtaccgcctcaaataatgtatagaccagtttggtctcattataacaatactctttattaatattgcccttctctaagcagttgaaaatactctgaaaaaaaatcactaattaactattctgtcaattatgtcatattgtttctatttttaaatggaaaacaacatgagctttctcaaagccagcttggtagcagtttcaggaagaaaatgtggatcaaatttcttagactaagacacctctcatacagacttaaggagttagattgaaactaattataaatccatgacatttttatttaccttagtataagaaatcatcccttcctccactcccagccatgcatgctattctacatgactaatgagttaatttgagaactgatgcttcatctggaacaggtgatgaagggtatataggaatcagtgttagatggcaggtgtctaaacaatgcctgattaaatgaagtgtgttttccctccaatgtattagcataaagtgtcatatagcctcagaagtcaaaaacatcaggagagttgtaaaagctaatgagccaagggatgtttccagggttctgccattgtaaaaaagaatgattatttaatgtgtgtggggacaaccatatttatttttgtatcaagcaaatatcctcactcttagcgtaaataaaaagtcatctgagcaacagggctccaagctgccatggttctttgctctgaaatgataactttttcctggaaaggtagggaatccactcagcacacttgaaagaagataatgggtttcagattcgcctattactaaagtggtcatgaatacctgggtggggtctgcctctgggatggtatcaaccccaatttgtactggacttctttagctagttttcttcagaaaggtagatcccagagctatcagcacccagagctatcagcacctgaatcaccattaaaatgcaaattcagggcccacttcagtcccattgaatccctctttcaaagtataaagatgaaatctacattcctgggaatacttgtccttcttccctattcctaactggttcttaatcaggggtgtgacactctataaaaatatacatgccaagcccatcacacccagttctattcccatgcaggatcctagggaaagtttattagcaggtgcatttaaaataattctctagtgattattctgaatgtcccctttcgttcagaattgtcctggatcttattaaacaagtggtcttaaacctcactcagggtgagatggaatcatgcgtaggtataagcattatttgtgagattattaatgctgtgcatccatcagcaatatttctatgaaacatagtaatattgttgcaataagagaaagcatataacatatcctaatttaacacaccttagggactacatataggacaggcatttccccctaaattggaagactttagagccctgccctattctagtctagcccagttgttcaggtaactgcaggttgacccactcctctattggaaacaatgagtcagctattatgtccacgtctgaaagtgctttcctgttgacacccaagatattcccagggatcagctgggaagcattcacttctagcttcctgggtattcctatcagaatcccaggcctttcgggcccttctgtccacttgtcttggatatgtggggaggttttttgtttttttttctattattattatactttaagttttagggtacatgtgcacaacatgcaggtttgttacatatgtatacatgtaccatgttggtgtgctgcacccattaactcttcatttaacattaggtatatctcctaatgctatccctcccccctccccccaccccacaacaggccatggtgtgtgatgttccccttcctgtgtccatgtgtcctcattgttcacttcccacctatcagtgagaacatgtggtgtttggttttttgtcttgcgatagtttgcttagaatgatggtttccagcttcatccatgtccctacaaaggacatgaactcatccttttttatggctacatagtattccatggtgtatatgtgccacattttcttaatccagtctatcatggttggacatttggattggttccaagtctttgctattgggaatagtgccgcagtaaacatacatgtgcatgtctttatagcagcatgttttatattcctttgggtatatacccagtaacgggatggctgagtcaaatggtatttctagttctagatccctgaggaatcgccacaccaacttccaaaatggttgaactagtttacagttccaccaacagtgtaaaactgttcctatttctccacatcctctccagcacctgttgtttcctgactttttaatgatcaccattctaactggtgtgagatggtatctcattgtggttttgatttgcatttgcctgatagccagtgatgatgagcattttttcatgtgtcttttggctgaataaatgtcttcttttgagaagtgtctgttcatgtccttcacccactttttgatggggttgtttgtttttttcttgtaaatttgtttgagttcattgtagattctggatattagccctttgtcagatgagtagattgcaaaaattttcttccattctgtaggttgcctgttcactctgatggtagtttcttttgctgtgcagaagctctttagtttaattagatcccatttgtcaattttggcttttgttgccattgcttttggtgttttagacatgaagtccttgcccgtgcctatgccccgaatggcattgcctaggttttcttcagggtttttatggttttaggtctaacatgtaggtctttaatccatcttgaattaatttttgtataaggtgtaaggaagggatccagtttcagctttctacatatggccagccagttttcccagcaccatttattaaatagggaatcctttcctgatttcttgtttttgtcaggtttgtcaaagatcagatggttgtaatatgcggcattatttctgagggctctgttctgttccattggtctatatctctgttttggtaccagtaccatgctgttttggttactgtagccttgtagtatagtttgaagtcaggtagcatgatgcctccagctttgttcttttggcttaggattgacttggcaatgcggactcttttttggttccatactaactttaaagtaggttttcccaattctgtgaagaaagtcattggtagcttgatggagatggcattgaatctataaattaccttgggcagtatggccatttttacaatattgattcttcctacccatgagcatggaatgttcttccatttgtttgtatcctctttgatttcattgagcagtgttttgtagttctccttgaagaggtccttcacatcccttgtaagttgtattcctaggtattttattctctttgaagcaattgtgaatgggaattcactcatgatttggctctctgtttgtctgttattggtgtataagaatgcttgtgattttttcacattgattttgtatcctgagactttgctgaagttgcctattagcttaaggagattttgggctgagacaatggggttttctagatgtacaatcatgtcatctgcaaacagggacaattggacttcctcttttcctaattgaataccttttatttccttctcctgcctgattgccctggccagaacttccaacactatgttgaataggagtggtgagagagggcatccgtgtcttgtgccagttttcaaagggaatgcttccagtttttgcccattcagtatgatattggctgtgggtttgtcatagatagctctgattattttgagatacatcccatcaataactaatttattgagaatttttagcatgaaagttgttgaattttgtcaaaggccttttctgcatctattgagataatcatatggtttttgtcattggttctgattatatgctggattatgtttattgatttgcgtgtgttgaaccagccttgcatcccagggatgaagcccacttgatcatagtggataagctttttgatgtgctgctggatttggtttgccagtattttattgaggatttttgcagatgttcatcagggatattggtctagaattctcttttttttgttgtgtctctgccaggctttggtatcaggatgatgctggcctcataaaatgagttagggaggattccctctttttctattgattggaataatttcagaaggaatggtaccagctcctccttgtacctctggtagaatttggctgtgaatccatctggtcctggactttttttggttggtaagctattaattgttgcctcaatttcagagcctgttattggtcttttcagagattcaacttcttcctggtttagtcttgggagggcgtatgtgtggaggcatttatccatttcttctagattttctagtttatttgtgtagaggtctttatagtattctctgatggtagcttgtatttctgtgggatcggtggtgatatcccttttatcattttttcttgcatgtatttgattcttctctgttttcttctttattagtcttgttagcggtctgtcaattttgtagatcttttcaaaaaaccagctcctggaatcattgattttttgaagggttttttgtgtctctatttccttcagttctgctctgatcttagttatttcttgccttctgctagcttttgaatgtgtttgctcttgcttttctagttcttttaattgtgatgttagggtgtcaattttagatattttctgctttctctggtgggcatttagtgctacaaatttccctctacacactgcttttaatgtgtccctgagattctgatatgttgtatctttgttctcgttggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagttctttacttccaactatgtggtcagttttggaataggtgtggtgttgtgctgaaaagaatgtatattctgttgatttggggtacggagttctgtagatgtctattaggtccacttggtgcagagctgagtttagttcctggatatcctttttaactttctgtctctttgatctatctaatgttgacagtggggtgttaaagtctcccattattgtatgggagtctaagtctctttgtaggtcactgaggacttgctttatgaatctgggtgctcctgtattgggtgcatatatgtttaggttagttagctcttcttgttgaattgatccctttaccattatgtaatggccttctgtgtctcttttgatctttgttggtttaaagtctgttttatcagagactaggattgcaacccctgccttttttttgttttccatttgcttggtagatcttcctccatccctttattttgagcctgtgtgtgtctctgcacatgagatgggtttcctgaatacagcatactgatgggtcttgactctttatccaatttgccagtctgtgtcttttaattggagcatttagcccatttacatttaaggttaatattgttatgtgtgaatttgatcctgtcattatgatgttagctggttattttgctcattagttgatgccgtttcttcctaaccttgatggtctttacaatttgggatgtttttgcagtgtctggtaccagttgttcctttccatgtttagtgcttccttcaggagctcttttagggcaggcctggtagtgacaaaatctctcagcatttgcttgtctgtaaagtattttatttctccttcacttctgaagcttagtttggctggatatgaaattctgggttgaaaattcttttctttaagaatgttgaatattggcccccactctcttctggcttgtagagtttctgccaagagatctgctgttagtctaatgggcttccctttgtgggtaacctgacctttctctgtggctgcccttaacattttttccttcatttcaactttggtgaatctgacaattaagtgtcttggagttgctcctctggaggagtatctttgtggtgttctctgtatttcatgaatttgaatattggcctgccttggtagattggggaagttctcctggataatatcctgcagtatgttttccaacttggttccattctccctgtcactttcaggtacaccaatcagaagtagatttggtcttttcacatagtcccatatttcttggaggctttgttctttttcttttttctctaaacttctcttctcacttcatttcattcatttgatcttccatcactgataccctttcttccagttgagcaaattggctactgaggcttttgcattcgtcatgtatttctcgtgccatggttttcagctccatcaggtcctttaaggacttccctgcattggttattctagttatccatttgtctaattttttttcaaggtttttaacttctttgccatgggttcgaacttcctcctttagcttggagtagtttgatcgtctgaagccttcttctctcaacttgtcaaagtcattctccgtccagctttgtttggttgctggtgaggagctgcattcctttagaggaggagaggcgttctgatttttagagtttccagtttttctgctctgttttttccctgtctttgtggttttatctacctttggtctttgatgatggtgacgtacagatggggttttggtgtggatgtcctttctgtttgttaattttccttctaacagtcaggaccctcagctgcaggtctgttggagtttgctggaggtccactccagacactttttgcctgggtatcagcaggagaggctgcaaaatagcgaatattggtgaacagcaaatgttgctgcctgatcgttcctctggaagttttgtctcggaggagtacctggctgtgtgaggtgtcagtctgcccctactggggggtgcctcccagttaggctactcgggggtcagggacccacttgaggaggcagcctgtccattgtcagatctccagccatgtgctgggagaaccactactctcttcaaagctgtcagacagggacatttaagtctgcagagttttctgctgccttttgtttgtctatgccctgccctcagaggtggagtctacagaggcaggcaggcctccttgaactgtggtgggctccaccctgttcgagcttcagggccgctttgtttacctactcaagcctcagcaatcgtaggcacccctcccccagcctcgctgccaccttgcagtttgatatcagactgctgtgctagcaatgagcaaggttccgtgggccttggaccctccacgccaggcactggatataatctcctggtgtgccatttgctaagaccgttggaaaagtgcagtattagggtgggagtgacccgattttccaggtgccatctctcacccctttctttgactaggaaagggaattgcctgaccccttgcacttcccgggtgaggtgatgcctcgccctgctttggctcacattcagtgtgctgcacccactgtcctgcacccactgcctgacactccccagtgagatgaacccggtacctcagttggaaatgcagaaatcacccatctcctgcattgctcacactgggagctgtagactggagctgttcctattcagccatcttggctccacaccctcgtgaggacgttttgtgtcctcttctcctgcactagcatcaggggagagaaatgctgtcagtgactcagctatttggccagggctcagtttcaataaggagctgggtcatacttatgtctttcctctcctctgtcagtcagatcaccacaacttaatctgataggctcactgttcctgcttgttttgaggtgggcaggcctatgcatacctgtctccaaagtctgtgaaagctgagaagccaaagagagtggctatcacgccattctcctgcctcagcctctccgagtagctgggactacaggtgcctgccatcatacccggctaattttttgtatttttagtagagatggggtttcaccatggtcttgatctcctgaccttgtgatccacctgccttggcctcccaaagtgctgggattacaagcgtgagccactgcgaccggccatttatgaataccttcgtggggtctgcctctgggatggtatcacccccaattagtactggacttctttagctagtcttcttcagaaaggtagatcccagagctatcagcacctgggaacgtttctcagaagaaatgtttaatagggacttaccaataaaagccatgtctgtgtctcaggctgtgtgagagaagatggtggatttccatcagaaaagaggggaacaattgaagcacaataacagaaaagttgttttatctaagagcaagatctatagtaagtttctgttcttacacaaagaacagcagataaactggaaatcttagaggctttcctggagcagaggctaatcagaagccaacatggcagattagcttccaagacagagttgctttagcctacacactactctatccttctgaggctatatccccaccccattctaaacttatgtgaatgtattatacccatttttcctcgtagcctaaaatcaactctatatacagaccaaatgctattttctgcaaattctaatatttgagagtccattctgtggtggtctaactcatgactttctggcataacttttttctttcaacatttggtgtagataaaatgagttttatataattcattgtccctggatcctcctggccagacatttaaagctaaactcccatctgattctgaagagcttataatactttcagaagagataatgtttgctaaattttcatgcacatatttaaaacatgcagtgagcatagttcctcagaaaggtgatccaactcaaaggttatataatttcatatgtgttctccttctgtttatataatgaaaaacactgttaaattctgaaggataaatagaaacccttttctgcatagacattctcccttagtctttcatcagaggttatttagtttttctgaattttgaaggaagattaaggaattttaatggagggttgaaaatggcaaataatcacaagcatcttcaaaaggccaataaattcatttatctgccagctaataaaatatttaactccatttatggctagaattaatttcatgatattttcaggaaatgagaagagttgttcatttggaatgaaacattaaaaatattagtgattttgtaaacaactttaagaatacaataagcatatctgtagatttattggtctttcattggtaagcattggcaatgaaagttccaataagaactggatttgggggtatggggaacaaatatggccatctagcaaaagcaacatgaacatatgtaaatgttaaaaaatcatctcttttattctgaatgaattcaacaatatgcagagtgaataattttgttttgttttattttattttttgagacagagtcttcccctgtcatctgagctggagtgcagtggtgtgatctcagctcactgcagcctccgcctctggggttcaagcgattctcctgcctcagcctccggagtagccgggattacaggtgcctgccaccatgtctggctaatttttatatttttagtagagacagggttttgctacattggccaggctggtctcaaactcctgacctcaagtaatcctcctgcctcagcctcccaaagtgctgggattacaggcatgagccaccacacccagcctgaagtgtgtaattttaaaatgtatttctatatcctaataatttaatgttttatgcattatttttagaaaaataaaattttattaagttgattttatgaacagaagtagttattataatggaaagactgggaaacattattaatggtgcatctaaaataaggatgcttgaaaacacacaatgttttctccaaacttttttagacataaatattacggaagttctgtactaaagttgtgcaatatagttttggttttgcattataatatttaaaatacatgtcaatcatatacttactggaattagataccctgttagtagctctaaatattacttttatatttttaaatgattttatgatatttataatattaatataattttgtaacaaactctgaccctactgatattatatccttctcaatttgcagttgtttcatcttggaacctttttattttttaaaggaataattacaatcaataatgttttaaaattcctataaggcatagtttctgatttatgtgtaatataatgattcacaaagcatattttcaaagaagggttaaatatattaggaaaattctttgttctgtattttgctcttacaacccacaaatcccatcagcataggaaacattctgagtctaatggtaatacagcctcttacattgttggtccttacatttcataaagtcctgtcaacatgaaattattttacagggaattttgggaagcagtatttaaaagaaacacagggctaggcgcggtggctcatgcctgtaatcccagcactttgggaggccgaggcaggcagatcatgaggtcaggagttcaagaccagcctggctaacatcgtaaaaccccatttccattaaaaatgcaaaaattagccagacgtggtggcggctgcgtgtaattccagctactctggaggccgaggcttgaaaccagaaggtggaggttgcagtgagctgagattgcgccactgcactccaccctgggcgaaacgagcaaaactccgtctcaaaaaaaaaaaaaaaaaaaagaagaagaagaagaaagaaacacagtggtacctcctaggcaatccccatgcaatgctcttggcttagagtttaactgtgattaacggtcctcttccacaaggtcagagatggagtcagtggcccctctggttcctttctaaatttggaaaaggtggtatcagtctttcaggttcagtggaagacagacctgctgctcagcgtttagatcattgaaaagtagttgttaggtgattctccctttaactcaataattatcatcattttttttgctgaaaagaataaggatggaaaaaatcagaatggacagaacaatatgccataaagtcaagcagtgcggtagaagcatcttcacatcctgaaaacaaatgtagctactttcaaaaaagattcttgagaaacactgtgtaatatttgaagaaaaaagaatcttgctcacaatttttgcttttggacttcttgttgaaacagactatatttttattcagtgtttgctgagtgttttcctgttcacataatgcccagtatgtgcccagaagtgagctgtgaaagcaaccgtacacttttgctagtaggaaagtagctccatctcagctaagcatactccatgtcagaagcaaccggatgacattaaggatgcagtctatgggaaataatgtgttcttttcttcccaaatgctagctaatgagaaccaggtccttggcctcatcagcactaagctctcttagctgtaacctggttcagtattacagcactaagctttcttagctataacctggctcaatattactaatagaggtgacagcctctaagacattagaggagaaaaggtaaacttttttgcatgtcataaataatttctaggtgatgagtttctatcataaaagtgtactatgcattggagaaacactccatgtataaagaaaacctacaaaatgtggactgatcattatcaagccttaaacaaatgtgatgattgacagcaaaagaggttttctctgctatagagaataatgtcttgagaatttggagaccatttttattttccgtttccctgttagttttctgaatcttaccctaatcaagtttgacctgtttccttgacctttcaatattattggggaatgaaaaatgtaaagatgcttacatggcatatagttccagaaatcaacttatcatggaaaaatgccaatgcaggataggatatgcagatgatgcaacagacattctcagctccgatctgttatctagggctttcagaagcttacagggtctccttgccatcttatcagaaccagaatttcaaacttggaactcatgatctttctcataaaattagctactatcccctgaagtttactttctgttggtgatacctctgttcttcaaggttcccgttttaaatggattgatgcatcttccaaggatctctttggtttacccccagcttttcaatccttgtttcctggcattctctcttgagctctactttaagccaccctgcctgtggacatatcatgaaagtttctccctctgggccttgtttatgccctttcctgctctggggtcttcctcacttcttccaagccatccaaatcctaaccaagcaccaggtcagtgacctcatgaatccagaattcctattatgttttacttcttttgtcaacatcactacacatttcatacctgatttctcattatcttgtttcttttctgtgtacctctacagctcaacactgttatcttgctgtgctgtcctagggacactgctatttcaatcctcatacattgtatgggccatgtaatagatgctctataaatatttaaaaagacagcagttggaacaacttggaggagatcatctcacttaatacatttttttattattgttgttttatgatttttgttatttgattttgcttttttcaatgcctggggtaaaatgagagttcaaggtgaagtaatttatttacaaacactcaaagttgagactcaacccaatgcctttgatcccttccctgtgctctttctttcttttttaaaacagcgttgttgaagtgtaattcacatgccataaaattcactcttttaatgtgtgcagttcatggcttttagtatactcatagaattgtgcaaccatcaccacaatctgattgtagatttttattatgaatctcttagcagtgccctcctcacacttcagccataggtaaccactagtctgatttctgtctctatgtatttgtgtattctgaacatttcatataaatgaaatcatactagatgtggtctgttgtgattggcttctttcatttactgaaatgttttaaggttcatccatttggagcacgtgccaatattttattccttttgattgctgcataatattctattgtatagacataacatttcatttatccatccttcagatcacagatgtttgggctgtttttacatttttactattatgaagaatgctgctatgaatatttatgtacaagtttttgtgtaaatgcgtgtttttgtttctttttggtagacaactagattaattgctgagtcatgcaataacactatgtttaacctttatatacacacacacacactctctctctcacacacacacacacacacacacatatatatatatatatagagagagagagagagacagagacagagagacagagacagagacagacatagacacagacacagtcttgctctgtcacccaggctggagtgcagtggtacaatctcagcttaccgcaacctctacctcctaggttcaagcaattctcctgcctcagcctcttgagtagctgggattataggtatctgccaccatgcctaactaacttttgtatttttagcagagacgaggtttcatcatgttggccagcctggtctcgaactcctgacctcaggtgaccctcctgcctcatcctcccaaagtgctgagattacaggcatgagccactgtgcccggccaatattcttttgagacagggtctttctctgtcacccagggtagaatgcagtggtgcaaacactgcttactgcagcctcaacctcctgggctcaattgatcctcctagaaccacaggcatgaataatcatgcccaactaattttttttagttttattttttgtacagacggggtcacaccatcatgcccaggctagcctcgaacttctgggctcaagcaatcctcctgacttggtctccccaaatgctaggattaaaggtgtaagccaatgtgcccggccacatattcgttattgttaatgagaaatggtcagtactttatgtttgggacttgtcaagttgagtagacataaatacttttaggtttgtgaatagcaggtttccaaggtttaatatttaataaaattcaaacctggtacagattgattacttctaaaggagatccttttgtattataactacaggtataattattttgcagtcataaaaagtaagcacttcaaagcactaaaaaattcccccgtgtgagcaccttattgcaaacttattactttggggggtagctgagagcttccattgtatctgaaatatttgatttccacttgaacacaggcagcaaaaatgagtttatagaatgtctctgaggtaaatttagccaaaaacaagattaatattaagtgttgtctctggctttctttcaaaggaattttttctcagtgggaggtcatttcttctgtaacctaaagcatcatgatttttacagatttgtcaaaaaatgttagcaattcaaactaggcaatctgatttacacatacttatgtaaatagaacatgtaacagatatgttgagtttaaactagcctcacatagatttggggaggaaggaaattatgctttttcacaattaataaaatttaaaatcacaagaattatcactttatttggcttatagaattaaaattaagaaatattttttcttcctttcacccagagaaatgttaagatgaaatgccttcttacatattcaataagcttctctcaagaatgtgtctaatcaggacttctcagccttcaattttctcatttgcaatgctattctcattcccctttattccctttgttatttggccttgaaaaaaaatggcgagattcatatctctgtccaactgctgaaatctcacaagtttaaaatggcaatgtttttatggaggaatcgtggtgctgtcacggtgatttcagaaagccttacttctgttttgctctctctcagtctttattatgaccacctgaacaggatgaggggccaaagacactgccactgtgtgtcagctaaagagcagaggactgggcttggcctgcagtgaggaactgtagggaatgaggatggatgagtggacaaggaactagggctgcaaagaccacctttgggatagaaggcaattgctttttatagagtgtagtctccaggtcatttacactagaaatgtgtttttagaggaaagaatattgtccattagtgaacagatggtctcagcaggaaaggcatctcaggggcaagttttactcaagtttagagttcacaacaattatcctgatagatgtgtgtgcgtgtgtgtgtgtgtgtgtgcatgcacgcgcatgcctgtgggtatatgtgcacttgtgcctgtgcatatgggatttttcttttagcttgcttgactggaatgataaaataactagcgtattctttatttatttgctataaaatgataaaatgtggttttaacaaaaaatgttttaaaatattgttcattgaactttaacaacacacatacacgaatttttcttgcatttgccaaatcaaaacaggtttcatcctggtgttcttagtttaacaacaatggtctattttacattaaagcctattagtcaaccctgagcacaaaactccatccaaggtggtgactccaactatgacaccccctctccaccatatcaacctagatcttaagtgaaaaagtacaggggaaaattattctcctgcatgcaaagaataggaaaagagaaaggcatagaatgttaagaataatagtcgtaatattaatggcaattacattaatcattgtctttcaagtacctgttttgcgccaggcacaatgctaagtcgtctatgtatattgtattgttgtttctcctgatagctccatgtggtcaagactattattgaacccttttggtagacaaggaaactgaggcaaagaaatgttaaggaacagtcccaaagtgcacagctagatgaaaatctagaaattgcactctagagtctggttgctctagagtcagtttactcaagtataatttctggattatatgatatctctccgataagatgagtgtttcctagaggtgagccccctagagtttgggctggagaatggatggcaataggatagattaaggcttggaatgttgacggagaaagagccttctagaagagaaatatactatactttaaggcagggtttagaaaatgcatgtggtgcattcatgggataatgaagaatccaggctgctccattgggctgtttatgctggaaacactagttggagggacaggtagttatgcaatttgtagtagacaacctctccctagcaaggtagaaaagcaagagaggtaggaacaaaattctgagtttttatttttccatccatattttaagacagatgcacaatatctgcagtttgaccacttacctcaaaagagtgctacccataagctcctggctccaagaatgcttttgttcaaacataggaggggatttgaaagatgctttgaagatggtggtctgaatattttaactatagtaaggaattcctagtcaatttttgttattctttgtttttgggggagggggaaaagtgccaaatattttcatataggaagaatagagtattcaaaatctttctaaaaacctaattatatatgattagttgtaagattttaatcctagagtttggacagatctcaacattaaaatgacggttttggaaaattgtttaaagatacaaatgtcaatttgcttcctgggattcatatactgggaggttttaccctaatatgtttagaaggcagaatttggaaacaaagggctccctacttcttacagttttactttgtacttcatgatgctgaaaatgtaattagcccctcgataccatatggcacattggtacccattgttatctttttaaaattatgttttagggccctaacctatgtagattttaactctgcagatttatccaaagtacttcatcttatggcatgattttaaggctttattcataatttttacttattattaagagaaaactctctaggatcttttttctagtataagcagattatatttatagagtccttactatgtgccaggtactacttattaaaagtacattcaactggcttaattctcacaatactttgtgaggtaagtaatattacccattttattgttaaggcataaaattttcaataactaccacaatggagcatagctattacatagtggagctcagtgtgaaatcaaacattttggctctagagattttgctactcaccactgtgctatgctacaagggtaaggttaaacccacatatcagcctatataatactagagtgttttggttaataagtaggagcactttcttttctacaatctagaaaagtgctattgaagggaggtttcctaagtggtctctgaccatagatacagatgagatatttaaaggaggtttttaactacatcactatgtaatgagtggaggaagcaatatgtaatacttatctattattgcataaaaaattaccccaaaacttactggcttaaagcaacaaatatacatcatctgccagttcctatgagtctggaatccaggtatgattcagctgggtgcctgtggctcagaatctcccacaatgctgtctcaagttatgaataggagctgtgttttcatctgcaagtttgactggggaaggtctgcttcaaagctcatacatttggctgttggcaggccccaggtactctggctgttggacagagacatctgttccttgctccatggacctctccatagggcaggtcatagcaaggcatctgaattccctcagagcaagccagcaagacagggaaactcaagccggaagctatcttttgtgacctttttgtaaccaccactttttctgtattttgatgattaggagcaagtcagtaggtccagccatggggaggggattacacaagagtaaggggtttacacaaaagggatcactgggcaccatttttgaggctgcctaccagcgtctccccttgtcagcctaagataagttagtattgctatgaagtaataacagatcactgaatgtattgtcacctgcctatttttatagttaatagatacagcaacgtattttgtatttaaagcttctttttaggaaaaggccatttgtgtgccctccattaacttcacaccaatttcagtcagtttgctgtgttgtgataagatgtttcagttacaccctctgtgcttcagagtgactggtccttcattagagggttaagaaacttagtattttggcagaactgagtaatttgtttcacccagtggttaatttaggcaagcaactgacttgactgatctgagtccttttagtacatgtctgtttagctgagttaatcagatggagtattggtttagcattaggtcagggaattctgaaagtagaatatgtattacctagcctattttccacatctaaaataaggaaatatataggatttattaataaaatatttgagaaaacaacagaatatacattgtatttttctatgtaattttgtgtttgatgagtaatcattctcattagagaatgataccagttttgagttttgaaagacatcttttctcacagaactatcaattgccactctttgccagaagagtttttcaaagaggtatgcgtatttctgctagctatcattacaaaatgattctgagttatagtatgaattggtaatggatctacttatgacacactggttcacatctcagattgtttttatcttctaatggaagtcattcattccttcacatagtcacttatatattcagtaattatttgttgagtgtctactctggaccacacagagttgtaagcattgcaatgtaatttcgtatatttttcaaaatctcattgtaaggaaaagagtgtttagcacctctcactggattgaggtagcaatgtttacttcttaatatttttccttagaaaacaagcttcaaaaaattgtgttatcctttgattgtttcggaaaaagctgttctctttaaatagcatttaaatatcaccacaaattgatatatgattctcgaagaatgaagcttcatatgaaaataaataaacagctcaacacagataaagaaatataaattaacctagtgagaaaagaacacaattattggctggatatgaaccttgattatgagtcagtagcaaacactaaaagagggaaaatgatccattattcaatggaaataatttagcttgattattcctgcattttcaagagcagtaagatcagccacatgcagacaagtgggacagagttgttgtgaattaaatgcagttgtattgctattatatttaagacatcacaatctcatttactcccatggagcctgaagtatgtgctcttatgaataataatcttatgatttttttcataatatgaaattatacatgagcctctgaattttatttcagtcaatgaggtttgtcctctttttgttcttgccattggtgattgatataatcattcatatgtgtgtgcaaaatgacctgattcatcatgattatatatattaataatggctatattgaataactttagccaaaggaaatttgattggtaggattcacaaattatgaaatgtctaggatttaaagaacatatatcattaaaatcctttgaaaaaacaaattatccaattcatagtccttcggtcaagaaaattatttgatactcagttccactttaaaaattaaatattaaatttcatgagtgttgcctgaaagctatttgcaaataagttctgagtttgtgttattacaatgggtttccatgccattgaaaatattgttcttctacacatgacatctttttttctcataatttatctccttaggtcctatctctttctgctgctttttttttttttaccccagttatttcaatatgaatcttcttctcaactcagcaacacttcagggctcactgctcttgtcccagtgagttatctcaattgagcccgcgcatcacacatgtgaccctggcacatctgtgaggcaccagcacatgtactccacagccatgtagaagcagctcatgttccctgataatattgtgtagggagagaaatcaatagggccttaggcgagcctgaggaaaagagttaattaagcagtgtggaaaagagaagcatcattgacaagcagcaagatacatttaaaaggaatttttcaaatgtattgaaaacaaaataggtgaaggagggggcaaaacaggaggaaactatgctaccttttctcagtgacactatcacaaatttatttactttttcaataaattgcatatatatattcacacacaagtacattcgtaacttaaaccctctttatatttcagtgtagacaacatgtgagagggctgttatcgattctacagaagaatcatggcatgttatatcaatcatgtttcatgtgcaggagctactcgtagggattgtgattgttgctacatcatccagaatctcatagtcaagttgcacttttgccccatcaaattccacttttcatcctattaggaacaactttgctatgtaagcagggtttttatgtaaatattttaaattgaatcaattgcaatatgctgtcatgacatctgatttccaggtatgaagtaagtgtgcagtatattgtggacatcacacgatttgcctctctgttctttaccatgtgtctcatgatgccactgcaagttgcataggagaaaactgaacatatctactcctagaattagattggttttttagaagcaagattttcagggaaataaggaggaattcgtttgaaaatcccagttgaacacctattcgtattacagatgggtttatttcttggttttattcagaaactaggggcctggattgccacttccttttaaagcaagctgtgtaggcccttattgatcgaagtgtggtctcttggccagaagcatcaggatcacctaggatcctttagaaatacagtctcaatcttcagattagtcaaactgaatccaaatctgcatttaacaaggttccctaggtgattcttctgcatattacagtacggggaagcactgagcctcagacagttgcattttgggtagggcatatgtatttgtttcaactataactctcaaatcttgtcctctagctgtaaatcccaactacactgaaaattttaaattgtcaatcaatgcaaataaagataattaatatttggtgcctctggtgcatgcttaggatagtgaggaatgcacagagattaaaagaatgatgtcagctatgcagaagagtggaattcgttaagaatgtgattgcctcccatcttaagagataaaacatgcattgaaaaaactattagagaacaacatatacccatatttagccaactgctagattgagcttaaggctattactgctttgcaagtactaagaagataaaaatcattgtacaaaaattctctaagaatttttgccttttcttcttctctcagtcatcactgcaattatgataaaattatactgacctttggaaaactcagtcaaatatatgatctccactggccctgaattctacagtctaactaaacgtgtcacagagagagaattagatagttctctttaattggttttaaattggtagtcctttcactcaacattttttgctggcttcctttagttcactgtattacagtataacacagaaaaattggaacaaaaactttttgccaaaaactatgcattcgtagtcaagtaaacaaacatggctactctgagaaattggttataacaatatagcaagcaacaacccactaaaaaaatcaagcagcactaggaaatatctcttatgtttaatttcctgttggttttgctattcaggtaggtctggttttttgagagctaatgtggtagtctatacaaaagggtcatcgctgataatgtgtataaccaaatgttattgactataatttttttaaaataattttgttacaatttttctgcctttatattatatcagcaatacaaataaaaacactcctttagagttaaagcaggattttttaacaaacagttattttcaggccattagtaaaatataattttcaaaagttaaaaatatgactctcataaatataaaatgaacatatcaaagattttattcatttcattaattaatgacagaatgaggaaaatggcaagcctggcatttattggcactttaataaaaaattagaatatgtttgctaggatagttatgaaataggctaatatccattaacagtaataaactatcaactttgacatcttctcagctggacaggaattatttgcatttctaatagaaaatctataacatatagcttcactcaactggggttctttaatcaattgtaaacaggctgcttaacaaaatacattccctagataattaaatcatctttgtatggacctgataaatccccatggacaaatatgtcacctttcttttttccttattttcacattttacatcactacctgtatttagaaagatcacatattaattctagttctcattccattgttcttgctttctttagattggagtcaataaacataatctgtttctaaattctctggaaaataagcacaaaaccaccttactctaaatgtccttctttccttactgacctttccaggtagggcattcctaatgccatgtgacctcataaaatcatgggctagctggaatttattaatgtgacttgagagatgtttaaagctgaaccagtatgattaataatcatgcagatggaaatgaagggaagggtctgagatatatctagaaagtaaaatccaagggacctcatgccttcttgagtagaaaggagcttgggagaagaaagagccaaaattgacagtgggattacatgagaaataaataagatctttgacatttgggtttaaggtagtaaagaaacattgaatttaagatattgatgaagcaatgagaaattttactatggaacttgggtcagtgtaggaaccaggaccatagagtcacagggtacccattgatggtggtacttgaagccatgggaaataatttaaaaatagtcaccaagagagggcatcctaaaacaaaaccaacaaaatcagtattaggtaccagagaaagaagaggcaatgaagaaaagatagtcagataagagaattgaaatgtggcagtgtaagtgcatacaagttttttgaaatgtaaacaaataaatatagtactctcaacacatatacaggaatacattttaatttctctaagattaatattgtgtgcctctttccaaattactacaaacagggccaggcacgatagctcacgcctataatctcagcactttgggaggccaaggcgggaggatcacctgaggtcaggagttcaagaccaacctggccaacatggtgaaacctcatctctactaaaaatacaaaaattagtcaggcatggtggcacacgcctgtggtcccagctggagaaggaggatccttattattctgcacactcaccacatttgcttgccaaatgcaagcacaacctgaggattcctccagcactttcaatgttactactgcttcaacattccaatagttgacagtagatataattttggcaaaattagaagatcttatggaatggtttgtctcattcaatttctgacagatatgttaaagaattgttttcctgtcctttcgtctcctcccttttgcagttttgataatacagttaagcagaaaatcagtgagctagtctcccagtgaaatctcctctcttccaagggactgtgcccaagtgatcctttgatcatttggagaaataaagccctcgctgtacagaaaagctcagctccacagtgcctcagccacagagcagatcagcagccatgctgtcatatttacagccaggtgaaactctgggttctttgctctgcatatttgtaaaatcaccaactatgatgagagtccacgggatagcaatttgctgctgccgaaacatttccatgcaagattccagggaaaaagaaaatggcatattcctgggtcttggctgaaatgattttgctgttatttgataaataatagtgactgtgggcttcttttatgttaggtattctgttcacacacagataattgggattgcaacagatattttgtttttctttaaagggagttgatcttaataacaaaaaaattaaatatattcacaggcatatgactagacaagtagtgtatatatgacacaataactaaactaaaattgaacagtataaatttggcacagtgtacattaaaaaatctgaataattaacctcatggtgctttcattcacatattgggaattatatgagtctagaatgtgagaacgtgtgctgttctcattttctagaaaagactagaattttcctttatatggaaagaaatattttctttcagattggaaaaatatattcactttgtagggtaacattgacacagcaaggtttttgtgtgtggtttctagatgtgggaaatgtgaacttggcccaccataccgtctatatctattgtatgcattatcaagaattattatgaagggatctgttgtaattagttgacacaggattactattgtctctgcattaatgaggtagaggtaaaacaggatctctgtcttgtaggtcctcttttccctctgctccctctccttcctgctgttaattttcaaaagcccttcaggattttttaaaaaggaaagcctattgatgtgacttgataatttctccttaaaacaattcattttcatttctttcagttgagaattcaatttttgactcagcatttagccctaaaagcatttgaaacagggttgatcatgtgccagatgtgcataaatgctttacatccattgtctcatttgatcctcacaacaccacaaagttggtgttgttactcccattgtgtggcaagagaaggtgaggcacagagaggtaaatggcatgcaccaaagaactgacagctgttaagtgttggaattgtgacttataatcctttgggtatatacccagtaatgggatggctgggtcaaatggtatttctagttctagatccctgaggaatcaccacactgacttccacaatggttgaactagtttacagtcccaccaacagcgtaaaagtgttcctatttctccacatcctctccagcacctgttgtttcctggcttttcaatgatcgccattctaactggtgtgagatggtatctcattgtggttttgatttgcatttctctgatggccagtgatgatgaacattttttcatgtgcacatgcacacgtatgcttattgtggcactattcacaatagcaaagacttggaaccaagccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaataccgcatgttttcactcataggtgggaattgaacaatgagaacacatggacacaggaaggggaacatcacacactgtggcctgttgtggggtggggggaggggggagagatagcattaggagatatacctaatgttaaatgacgagttaatgggtgcagcacaccaacatggcacatgtatacatatgtaattaacctgcacattgtgcacctgtaccctaaaacttaaagtataataaaaaaaaaaaaaaaaacctgtgacttaaactaggctaaatgcccatcattggtaaactggacaaagaaaacatgatacatatacaccatggaatactacacaatcataaaaaagaatgagatcatattcttggccgcaacatggatggagctggaagccaaaatcctgagtgaactaacgcaggaacagaaaaccaaatactgtatatcctcactttgaaaggtgagaggtaaacattgagtgcacatagacacaaagactagaacaacggacactggggtctacttaagggtggaaggtaggaggagggagatagtaaaaaaaaactaccgttgagcactatgcttattacctgggtgacaaaataatctataccaagcccctatcacacaaaatttacctatataacaaaactgcaaatgtacccatgaacctaaaacaaaagttttttaaaaaaaatcctaggcttctgttgaagcctatgggctaattttttcatgatactgcctgtgcttgttaaatgaatacatgtaaagcacaaggtctagcacaagtaataaaatctagttataagcaaactgttatttttattttctactgatgtttagattcagtattgttttctttccctgtgttggagatttattttagagtaacctagtctcatttctgtttacatttcagagacatttgtaggttttattgttgatgttgatttttttggaacaatatattgaaaaaccaaaatgtcatgaagttactgaaaatagttattccacatttcaatctccaatcttgttcctaatctcaaaattttgaacgtctacctgatttaaatttctttgagaagttttttgggtaggatgaaggagcatgctctggagttactgggtgttttctttcttcctatggagccaccctgttttattcatactcttgccaagcttccagcacggaagctttctctgtgatagattttctctggtatgaaatatttttttttctctttctcaaaatcactattaatgaacgtactggaaaatggagcagcctgacaattttggttctgaatgtaaccactatgaaaattttctaaaatatctaaaatatccttgaagtttctgtttcctcacttaaaacccgaaaaggttggactagatgaggaataaaaaatattctagtagactgaactatatgaaattaccatttttgtaggtaaaaaaagttgattattggtcatttcatatgacctaacctaagagattaactatcttgtaatttcaggttaaatattaatatgtatttatatagagaaaaagtagcagtgtgcagtcttctctatgaataacttctcctcagaagagactgagataccagcaaaatgttatgaattcttttggaataagtaggggttattttggaagatgctcagaatcttgaaattgtgatttaataaaagatctgttttttaaatgtttatagcacaatgtagtatgtgagcattactgggtaattgaaaacagtatatgtgagtattaaatatagctacaaaacagtattatttgccatcaactttccattttttaaatatattttcatgatcctaatggttttgcaagtactagtaaactggagctaggtttaagatattatccaacattttctctctaactaaatttgatatgtcatgtaactcttttctgattttaacagaaattctgactatataaggtcaacacacacacgcacacaatatattgcatggctgagttttagtctttaatccataaatatttcttttgctgagaactacagaagataaaaatgctgaatcagacgtaggccttgtccccaaggaccttgcagtcaatttttaggtactgttcaatctaaacctgtcccattctgacttctggacttgtgtccttttgctagcaaactgacttcatattcctttttgataagtgctggagctggctgggactggctcatatgagcccattgttaaatacgcaggaattttgcaaggcagttgctaaactgttattagtttgcaattggcctaggtggaagtatttaccccacagaaattggcagatgctattaatgggggatttttttttttttttttttttgcctgagaggcactttgccagtataccaccagaattcaccaggctggcagttgcaatagaattctccaaaagatatacatccgattattacacaaagatagaattataaaatcttatacacagctacgctggggtaggataaagtgagagatcttggagaattgtggcttaagaaaaataacttcaaaactaagacaagcacccttagtttagatagtaagttcaatttctccttatagcctttgcaggaatactgataacttcccagggagaaacaaatggctttttttcactacctacaacgtacttcacattgataaatatcatatgtaattcacatgaggatcctgtgaggttattatttactgatagatttttcttttgttgtttttgctttctttattttttattcccactttaaaagcaaggctaaaagcacaggtgtgttccgtggttagtaaatagctgagttgggatttaaacacaggccatgctgactgcaagactgtcctgcttctaccacactgttttccaggcaagagcatctgataagtagggccagtgattttgagtgtcatctccttttttatcccttaacatcttccttccccaagattagctaactcatacagaagaggcaagaaggcttcttggagagtttctgaagtcaagatttagaaaattaatgatttgtataattcatacgcaaagaaccaatcacaactttgccttaatgtcctcatttgcaaaataactattgtaaggaaatggaattgaaaatatttaatatctggagtttattatactgaagcattataggagcatagaaccttaggattttgtcatttctgtaggctaatgtctctccatacccttcctattatctctcacttttaaggacaatttttaaaaagattcatgttttttcaagtggggaatgagctaaaataaggaatctgtttttatctctcagttataagataggcagatgacagtactcagcctcatgttattgaatatgtgcagggagtgaaaaagacttctaattaaatgaatgccattgggtaccaaattttaaaggcctgcactaaatggccctagtcattaatcctagaaaaaagaaaatcgatgtgtgcagaatgttctctggtgaattttggtcatttgcttttcccaggaatattcactgactgtatcacatagtctttatatagctcaataatgagcaaaagaataaaaggagacataaaagaaggaatcagtaagtcagcactgacctaattattacaaagtgaatgtttttacaagtaacctgcaggcaactcaggagtgagaaaatatttttgttcaagcgtttcagtatttcttatgcatcataaagcttaaagcaaaaagaatagcattcagccataattgatgaataagctgaaccctgaattttagaataaaaatgtttacctgtaagttggctttaacatgataaaatagggatagtcaagacaaaggttgccttctgtttggctataaacaagtgtattctgttctattccaggaaagaaagaaggactcattttcttcattttttcttccttcccctatttctctctctctttcttagaattttcaggctcagagtctttaattataacattaatataggaaggacacgtttactgatttgatgtatattattttaaatgtgttttcataatatttcaatgtaatttggaaagcaaagataatagataatacatagaaataaaaacctgaactagaatatcaaaagatagcctttattttatgcttattccattgctcactgaggctttcttcagaacacaacaaaggtatccaggtctgtctaacttctacgattctataaaaaggaaaattaaaacataggccaggattacaattgtatataatcaatgcatgtaagaacatgtatatatttcaaatctgcaattttccaaaaacaaagaacatgtgtcatgattatcacttgtttgtcatttactcaaattttctcatgaactctggtatgactttgtcaatgctaattataaacttaccttgcttcataaaagacagcagcaaagttcatgagtttaagttctagggagctaaaaaacaaacagatcaatggaaactttgaactgtgataaacactatgatgaaaagtacataggctatgaatacgttccatgtattatcattttattttcttgtgcttgagcaaataagcatataaattattatttttcaagacctttcataaattttatgctgagattaaccattcatttgcacgtggcattttactaacccctacctgcatctcctcaaaccctctgaaagaataccctgtacaggcttagacccatgttttgccctgtagttctgttatgtaagatcactaaaaggattgagattgaaacctccaggaatttccccatgggctgtatttgttcttttaaataacttgaggatagatatggctttgctgtgtccccatccaaatctcatcttgaattgtaactcccacaatcccacatgttgtgggaggaacctggtgggaggtgaatgaatcatgggggtggtctttcccgtgctgtttttgtgatagtgagtacgtctcatgagatcttatggttttaaaaatgggggtttccctgcacaagttctcttctcttgtctgccaccatgtgagacgtgcctttcaccttctgccatgactgtgaggtctcccagccacatgaaactgtaagtccaataaacctctttcttttgtaaattgcccagtctcaagtatgtctttatcagcagcatgaaaatggactaatacagtaaattggtagtgggagtagggcactgctgaaaagatacccaaaaatgtggaagcaactttggaactgggtaacaggcagagattggaacagcttggaaagctcagaagaagacaggaaaatgcgggaaaatttggaactccctagaaacttgttaagtggctttgaccaaaatgccgataatgacatggacaatgaaatcaggctgaggtggtctcagatggagattaggaacttcttgggaactggatcaaaggtgactcttgttatgttttagcaaagagactggcagcattttgccccttccctagagatttgtagaactttgaacttgagagagatgatttagggtatctggtggaagaaatttctaagcagcaaagcattcgagaggtaacttggctgctctcaaaggcattaaattttacatgggaaacagaagataaaagtctggaaaatttgcagcctgacaatttgatggaaaaaaaaatccgattttctgaggagaaattcaagccagctgcagaaatttgcagaagtaacaaggagctgaatgttaatccccaaagcaatagggaaaatgtctccaacgcatgccagatacctttgtggcagaccctcccattataggcccatgggtttaggaggaaaaagtggttttgtgggctgggctcagggtccctctattgtgtgcagtctagggacttggtgccctgcatcccagccactccagccgtgactaaaagaggccaaggtacagctctagctgttgctccagagggcagaagccccaaaccttggaagcttctacgtttttaagcctgcaggtacacagaagtcaagaattaaggtttgggaacctttacctagatttcagaaaatgtatggaaatgcctggatgccctggcagaagtttgctgcaggggcacgaccctcgtggagaacctctgctagggcagtgcagaaaggaaatgtggggtctgagtctccacacagagtccctgctggggcactgcctagtggagctatgagaagagcaccaccatcctccagaccccagaatggtataaccactgacagcttacaccatgcacctggagaagccacaaacgctcaatgctgccactgaaagcagccagggaggagaccgtacccttcaaagccacaggggtagagctgccaaataccatgggagcccacctcttgcatcagcatgacctgtatgtgagacatggagtcaaaggagatcattttggagctttaagatttgactgcacctctggatttcgaacttgcatggggcctgtagcccctttgttttggccaattgctcccatttggaatggctgcatttacctaatgcctgtatccctcttgtatctaggaagtaactaacttgcttttgattttacaggcttacaggtggaagggacttgccttgtctcagatgagactttggactgtggacttttgagttaatgctgacatgagttaagactttggagggctgttgggaaggcatacttggttttgaaatgtgagaacatgagatttttgaggggccgggggtgaaatggtgtggtttggctatgtcaccacccaaatctcatcttgaattttaactcccacaattcccacatgttatgggaggaacctggtgggaggtgactgaatcatgggggcaggtctttcctgtgctgtactcatgatagtgagtgggtctcaagtgacctgacggttttaaaaatgggagtttacctgcacaagctctcttctcttgttgaccatcatgagatatgtgcctttcaccttccaccatgattgtgaggccttctagtgacttggaactgtaagtccaataaacctctttcttttgtaaattgcccagtctcaagtatatctttaccagcagcatgaaaacagactaatacacaattgcattagcctctaattgtgcctggctttctagatgtcctcagaggcagcacttgatgcaatggagtaggactcattgctctgtatatactgccttcttcgccttcttctggaggtccagtgcatcgccattgctgtcttcaaatatttgtgagtaccacgcttacagggcatcatagccatgatgaaggaaaacaacagacaggatttaggttccctctggaaagtacttcccatttatggcaagactcacaaatgtaggggtgtttccaactctacaaaaatatttagaatttccttaaataaagtgtctatctggagtctttggcatatatataacaagactggcaatatactgagaatttgaaattaagtgataggcatattgggactcattatactattcttttttttttggtggtgaaattttccagttttaacatcttcacatgtggtatttaatttacacaccataccattttcccatttaaagttacacaaccatcaccacattaattttctaacattttgtcacccctaaaagaaattctctagcattcacctctcatcttccagtccctccctcaacccatcagaggcaatctctcatctactttctgtctttgtatatttgcctattatgtacattttacataaatggaattatacactatgtggtctttcatgagtggctttcagatgagataatttttcaaggttcatccatattgtagaatgtatcagtacttcattccttttgatggctaaattaatattccattgtatggatatactacattttgtttacccattcatcagatagtgggcatttggactgttttcactttttctggctattgtgtgaataatgctgctatgaacatttgtaaataagtttatatgtagatatatgttttcagttaccttaggtatatactttgggaaggaactgctgggtcatacttaattctatttttaaccttttgaggaactgctaaactatttttcaaagaggcaacatcaatttacattcccacaagccacttttacgttcccaccagccagttgtgtgaagattccatttttttcacatccttgccaatattgttattatgtgtttttaatcacaatcatcatagtggttgtacagtggtatttcttactatcctaatttggtatctgcttaaaacttttctaacaaagaacttttaaaaattataaatattaaattctctgagtttgtttaaacagtcatttgcagaaacattttattgataacaaaagagactattaaaaaagtagccactgcctcaatccatattttgaggtcactgattcttaaaacgttatattggtataggatagaactggagaggattttttttaagtttagaagatttattggttctttgagcatgtacgcaatcctaatatgctgtaagccctctcttgcaataccgtcatgtaaacacgcatcatctgcatacaggatgttttgtcactattgcctgattttaaggtatattagttaaaaattgactttctcttttagaaaaactgtgtttggagcaattatttagattcttattgtgcataaaaaagtaattcaaggtctctttttgacaatgactattgactagtctgacatattcttgattaaaggatcaacaaaccttttcatttctagaacatgaatatttattaaagcagattagaaattttatctattgttacctaggaactttttcctaataactattgttctgatggacaatggcatattctgaactacttcctggtctcccaggaaaatggcaagttagttacattagaatgatcactgggcggtttctttccatgttgcataattgagggaaaatctgttaacattgcttgaaataaaaatcttttaaaatattttattaattggctttaatctcaattttaatagagtaattattttggaatagttttattcttttccttgtaatctaatggcttttgtgcagatataattttaagtagtcagccctaatgcaatcagtaattaaaattatagccaactacaggtgctgctaattgttaatcaattagatgcagaacgattacatatctaattgaaatactgattgaagtgttgatagttacccatacttttttcaaaagtaaactacttctaactgttcttaagttggaataagttgggaatattttctcaactactctctcactcattaacttatctgaactttagtggagaatagacttgctctttctgcatgtataaataaaattggtacagtagatcagaattgacctgactggctgttgaatgagtctgtgatttttaattggtttatgtgcatattaacaggccacattctgcagatggttgtgtgggttctgagtatctggatttggcaaatactaggaccattatataggaatgttatagtcattaaacactgatagaatccttgatttgccaggaggctgcagtgggtatcactgtcaacctgctgatcagcctttacagacattaattagttcacatatttataacaatttagtggtaagaatatctgcatgacaaaaaaaaagatttgatatttattccttttgaaaaataattgttgaaattcgcaatataggctcaagtttagaaaggaacattttacctataccatcgtaactgaaaactattttgcagtttctaagcatggaatcacacgaataggagacagcaatagtaagcaaagactgggtaatattatttgtgtttcatgattgatcaaatcataatcattctaatttagaggcataaattctctacgaagccagaatttattttctcaaaaggggactatagtatggtgtgtctatttatcttagtagatttaagtaaacctgatttaccaagagcattatataatctttcactggaaagaatcaatcatgttcttcaaggaaagagtttgagttgaatatgcctgtttcagcaccatgcctggagtgtagcaagcatttgggatgtttattgaacaaattaataaagtgactaatgtaaattatagtgagattttctgcagacattaataaaaaaagatcattaacaatccaaaaagagtgtttttttattttttaaaaccagccatgtaattttgagactgctgagatctcttgattgtgcatctgacgtgatgcttcagatgtaacatctcttctgtcagctgccaaaagtcacctattaagccaagtaaaaacttccaagtatagactgggataaaggaaagaaatttaggagaaaactacttcaaaaattttcctaaaaattttctctttttcagaaaatgggaatggattttagatttgtgtgcttgaggagagggaatgaaaatctgagcaaataccattttgattcaaagcaatagaaatgaaaaacacaaggacaggtattttatcattctgtttggttgcatggtatgctatttgtgaaagcattgtatatgacactatttttaatccagcaattctattgtcacctgaacatttatggtttggatgtaaagtgtaactagtaaatcatactattggtctatcatctggcattacctgaagatcgaagagagagaacaattccatttacctcatccctggtaggaatatttgttaggatgcctgaagtcttcatttccaacaggagaaagccacaaaacacttgtggttctgaaagcagcctgctgttaacatgagttatgtgaatctgatctataatcttacctgacatttggaactcaaatattttccttatttctccaaaacaattaaaatatttagtctcacttcattttatgagacataaatagctatataagtactctgtaattactgtacattgtaacaaatgacctcataaatacattgtaatgtcccatgtaattacatggtacatcgtgtctttgagatggctgctctgagattgaaagcctgctggtttcagagattaattacttagggcctaatttgacagtttgcttgaagataggccgctgttaatagccacttctgtggtttcataaaaaaaaaactgtttcttcacaagatcttatttccttatttactatagacccagctgtacatgtttatccctgaatattggccatacctaaatttttctgtatataaaagcaaaaaagtgaaaagggcatggttctgtacaggaagaagttgatttgcaattatatttctcccatcaaacactatgacttattttatgacaataattttaaaagttctggtttattaatttaaaaaaatgttggggccaggcacaatggctcacacctgtaatcccagcactttgggaggctgaggctagcggatcacgaggtcaggagttcaagaatagcctggccaacacggtgaaacccctgtctctactaaaaatacaaaaattagccaggtgtggtggcaggctcctgtaatcccagccactcagaaggttgaggcaggagaattgcttgaacccaggaggcggacgttgcagtgagctgagatggtgccactgcattccaggctgggtgacagagcaagactgcatttcgaaaaaaaaaagaaaaaagatattggagtataagatattgtaaaaattatgtcatttttttctctgattaagcgttatacagcctataaactaatatttcattttgtaagagcccaaattcgtttgtcacaattattttatcatgagggcattattataataccttgcgatctcagtggttattcttgataaatgcatcttatcctatagttgccgtttttatatggcatgaatcgtatttaaaccttctttctctttgactcaggttgcttaaatatctggtgaaataaacttttctcaagttgtactactcaccttactgctcaaattctatctagtttccatgttccaaaacacaaaggaaataagaaataagtgaacactgtattttctgccttaaattatatactggccctattttcttgtgcctttctagggtgtaattttacatataactcccctgatgtatttctattccagctttcttaggtctagttcctacatcaaatatattatattgcttttagtagttttatttagtacaaacgaatagtctgagaaaggacctagtgatctgaaagagttaataagcccttctaaacatccagcttacttccaaggaatgatttaggcactggagaattaagtctattgatactgacaaattccaaaatgtattaatcgtaaactcactttatcataaactctagggaacaaccaaattgctttattgtaatggaattttgtcaaaacgtgaatacctcctagaaattacatttccagtttctaggacctagaagaaacaagcctggctactaggctatgcatagaaaattatcagatgtaaaaaatgctattttaaatccaggagcttaaaaaaagaagatgctaggtacacaccaaactcactgctttcttttcatgtctttttattctttgagctccacccccccccccttttttcctgtaagctgggctatactctgacatttggggatcattttcttagtcagtttaggaatattgggttggttttgcttagttagccaagaaagcccagcgggcaggaaggattaattgatttttctttatttttcttcccataatagaaaccatatatggttacatatctgagaagcaactcgaatagagctgtggtaatcagtggaaaaagtgatgtttctatgggtcattcatctgaatatgggaaaatttactatttaaaaaaaaccacctcagccaggcatggtggcttacacctgtaatcccagcactttgggaggccaaggcgggcagatcacctgaggtcagaagttcaagaccagcctgcccaaaatggcaaaaccctgtctccactaaacatacaaaaaattatccaggcatgggtggtgggcatctgtaatcccagctactaaagaggctgaggcaggagaatcacttgaacccgggaggtggagcttgcagtgagccgagatcgtgccactgcactccagcctgggtgacaagagcgaaactccgtctcaaaacaaaaacaaaaacaaaacaaaacaaaaaaacaaatctttgcacaatgctgaattgtctttgagaagcaaaagaacatttctcagagatttgtaatctaattgttgcaatcagattaagtatttatgaaggtaattcagtcacaaccagaatcactccatttatttatttttatgtctgtgaaacccaatcatgtgaggccaaagtgacttgattacttaattctttgaaaacttgcttcagtttttaatgtcattttgtgtttcaaaacagttatccatactactcctactgcaaatcatgacaatcgtgacatgggaaaactaaaataagagcaaaactttgtattttgtagtgttttcaattttctaagccctttctcatcgatcacctctcaataactagggagagataatgttgtaatacatacaattgatgctgctatataaataatttctactgtcacttagcaaattaatgaaaagctgagagtagaacaatatgcatccatgttcatacagtccgtgaataccttttatgtgcagaacactattctgcctttctctaaatgattcagaaatgcacactacacttgatcttagccaaaaagtcaagaagcaataggaatgcagctagatagaacatctaataagattttctaagcaccacacctggtataaaaattaagaagacctccaacatgtttctgtacatctgtgcctaggatctgagattcatttaacatttggagttaaatttttaaatagattactagcgttttttaaatttttattttagtttcaggggtacatgtacaggtttgttatataggtaaacttgtgtcataggggcttgttgtacagattattttgtcacccaggtactaagcctagtactcaatagttaatttttctgttcctctccctcctcgcaccctataccttcaagtaggccctggtgtcttttgcctccctttttgtgtccaaggatcactagtgtttatggtccagaattagcatgccagtttggggctacagttgaattaacctcatcactagagagatgtctgcaggctactctcagctgttgtccacttttctcctgatagagctccgagcttcatatttaaataactcaagaagtagttttttatatattactttggaagtgtgcaaaatactagcctaccagactctcaaattattagtctccactgggcttcctgtgtctctgtgaacagtcatagattggggacctcacaatgaaggtttggaaacctatttgaccctaatttactggttcaagtctcctgtgctcctacaatgaagcgggttgggtaagttattagtttctccttttttttccttagaattgtgaagtttgagttgtaagaattagattaaagcagagaaaagtggtggcatgtcaatttcccaaaatcaatttaaatttagctcagtttggctaaaaaatataaaaatggaacatataagaagtggagcataattcggataacatttcttactggtgtaaatgattttttaaaaaataaccctaactgtgttgattgtatacacttgaaaaagatcttggggatgaacaggcatggagttcagagccagtggcaggagggctgtgccctaaaccagaagaagtgaggtgatgaaggctgtcattcaaaaagacagtatccagagaagtggagtggtagaaagcagttatgcctgataggggagtcaaaaagactgaagagacatttctggttgtgaatcagaaggctagtaggttttgctggttcagagcgctaaatcaggtaacatgcctaagttcagaaagggtgggtgtattttggaagggaagtctgccagcctctgattagagtctcagagaagacagtcatcgctggaggactcagccttgcatgtcttggagggacctggcagattaacaaaatgaagggggactcacccggaaacaaggcagtgtccccaccagagaaatactgttacaagagctgggacccaaatcaaagtagatgatttgatttgaagttgaacaatctgagaaattgtcccaggttggcttacgtttttacataaccagggaaaggattctcccagagtaggtaaaggagagcttaatctctaggtaagagttccactggcacttttacgagaaccaggggccagcagggcaaagataaagattagattgttttacaactatataaatgtattgatgaagaaatgtttgtatcattttcaagctgttaaataaaatcacaacagcttagcctttattttttttaacaaagtaacatttcttgcttcaatttaagacatctccataaaattttatttaaaatcaaatattacccaacgtgtacttaaacatactttattactgcacaaatatttacttcaaactttgcatagtaatgtcagagttttccctctggaaatgtatcatactgatacattttgtctaacagttgtctacatgaaattacggatctcaactttagtattctacccaaatttctaacttcccttaatacaagaaattatatatttattaatgctaaacttaaaaatatgtcaaatcaacaaaaatagcatataagagtaggaaaaaatatgggcctttattatatcatattgatattttatcaaatccatgctgggttggtaaaataagtttatagatttacatagtttataaaaagacaaaattgttaatgaaaattgtttacaaatacacataatagaattttttcatagatatttatgttctagcttgaaattcagttagatgttttcaggatctatagaaatatttaccaagtatttagatagatactgtaagttaaacattaaatgttgctattttgtaattttgagattatgagtataacatttgttctgaatgatgaaatttgaaaactgccctttccaacattaaacagaatgaatccatatgggtaatctttgtttctatatcctctgagtgtttccatttgttggatatctggtaggtaagtccagtgttttgttttttcttttggaaagtggattatttttcagaaaaccttatccatgtaaatgcattattatctaccgtgttgcctatgtcagaaacctgtcattcttgatgacttgtcctcctttgcatttgacattcaataattcaccaaatcctgtcaagtctacctccaaaaatatatatgggattttttattttgctgtatcccaaggtttcttcactacccatgcccggaggttctatttggtacagtaagaaatgtgaatggtaccctgcacagaggaagtttctcaataagtattcatagaatagaagttacaaaagtgttgctagacaatttctctctctcagtgctcctttcagttcacagtagaaacaaatgttcaattgttgggtcagtgcacaaataagtaggtccatattcttggcattgctactgtacgtggtcttgcttccttccttcctgctgttttccacttctgcttttctttattctttctacctggcaccctcacaatctttcagtctctcaatctctggatcgctggacctcactgtcactctctctttttctctttcccttttcctcccagtttcccttaaagtagttctgatttactacataaatattatgtgccagcactctgatggaactttcacacgttctcattgtttcctttcatttgtaccataatcctacgagggagggactgctattagctcatactgctgatgagaaaactcagtctctgaaggcttatgttgcaaattcagggtcacacactgaccagaaaggtaactgagatgggtgtgagcagtgtgagagtagaggctggggcgccagttagctatggcaatattctgggcaatagacaaatcaaggtcagaattagggtagtgtcagaggaaatatacataactgggcagaaaagggactcagtgaaaataaattctttcaaagtactgatgggcacactttaatgaaaaccctcagggcctcatgcatactgggagcatattttactctgaaagcaacttcctgtgagattcaagtcaccagaagtccaaaactgattttaaattagttttcaagattcgtagattcctgctatgttccagccaaggcattcttacttgctgcaaggactttcagagtgcccttcatagctttctatgggaattccatctagataaaaccatcttttttaaaaaaggctttttgctagagtaactgactgtgtttgacgaggatcaaaatgggtttgtcttcacctgaaggtcactctggagagagtaaggcagaatgtcagtgtgcagtaggagatgtggagttaaaaatatgataagtttatgaaatgtggcttctgagaaaaattggagtggtgggcttatcaacctctttttttcctgtttcctcacttactactcttgtacgtctacagtggagaaaacagaaagcagtgttttaatggatcccaggaaaaggctaacaccacatcattgaattggacatgactatcccaggcagtttggagactggccagtgacaccctttgttttaaatcaattaactcttttccatcaggtttacttggcaaataaataatttttatggtgatcaaagaggggatggaggaattagaggaagctaaattttatagttcttattttttcccaaatatgaagaaaactgaaattattcattgattcggatagaacactgcaagtgataaggattaatttctccctctcaagtaataaaaggaccaaaagtcaagtcacagctactagaactgatttttcaaaagtcaaaggtcatgtgttaagtacttttaataaaaatcattgccagggttgcctatgaaagctaggttgttttacaaaaatgttcccgtaacagcaacagcttttggtggcttgctgagggaatgggaaatgaagtctgaactactgggcagtggcaaaataggtctcatatagaaaataagatgccttataacattaataagaaaagaatgcctgaatgctttcatttaacttcctaaaacacaatataatttggagcctccagctgtatcatctactaaagaacctaagaagaaagaatctttgtaatctgctgacgcttgaagtcaatgagaaagcacaaaagatgctaataaacttagctgctacctacagatgaggatgaataaaactgataataatcacttccaaagatgaataataaccattcagggggtttcactcctggtgtgttgagtgtataactgattatattaattaattgctgcttggcatcgatattaaggtattggctatgtgggaataatttaagcgatcactggaaatcctcaaatgtgataaagaaaaattgtcaaaaactattacttatgtaatcattagtataattaagttctccaggcttatcaagtgatttacacttggtagacatactaagcacaattgttctctctttttcagtatgtacatggagattcagatcacttattagactcataactggggatggtggctcactcctgtaatcctagaactttgggagggtgagcgggtggatcctttgagcctaggagttcaagaccaatctggacaacatgacaagaccctgtctctacaaaaaatacagaaagtatttagccggactatgtggctcctgcctgtagtcccacaggaggtggaaggatcacttgaacctgagaggtgtaggctgcagtgagccctgattgcaccactgcactccagcctggatgacacagagagaccctgactcaaaaaaaaaaaaaaaaaaaaaaaaaaaaaaggcttgcagaaggtcactcagcaaagtcacagcaaaacaataattggaaattaaaaggttctaattcttgttctaaggtttaatatctacatttgtattttccttttcaacttgaatttatttttgactttaaaaacagctgtagtcttcagaaggtggccctccttgattttccaagggctttgtatgggaaagcttattggatgtattttaaaagaataatttaaattatttaaattctagtttttaaagagaataggagaaattagatgagtataattgccaagtagagtccctgtgattacttattttagtgtgaaataatgaaaggaacattagaccccacagttgggaagtcttccattgatagtgccaggtgaccttgggcctatccttcttttaactgtgtcccaatttccttctttgtaaaatcatcaatggtgataatatctgccatttcaccactcaccactaagatgagtagtgaaacataaaccatgactattcttttaattctggttttctttcctagtttctaaaacactggggagtaaagaatatgtccacacatgtgcacctacatgtatgaatggtggggaagaagggaatagatgggcttgtgtgtatttaagactatgagttctttgcagccagggactctacactattattttatgcattattttatctcctaaataacttagccaaatgccttaaatgaacacattaatccagccttctctctcttttgcatggtctgaaaaattttgtaatgtttttcccaatctacctttccttttccttatcctatatatcctttgctttagccactaagagactacatgagctttccctgaagatgcttgacgttgtccttacatcttgagcttgttcttgatatttcctgttttaaataccattcccaacccctccgtgaactccaaatcacacttgaaggatgagttccttgtaaagtccttttggtcatatgacatagaattaatcactcttggacattctactataaaccttagcatgttgttttttcattattagttcatatgtctctttcctcagccagaatgggtaaatcatgacttatttacatgtttaccacatcaagaatgtagttgatacatgttgaatgagtaacaactaaatgaattagactctcagcctcttgaacttctcataggaggcaatattaagcagaaaagaatgtcctccttttgactcatgttatctcagttaaaattctgcctattgttggatacatgtctattttatttaaccattcttgtcccagtttacctgattttacaaaggtcatagcaatagaccttaactcacagagtcataatgagcataaaaatataaataatgcagagtgcttagaccattgccaggtctaaagtaagtgcaaaaaatatgttaacaaatagtagttaagagtggtgcttaatttatcacacttaaagaatagtggaaacaaagtaaaggatctcagtgcgatagtattttgaatatattctaccaacttaatcagatcaattgtatgtaactagattcctctgaaattagtaaaagatttttattatataagtacagttgatcctcattatttacagattctgtagttgcaaagttgcctgcctgcttgctaaaatttatttgcaactcaaatcaatacccttggtgctttgtggttatgcttagagcagggtaaaatttgagttgccaaatgtccacgttcccagctgaggttgaagaaagagatgctctgtcttcttgttttagccctcatactgtaaacaagcaccctttttgaggtccatttggtgccatgttttttgtatttctgtgcttttggttggtgatttttctgtttaaaatgatcccagagtggagtgctgaagcactgtccagtgttcctaagagcaagaaggctgcgatctgccttatttctcgcattaaagttcaaagttaaagagttgacaatactgtcatattaaataaggtatcattaaatagaaacacacataaaacaaggttgggtacccatcagttgacaaaaatattgtaaccagaggcttgaaggaacctaaacctatatttcccctaggagcaatatttcagtattctcaaattcagtgctggggtgagggcagctatacagaaaataacaaagtaagttactcagcaagtaaatgcaaatttagattatattttttttcttctctcagagaaacttatctgcagagcaccagctaatttgtggtagatctggaagaaggaggttggatttctatctccctggagagtctagctctgcctctgctccatgactgaagcagggacagggaggtcctggacaaatccattatttgacgttggttctggattcattctttctttctttctttctttctttctttttttttcttttctttcttttcactctttcttttctttttctttttcttcctttcctttcctgtcctttcctctcctttccttctttctttctttctttctctctttctttttccgagatggagttttgctcttgttgcccaggctggagtgcaatggtgtgatctcggctcactgcaacctccaccttccgggttcaagcgattctcctgtctcagcctcccaagtaggtgggattacaggcatgcgctaccacgcctggctaattttgtatttttagtagagatggggtttctccatgctggtcaggctggtctcgaactcctgaccacaggtgatccacctgcctcggcctcccaaagtgctgggattacaggtgtgagccactgcacccggctgtgtctggattctttctaacagcctgtaatttgtttctaccacctcaaaaaaaaaaaacaaacaaaaaacctctgtgtgcttattttaaaacttaatttaaatattttcagagtattacatgcacattattttttaagttaaataatactaacaagcctataacaaaaacaaacaggctctttctttcccctccccaaaccctgcctccattccctaaagactgcctttttttttctgacatttacctttatgtttctcagtaatctacttatttagatgtctcttagtttaccagttttaattcatcatttgtagatatcatctattggtttatttttatgtcaggatttggtgctgacacacttccatcctcattttcttctccaatcttttctcttttttctactgctgcttctcctcctcttccttattttgttgaggtgtaattaaaataaatgaaattataaatcttaagtgttcagtctcatgaatatactggtattctagggctgccataataaatactgcagactgggtggcttaaaaaacaggcatttattttctcacagttagtgaagctagaagtccaagatcaatgtgttggcagatttggtttcttctgaggcctcgctcacttggcttatagatggctaccttcttcttgtgtcttcacgtggtttttctctgtgcatatctgtgtccttattttcttttagagacaccaatcatgtcatatttaagacctaccctcgtgaactaatttaaacttcattacctccttcaaggacttatctccaaattcagtcagattcttctaagatacaggagtaataacttcaacatatgactcttggtggtcaaaattcagcccataaatatgtattttgacaattgtatccatctgagtaacaaacatgacatcaatatgcagatttccatcaccccaaaaagtctactggtacccatttccaatcaaaacccagaacaactatttagactattctgacttcgaatactgtagattagttttgcctattctttaacttcacataaatggaattaaacagtatgtactctttcgagtctggtttttcatcatattatatcttttatcacattacaattttcttcattgtcttcaacgctgtttgttgtgttttaaatatttttttttcagactgcactcttttcctggaacacatctttcattagcttcctgttaaggaaaacacaaatagatatcttagaaaccatgtatatctgaaatatccctatactgtccttagcatatattcttatacttgtgctatattatccttatgcttgcttatttgactggacattaaattctagacttagaatcctagattagaattgtatgattcatgttctgttgttttctaatatcgagtgttgttgagaaatctgatgccattcttactgttgatcatgttttatgtgacctgcttttttccccttcattctggaaacttgtggatcccctccccactctccatgaggctctagtattttacagcaatgtgccttgaaatggatctgttttgcatttattttgtttaatattccacaatctttttcagactagagtctcaagtattccagttttgtaaagttttattgggaaaggggtcattttatcatttttgctaattttctaccttttatttttcctgcttttttattctctcctcaggggtgttggaaattgagaaccaaatctctaatttgttaccttttctctcccatttcatgtgataatttattcccactgaattttgagagatttcttttaattcatcttccaacttatttattgaatatttaatttgtgcaatcaaattatatttgtaataagtttctaaaaatcttttaatattcttgtgtttttatcctgttgatggatggattatcatttcttagattaccagggtattaatgacgtctttttggatttcattctttgcattactgatgtttccttcatgtgctgttatcttcttatgtattactttttccacttcctttatgctaagggccttctttgatgtctggtaatcttaaattgtcagtttacattaaaatgaagtatgaaaaagctgattttaaactacaaattttagcacttgagttggacttattaagtagtgaaatgggagaattacttgaccccccttgcaggatatgtgacaccggtgtggcctgtctgtttggctgctgcaccctcaaaccccttatgggacagggagcatgcagacaggcaggagctagggtgagcacttttggtctctgagcccacagtagcatctaggggttgctgtctgtgactcccaaatccccagtgagtgtgctacagtgctctttcagctctgccatctgcagacagcttaagtgttaaccagctcagtgccttcttggtacctgggttcttgtccagcatccaggaagaatcaggtcacatgaacaaattgaaggatggtaaatgtgggggattttattgccagatggaggtggctctcagcaggatggatgggaagctagaaagggggtggagtgggaagatgatcttcccctggagtttggtggtcccatggctgatctcctacccgactatccccagctgaactcctctcgatgttcagatgctccttctcttctcttcttttctgccacactgctcttctgttcctctcctcttctgctagtctgctcatttgcttgtggagcctggggtttggggttaatatgggtacaggatagggggacatggcaggccaaaaggcaacatttgggtgtgaaaacaggaatgactgttctcatttagggctgtgggtttccaggcttgagggtggggccttttgccagagaaccaccttcttttacccagtatttccctgtctcctgtccatatcagtaggagcctcattgttggggaattgatcagggatatgactgctttttttttctctagggcaaagataataattttctctagagaaggattatatgatattctacccaagaagcatatacctggttgccattgctctaggtatcatatgaaggaagaagacatgggtagctcatatctttgatttacttactcttgcctacatccctgttctctcctgtgtttaatatctctgaaactttggcctctgagttgaatatccccagaggataaagctaccaacacctccaaggtcagggagggttagtagcctggttttactgggtataggtagaaacctgatctgaatgactttcagtccttcccctccttcaggactatgcttggaagtcctaccttccaagttatataagcaggaacaatgtctaggaatccctgacttttgatgtgcttttcattgccttgcttttttattattgtctcttaaaaacgtatttagttttccggctctcttctttggctcagtcaacctatgatacggtttgactgtgtccccacctaaatctcatcttgaattgtagctcccataattcctacctgtcatgggagggacccgttgggaggtaattgaatcatgggggcaggtctttcctgtgctgttctcatgatagtaaataagtctcacgagatctgatagttttataaaggggagttcccctacacacgttcccttgcctgctgccatgtaagacatgtctttgcttctttgcactctgccatgattgtgaggtttctcagctatgtggaactatgagtccattaaacctctttttctttataaattacccagtctcaagtatgtctttaattagcagtgtgagaacagactaatccactatagctccctccgatttgcaccttccaaatattagttgacatctctcatgcaatataaccttattctctattgttttgtggctttataccatttagaatattttactgtcattttagcagtgtatgcaaaggagaggtgataatgcattcaatcaatcaaaggaaatgtgtatttttgttaaaaccagacaaataagaatgctgtcagattataagaacgaatttaatttgtctctaagtggcaatcgctaacacttcttgcttctctgctttcttcacacttacgtttgggttacttctttgaccctgtcccattgtcctttctttcttcaatgttttaatttacacctattattttacagagtatcaaagttagctggctgcctcctccatcaggaacacaaaatggatttattaccggctataaaattcgacacagaaagacgacccgcaggggtgagatggaaacactggagccaaacaacctctggtacctattcacaggtcagtgttcacatggtgtagtcttgcaaggttttgatgaattaaatgctttaggaataaaatatagtctcactccaaaggaacattgattttcttcctggcatccaggcaggtgacatctattggctggaacaagaacaacctttatatttttaactttacattctctataatgttttcactatatatttctctctggatcatcgtcttaatacatgtatcataaaatttttattcatactagtttctcagcattgctgattcaacaaaagcatctgttatctaaaaacttaacattttaaccagtaacttttaaaagtcatctaatgaaattgttccaatttcaatcactttgattcccctctaccaatattcaggggtgagaatgggttgaaaactgaagaaaagggtagattgtaaaacaaagagagagattattctaccttctgccaatataaagtaaattcacttatgcagcaatattgatagaattcagagtagatcaaccttctctatgaaaactggacccagtttgcatgtaaagaatatatttttttaaattttataaaataatcatgtatttaataactacaacctttaattcacaacagctcaggttcctagaaaacagaatgaggcgaggctttcaacgtaatacctttaaagttataagttcaggaaaacaagaaggagagaacaaggaaagcaatccagggaagaagagaaaacagataatggtggtacattatccatctgtggtggccacaacttcggggcaaacacagcacttgctaggtctcctgggtgtctcttgagaagccacatgaactatctcacagtccatggatagaaggtgtgagcagttgctctcttgtttctcactggttgagttcaccaacagcttactgattactctgcacctcccaggcagtccccagtgaagccagagcttctgatgactctgcagacacataggtgtctttttgtcaatcaacattttatgtgatggtggcttggcctagggtatgatcagagctcagggcttttcaaacctaggaatatcttgagctactgccagaaacttggcaagcaaagcatatagaatggctcatgacacagctgggtagatgaagttgagcgactctgaagtggcacataaactgggtcaggacaacatacaaaccataaagcacatgacttacaatttatagatgaggtaaactaccattgcaagtgagaaaaaagaaagtaatcccttatgtattccttttctctacgccagatactcagcgaatttccatttgaaatcatgactcacacacattataagcttcttgttcagcctacactcagagacttgaaagtaacttgtttatttattttttcttcttttctctcaggttgtcttttatgcctatataattttagcataatggccagagcacttccaaagtagattgccaaaaatcatgttttaaatatggacaaaatctctgaggcagggaatggttgaatctaacggaaagtttaacatttaccatatcattttaaaagattttgaaaagccaatatcctatgtttttctttttcccctgacaaaataatggggaagatggtaaaaataatcaaagtgaggaacatgtattcattaggatatttggtacaatatgacttttactttgagagaaatcaccaaaattgaaaaatcttgctaaaaatattttagtatggattctaagatttaatattagagtagaggagacactaaggataatttaatccaagctcttccagacatagagatttgaagcctcaaaactttatcatcattgcttttgcttctcaaatgataaacattgagaatataaaattaatttcttactataaaataattaactaaaggattaatattccaataaaaaagctaatgattggatgttcaattcacagaactatacgcagccaataaagatgataaaatgttcaatctcattagcaaatagagaaatgcaaattaaaataaaaatgagttagcattttcctttgattaaagtaataaagataaaaataaatgagggcatcccattctggaaagcatatgagaaatgtaaactctcatatactgcttgtgggacagaaaatgtccataacccttctggaaagcaatgtgtgtgtatgtatatatatatatatatatatatatatatatatatatatatatatatatatatgtattttatacgaggtatatacatgtgtatgtggatgtatgtctgtacatataattttcttttcataaagatatgacccaggtttccaaattctacgagtttatcctaggaagcaatcatatttttgcaaagtttttagctagatgcatattgtcatattattttaatagctaatagtgtttttgaaaacctaaatatccaactataggaagttacctagaaaactcagacacagttgtatcttggaatactatatgtctaatttaaatgaaatagtgtaaaaatgttaaatcatatgtaaattatgattatttaaaacatagtaagcaaataccccagttttaagtcagtattagtacaagagctcgtatttattaaaaaaagcattcacataaaaatatttagaataatatatatcccaaattgttgaccgtgaatattgcttactttgtaacaacagtatgatatgtatttttaattgcatatgcaaaatgaaaaacaataagttaaaaatattacaatttttgctttcaaaaattgaagatttcttcccactaatgctaactcaatatcatctgaatggcttagaaagcagtggtccagaaaacaaatgaatagtagcctcatggccagtagaatttgctagcgttaattgcttagtccttatgagttattttggcaaatggaagttaacacattcagttagtattttcaaaccaagattctgactccctaaataacacatttaggactttccctctgtttaaggtaaaatcattgaaaaaacgcagtacggcaactattagctttctcaccagcagagacccaaaacaaaataccacgaatttcgtaacttgaaagaatagacatttattctcatagttcaggaggccagaagtctgacattaaggtgttggtaggttcagctccctctgtaggctctgagaaagaacccatcccacaagtctctcctaactgctggggttaccggcagtccctggtcttccttggcttgtagatgcattgctctaatctctgcctccatctttttatactttcctctctgtgttctctcctcttccttttttatttgttttgtttttttgagacagggttttgctctcttacccaggctggagtaccgtggcatgatcatagtttactgcagacttgaccttcgggactcaagtgatcctcctgcctcggcctacggagcagctgggactataggtgtgtttcaccacacccagctaattttttaaatttttcgtagagacaaggtcttgctttgttgcccaggctggtctcaaactcttggcctcaagtcattctccctccacagcctcccaaagtgctaggattataggcataagacactgtgcctggcctctctcctcttccaattaggacattagagatagagcccacttgaaatccaggatgacttcatcttgagatcatcaactaattataactgtaaagaccctatttccaaataaggtcacatgctgatccttcagacatgcatgaattctagggggataccattcaaactactatagactcctttttaaatttttcctctcaaggacaatcattttgaattgtatcttctaataaactttacttactcaaaaataaataattcagttctacattttcattcatctaaaatatgtgtgacagttagaacttctaatcagcatgaggtaacccatcaccactctggtttattatcattccagccaaaagcaaagtgagatgaattaattagttattaggaacagctcacaaatgcccatttgcatcttcatagagctgtaagaatttggatccaaaatatgtaggctttattcatattgttacatcttgatttcatgagttataataaagcatttaggaatgcaaacaaaatatgagcagttatatgtgcgactatgcctgagatttactgcaaacatatatgtgcgtgtatatatatatatatatatatacatgtatatatacgtgtgtgtatatatatatatatatactctttctaaatttgaactaaagcaataaaaagagttaatgaacagcatcatatacttaaaatttttttgagtagctttggaaaatcgttccctcctctcccctgctctgtgactgggctacagaaacacctgttgcattgctagatattatgggaatatatgtcttcaatgctacaaaacattaaggaaccagggagcgctacatacttgtagattggctttggtttagacatgtccccaggatatatatagcacttacacactttgttgtaagcagaagtaattgattttccatataaatctacagcactgtaaaatgtaaaggatttgatcctatgattttaatgcctataagatacatggatttattgatttggctgtttaaaaaattggaaatttcagaatgctccatttgtatgttataaatattcaggtgtagatactcaaatttttttttacaatcttctatttgttagacaggtgttttttgtgtgtatgtgtttttttaatgagaataatgagacatctgcaataacaaagtaattcagagttataacaagaattgaaatcactgctatcaggtttattgtgagaacccacgtcaactaaattttaaaacgtttttaatttttgactgctcttcagggaaggttgtttgaattgaatttaagagttttcttgtgtttcatggtcaatatataataaacataataataaagatgcattgatagtttatggactgaaaaattgaaataatagcatagcaattttataacagggctaacattgggaaattgtgttgtttgaataatatgccatctcttactagaagttctaaaaattagaaatagaacataagaattacaaagcttgaggacacttagcattcaggatagaaacctgcagagataatcaactttcaacaactgaattttttacagctatgaaaagcattgctagttacaccgtactacccttacaataaaggtatacttagaagcatctaggacacacacacacacacacacacacacattgagattgaactttatgatcctgacaaacatagcaggaaacacagaattcgtctcatccaaactggttgggttttattttatttcatttatttatttattttatttatttattttttttgagatggagtttcactcttattgcccagactggagtgcaatggtgcaatctcggctcactgcaacctctgcctcccgggttcaagtgattctcctgcctcagcctcaccagtagctgggattacaggcatgcaccaccacacctggctaattttttgtatttttagtagagacgaggtttcgccattttggccaggctggtctcgaactcctgacctcaggtgatccgctctccttggcctcccaaagtgctgagattacaggcgtgagccaccgcacccggccatactgcttattttacagaagaaataactgaggtctggagggtggtatggctaaggtcctccactagttaaggagatgatcccaggtgaattgtgtgttgtctaactcctcattatgtgctcctttcactatgcgtgttgtcatctttagttcactttattgtgagtgattaaggctgttatataactttgtaaaagataattaacattaaaaacaatgtttaacatttacaacaataatacccatattattacttactgaactcaaatcattcactatgctaaaagctatatgtgtgttttccattttaatctttatgacagtttttatttatgtatccccattttatggatgagggcatggaagtaaacaaagaggcctggtttttcatggtcaaccagctaataagtaatggaatgaaaattcaaacctaatactgcctgaatagaaaacctatattcttacctcttaaactgtaaataatgtgtttctcaccgtaggcaatgcattcgtgattgtatcagtattaaaagggataggagaaaaacacaaggatggaaaaagatgtctattggacaataaaacttaaagattaccatacagtgggtagggcgcggtggctcatgcctgtaatcccagcactttgggaggccgaggcgggcggatcacgaggtcaagagatcgagaccatcctgtctaacacggtgaaaccctgtctctgctaaaaatacaaaaaaaaaaaaaaaaaaaaaaaagaaaaagaaaattagcctggtgtggtggtggcgggcgtctgtagtcccggctactcaggaggctgaggcaggagaatggcatgaatccgggaggtggggcttgcagtgagccgagattgcgccactgccctccagcctgggcgacagagccagactctgtctcaaaaaaaaaaaaaaaaaaaaaaagaaaaagaaaaagataaagattaccatacagctagaggagctgactaactctagaacatattaaataaaagctttcctggccaaattatttaaatttttaaaaatattcctattatcccagttcaggaactagatctaagataacagcttttcaaaatatacatacaaaaaaaaaagcttttaattggccggacgtggtaacttaagcctgaatcccagcattttgggagaccgaggagggcagatcaggaggtcaggagatcgagaaaccccgtctttactaaaaatacaaaaaattagccgggcgtcgtggcaggcgcctgtaatcccagctactcgggaggctgaggcgggagaatggcttgaaccggggaggcagagcttgcagtgagccgagattgtgccactgcagtccagcctgggcgacagagcaagacactgtctcaaaaaaaaaaaaaaaaagcttttaattacagactgccttctctttactccacctccaatgaaagagagagaggaagggaaagggaggggagaggagggaagggaaagggaggggaggggagggaagggaaagggaggggagggaagggaggagggagtggggagaggaagggaggagggagggaggagggaggaaggaagggaggaagaaaggaagggaagaaggaggaaagggaagaagggagggaaggaaagggtggaaaggaaggaaggaaaaaggaaggaagggagggaaggaaagaaagcaacattgaaagatcttctgatatcagctatcagagttggggcccccaaaaattgcttggtggtggttattgttggtataactctggaagataactcttttctctaatagggtatatttatttatttattattgttattattattattttgaagacagagtctcgctctgtggcccagggttgagtgcagcggcacgatctcgtctcactgcaacctccgcgtctcgggtacaagtgattctcccacctcagcctcctgaatagctgggattacagacgtgcgtcaccacgtcaggctaatttttgtatttttagtagaaacggagtttcaccatgttgaccaagctggtctggaactcccgacctcaagtgattcgcctgcctcggcctcccaaagtgctgggattacaggcttgagccaccgctcccggccgcatttctaagcaagagaacaaattaactcttcttgagactgaattttggatattactgatttcttagcttgatccactgtcaaaaataatagaatcatcaattttaacctccctacctgcctattattcaagtctgatgtagtgatcatagatagatatttcttccatgcctgcatagtgctttaaatttgttgctaatgtctctcttgggttctagcatagggcatgtgggcctttgaaggtgcccagcaagagacagaacagagtcaagattctttacccaaggatagtccaagctttaactaaaacaccataatacgttagcttaatttctctgagccttattcatgtctctaaaatgggaccaatcatgtattctgcgccaaaatcgcagggtatttgaaaaatcaagaaagtaacctggaaatcactgtgccaatgtcagttatcactacatctatgaaacgcttgattttataaatcacttttacaggcaatttttcatttgaccctcacaagaaacactataaagtggaagcatgtattattacttaatcacgttagataggaaatagctattaaaagagcctccagtacatctaaaattttcccaaacaaatcacagcatagaagcagggccacctgaaacctggaattctaaaggtaatgtccagactgcttctctgaaaagtcaaaatttctgcttctgctttatatcatgcacttacttgggtataaaaaaaggatcgcaagttaaattttcttgataaaggtttgataaaaaagttaccgaatttagaatccaaagtcttggataaacatgttttataggagaaacttaatttgtttttatcccactaggataaaactagtgcagtctatctgtaagtgatactatggtaaatcagattcagtgcaacctaaggaagaacttttctaaaaagcaaaacttgaaggtgagttatctccgttgctgaatttctcatccaacaaaagtattcctgctttatttacagggacactttgttagatattcagcattatatgagccatttgactagatattactgaagattttctttaataatgggattctatacatatctaaattttttttatacttaacctagcttttttaggtgtttgtagttagattccacagcccagcaaagttgaaggtgttttaaggataaaatataatacttcaaagacatttggcaggattttcagagtgacctgaggcactaatctctacaggatgctaaaacttccctgcagatgtaatagaaaggaagatatgaagagctcccctactgtatatggttggaagggatactctgataaatagtatagcctggccaggtgagatccctttggggaaatacttacaatacactagatggcctctaaactgctttctttttattattattataacttaagttctggaatacatgtgcaggaagtatagatttgttgcataggtatacacatgccgtggtggtttgctgcacccattaacccgtcatctacattaggtatttctcctaaagctatccctcccctagccccccactccctgacaggacctggtgtatgatgttcccctctctgtgtcaatgtgttctcattgttcaactcccacttatgagtgagaacatgtggtgtttggttttctcttcttgtgttagttcgctgaaaatgatggtttccagcttcatccatatccctgcaaaggacatgaacccatcctttttacggctgcatagtattccatggtgtatatatgccacattttctttatgcagtctatcattgatgggcatttgcattggttccaagtcttggctattgtgaatagtgctgcaataaacatacatgtgcatgtgtctttatagtagaatgatttataatcctttgggtatatacccagtaatgggatcgctgggtcaattggtatttctgattctagatccttgaggaatcgccacactgtcttccacaatggttgaactaatttacactcccaccaacagtgtaaaagcattcctatttctccacatcctctccagcatctgttgtttcctgactttttaatgatcaccattctaactgacatgagatggtatctcattgtggttttgattagcatttctctaatgaccagtgatgagctttttttttcatatattttttggccccaggaatgtcttcttttgtagtagtattgtctgttcatatccattgcccactttttgatgggattgtttgtttttttcttgtaaatttgtttaagttccttgtagattctggatattagccctttgtcagatggatagattaaaaaaatttttctcccattctgtaggttacctgttcactctgataatactttcttttgctgtgcagaagctctttagtttaattagctcccatttgtcaattttggcttttgttgccattgcttttggtgttttagtcatgaagtctttggccatgcctatgtcctaggttttcttctagggtttttatggttttaggtcttacatttaagtctttaatccatcttgagttaattttcatataaagtgtaaggaaggggtctagtttcagttttttgcatatggctagccagttttctcaacatcatttattaaatagggaatcctttccccattgcttgtttttctctagtttgtcaaagatcagatgattgtagatgtgtggtgttatttttgaggcctctgttctgttcctttgctctatatatctgttttggtaccagtaccatgctgttttgtttacggtagcttatagtatagattgaagtcaggtaggctgatgcctccagcttcgttgtttctgcttaggattatcttggctatgcaggctcttttttgaaaccatatgaaatttaaagaagtttttttttttctaattctgtgaagaaagtcgatggtagcttaacaggaatagcattgaatctataaattacttttggcagtatggttattttcatgatattgattcttcctatccatgagcatggaatgtttttccatttgtttgtgtcctttcttatttccttgagcaatggtttgtagttctccttgaagacacccttcacatcccttgtaagttgtattcctaggtattttattctctttgtagcaattgtgaatgggagttcacttatggttaggctattatcggtgtataggaatgcttgtgatttttgcacattgattttgtatcctgagactttgctgacattgcttaacagcttaaggaaatttggggctgagatgatggggttttctaaatatacaattaggtcatctgcaaacagagaccatttgacttcctttcttcctatctgaataccctttatttctttctcttgcctgattgccctggccagaatttccaatactattttgaatagggatggtgagagagggcatccttgtcttgtgccggctttcaaagggaatgcttccagcttttgcccatgcagtatattggctgtgtgtctgtcataagtagctcatattattttgagatacgttccatcaatacctagtttattgaaagtttttagcatgaagaggtgttggattttatcaaaggccttttctgcatctatggaggtaatcatgtaggttttgtctttgtgacaaaatatctcaaaatattgagataatcatatggttctgtttatgtgatggattatgtttattgatttgcatatgttgtaccagccttgcatctcagggatgaagccaacttgattatggtgaataagctttttgatatactgctggattcggtttgccagtattttattgaggattttcacattgatgttcatcagggatatcggcttgaaatttactttttttgttgtgtctctgtcaggtgttggtatcaggatgatgctggcctcataaaatgagttagagaggagtccctctttttctgttgtttggatggtttcagaaggaatggtgccagctcatcgttttacctgtggtagaattcggctataaatccatctggtcccaggctttttttggttggtaggctatttctgcatcaattccagaacttgctattgttctactcagggattcgacttcttcctggtttagtcttgcagcgggcagggggcatatgtgtccaggaatttatccatttcttctagattttctagtttatttgcatagaggtgtttatagtattctctgatggtagtttgtatttctgtgggatcagtggtgatctcccctgtatcatcttttattgtgtctatttgattattctctcttttcttctttatttgtctggctagtggtctattttgttaatcttttcaaacaatcacctcctggattcattgatttttttgaagggttttttgtgtctctatctccttcatttctgctctgatcttagttatttcttgtcttctgctagcttttgaatttgtttactcttgcttctctagttcttttcattgtgatattagggtgtcgatttgagatctttcctgctttctcctgtgggtatttagtgctataaatttccctccaaacactgctttagctgggtcccagagattgtagtatgttgtgtctttgttctcattggtttcaaagaacttatcaatatctgccttaatttctttatttacccagtaggcattcaggaccaggttgttcagtttccatgtagttgtgtggttttgagtgagtttcttaatcctcagttctaatttggttgcactgtggtctaagagactatttgttatgattttcattcttttgcctttcctgaggagtttttttacctccaattatgtggtcaattttagaataagtgcgatgtggtgctaagaagaatgtatattctgttgatttggggtggagagttctgtagatgtctgttaggtcctcttggtccagagccgagttcaagtcctgaatagccttcttaattttctgtctcattgatctgtctaatattgacagtgggtgttaaagtctctcactattattgagtgggagtcgaagtctctttgtaggtccctaagaacttgctttatgaatctgggtgctcctgtattgggtgcatatacatttaggatagttagctcttcttgtttcattgatcactttaccattatataatgcccttcttcgttgggtttttttttttttttttttgtgatctttgagaaaagcaaccccaagatacataatggtcagattcaccaaggttaaaatgaaagaaaagatgttaagggcagccagagaggaaggtcaagttatccacaaagggaagcccatcagactaatagcagatctctctgcagaaacactgcaagtccgataatagtgggggccaatattcaacattcttaaggaaaagaattggcaacccagaatttcatatccagccaaactaagtttcataagcaaagaagaaataaaagcctttacaaacaagcaaatgctgagagattttgtcaccaccaggcctgccttacaagagctcctgaaggaagcactaaatatggaaaggaaaaactggtactagccactgcaaaaacataccgaattgtaaagaccattgacaccatgaagaaactgcatcaactaatgggcaaaataaccagctagcatcatgatgacaggatcaaattcacacataataatattaacctttaatgtaagtaggctaaatgccccaattaaaatatacagactggcaaattggttaaagagtcaagacctattgatgtgctatattcaggagacccatctcacttgcagagacacacataggctcaaaataaagggctggaggaatatttaccgagaaaatggaaagaaagaagaaaaaaaagcaggggttgcaatcctaatctctgataaaacagactttaaagccacaaagatctaaattgctttctaatgataacttcaagttgttagcagactttgctttgcttaaaacaggtatatcagtcagattttcaccagagaaagaaagccagcaggaaatacatactaagaaaagtattgcaaggaattggtttaagtggttatgatggctggccaggcaattcaaaaatcactgggcaggccattaagaggggcaggctggagctctcaagctaagtccacagccatggcagggcagaagttctgcctcagggcagcctcagttctgcacttaaggtcttttatctgaatgaatctgggccatccaaatagattacggcaatatctcttagttaaagtcaactacatatggacttattcccatcgacaaaataccttcacagtaatacctcagttagtgttggattgaataactgggtgctgtagccacctaagttgatacatataactgaccatcacagaggatatttcaaatcaatcactggagacagtattgacatgattgtttattcattttaaagaaaaatgaagttaaacttctacataacgcaagagtacttttttttttttttttttttgagatggagtctcactctgtcacccaggctggagtgcagtggcatggtctctgctcactgcaagctctgcctcccgggtccatgccattctcctgcctcagcctcccgagtagctgggaccacaggcgcccaccaccactcccagctaattttttgtatctttagtagagacggggttccaccgtgttagccaggatggtctcgatctcctgactttgtgatccgcccgcctcggcctcccaaagtgctgggattacaggcatgagccaccgcgcccggccaagagtacatttttgatggattagaactttattttaaataagagcattatgaaagtcataagctgttatgagtaggtaaccatttcttctcagagttctctccctattaattttttaatttcccagaaaatctctgtaacccctctgcctctgtaatcaacaacagtgcctactaaatggtgaaaaagatgaacaaaattagatcaataccatgttaacaaatcaaagtgagcacgagcctacttaaggaatgacaaaggccttatgttggaagcatctctttgccatcttgttgatgtggttgaatgctgtatattaacctaatgttttctttatgttaagttttagttttagtggatttttcaagtattgttttgtgtgtgcatcttccctgcttcaggtactattgtgggccctatgaatatgcaattaaaacctgaataatattaataacaaagataagagcaccaatgatagtctcaatatatgtcttcatggagcttctagtctattttataaaattagaagcttctttagaggacagaaatttgtgttatagatattatgtaggtgaatttatcaaatggtctaatagtaccgtctattgaaggcaactgtttgttccttgacaataactaatcctttctaaccattatttaaaataccatctcctattagtagtaagtttgaattccccttactactaagtattcatcttcctatgcaaaaaatcttcaaatatgtaattttgtacatgagcgtaattacttttattatgcatttttttcttgacaccaaatatttgcactatttcagatgaatgggggataacagttacatttttatctttatcagcgttgtttaattccttgaggtttaaggacttgatcatttagtctgagtctcaaaaatgtcctatggtcttttcacaaatatcatttattttacaataatttatcatgttaatgagctactttcagctttttgtaagaggaaagtcacttacatcaaaaattttcatatatcagataaatgatccatgtggtctctctagtttacctatgttctctgtgcgttttgaaataagccctaatgtgatcattgtgcacaatattatgccaaaatcatcatagggattgattttctatatctcttgtgtggaagctaatgcaaaacaaaatattcttgaaagatggttttaagagacaaaagccctaatattttcttctgaagtgcattttctttggattcttgatttttggcctaaagaaaacataatcacagaccttgaatgaatgatggagacataaatttttagattgactgttcttgatttatagacgtggatcttctgaacagtaaggaaaaattatccatgtaatttttgattatttcttcatcatttatattttatattctgcatctgccctgaggctatttacatggacacatttttataaactggaaaaaaactcataagaatgtataaaaattaatttgatttcttgctatgatatttctacccttttagtcaaaataatcattaccacaacagtcacaaacaatgtaaagcatgtccactattgttacaattttgctgaagcttttggaaacccaggtaggaatacttggtgcatagtaactttcttcccccctgtggaaaattctttcataggactggagaaaggaagtcagtacagtttccaggtgtcagccatgacagtcaatggtactggaccaccttccaactggtatactgcagagactccagagaatgatctagatggtaagactttttcccagttactatcactctgattatcttcttgttatctcagcttcaaaaggtctcttaaaaaaggaatgaactccaactttggggacattgattcttactatatgttcacatgcaaaacacaacagggaaacattagtgaatacatagtcttcaacaatgccatgtaaataatgccagaccatgaatgacatagcattgattatgcaataatcatggtcctcaaaacaagttacttgttttcaagatcatctgaaataagatattttctatttattttattttgaataactgaccttaaccatttcgttcacaagaattagtgtaatttataatagtaatcatgaactataactatataatatagcttctcttgcttttttatgaggcttttgaaaaacatctatatgtatttttttacttgcttatgatattatcattaccttttcttggtataaaagacaacttactttatttgcttagctgatagttgtcctgaaacatttatcagtaggatattaggattcatataagatttatatattaataaattaaatataagcataatcctcaaaattagcaaatgagaaattgctctggaaataaaaacatcatgactaaatttttaaaataaaatttaaaatgaatgggtaatgaagtgacagaataaaacattaaataataaagcagaaatatatagaattagagttagaaatttaaaaggtaagaattcataaaaatgagaggtccttggaaaagaagtaagatatgataagtattcttaaatctaagtaatcaaaactagtgtcaattaaaggtagatgtaaagataaactcgtatgtattgaaaatgtgacagcacaagataattgcctattatatctaacaatgaaattctcttactccttaactgatacatctgaaattattccagtaaaaattgagagtaaaaactctatattcctttcttttcccttccgtttttaaatctctctttccatgtcttcctcactttaactcttttcctagttcttgtattactttctcatgtcatccttcctctttcttgaactcctccatctcattctctttctcctttgtcttcctctttttctctttttgaatacctcactatcattaatgatttttctatagccacaaatttggttttactaaaataattatggtagcattaaacaatcaacagttgatatttccataataatgttaatctctgccatgtgactgcatattaattcaaagaatgtttatagaagtcttactaagcatcaggcaccatgctgagctttgatacaataataactaagaaacacttggttcttttctcatggagcttggagaatagcaaagaaagacagacattttaggtgaagtataggaagttgccattgttgtagttaaaacctgattgggtacttgaaaactacagttcaacttaggatgggtggatggatggatggatggatggtggttggttggttggatggttggatggttggaaggttggaaggttggatagatggatggatggatagaccatcaggcaaacagacagacttgcatttaaattgagacctgaaggatgaataagaattaggtatgcaaaaatacattggcgattgaggggaaggaatagtgagtaaggtaaatgtggtttttaaagtcaagacaatgatgctgtttggggactgaaaaaggccatcaagaatgaaacacagagttggcatatgatgaagtttgtaagataagcaggttccaaatctgacaagacaaagttaagaattttaaacattgtctaaggatgtctaagtcaataacttactttgttttaagcaagtcctcaaaggttgatttaaaaaaatagtgaattaattagaattgcattttgtagagattactctggctgaagcatgcacacacaaaaaagtattctaagtaggcaaacccaggcaatgactttaagacaaccctagaggtaatataggagtttaaaaaaagtaacttgaggcttagagatattatttaacttgtcttaggttatataattgaaaagttgtggagctagaaaaagtcacatttcacagagttcatacccatcactaatagcttagaaaactttcattcatgtgtttattcaacttacatttcttattaaaggtctatatatgcaagatattaccttaggtactagagataaaacaataaataaagtctatacacccaaggagtataagttgtattcagatggaggtagatagtgataggtgctctgaagaagcatggtagaggggatagcaaggattagaaactactgctttatataaggaactgagaaaatctttctgtttagatgaaacatgaacccagactttaaggaagtgaaggggaagccatgcgaataggtcagactagagcccttcaagtagaagaaaaatcaagaacagtcatcctgaatagagcctaattggtgattgagatatatatggcaagaaggatgccaaagtcatgaggttataatttgtcttatgtaaaaaaatagaagagtggtcacaataaactatataaatagttatttttttctattttaacttatttacctaagaattaagcttcaaattttatagatttatgttttatcctttcatctacccttatgaagtatacattattagccttattttatgggagactaagttaagctatgaaaatttaactaacttaatcaagtagtcagctagcaactgtggagctcaaaattaggttttgaggccaaggcaggtggatcacttgaggtcaggagttcaagaccagcctggccaacatggtgaaaccccgtctctactaaaaatacaagaattagctgggcgtggtggtgcatacctgtaatccctgctactcaggaggctgaggcaggagaattgcttgaacccgggaggcagaggtagcagtgagccgagattgtgccactgcactccagcctgtgagacagagcaagcaagactccatctcaaaaaaaaaaaaaaaaaaaaaagttttatgctttgaggtccagtgtaggtgatcagagaaaagcctccactaatcctgtagaaatgacttgatgaccataaacacagtgattcaaggcaaacaaacgattctaagaagtgagatcacgttatttacccaaacctaaggggttatatctcttactggaaggagagaaaataaatgaagcagaggtgctgaaggtcttacaaaatatccagaatgaaacagacgctctacttgacttatgtgctctttttcctgactctgaatgagtcacaacttaagtagaaccaaaatataaagtcaccacttattagaagacacaaaatttttcatttaactccatgtttttcatatcaatgcagtctaactgtaatccaatttatacatctatttcaatcaagaatctctatgccatgctcatgagagtcttaataaatgcttttaattggatttgtttgaacttttctatgctcttggcttaataatggccctcttgtacatgcaacattccttctttttctttgggtatggttgtaattattacaaaatatggtttaagaatttaccgtgtgctgaatcatggggagtacaaacatgaaaacagcaagaacagctctattgagaaccagacagataatggctgcactgattagaaaagatttcataaaaacacgtagaacttgaactacaaacttcagagaaagggggttctgacagctaggattgtaaggaagtgtgtgtaggacagcatagaagacatttttcaaggaaatattgccttgagaaaatgatttctgccactattaattcaaaatgcatcctcactcatccaactgttactcccttaccagtcaattgtcaaaacatatttccacacaaatatcaacttttttctcattctcttatgttttcttatggatgagaattgcaaagacagtcttatcctttcctgtgatatacacataagcaatctgaaaaagataaataaaaaattaatagaagaaagacagtagaattgatacttcttgcacaaaatgctgttacacgttatgatttgagattgttcacatttagacataatgaaaactgaaagccatttcagagcatttaactgcataaatatgtgggatgtgtatgttttacttgctgtaaaaaattgataataccaaaggccttctcaatttattgatccatgatcactttcaactgtgatacttcctcaaagtgattttggtttcctttctttccttctggttttcttcttttgattgcaccattcatatattaaaaagtgtaacccttgatggaaattaatatttgaaggaatgaacaagatcaatagtggtcactggtaggtacaaaagaacattcaacctgctagtttgctctatttttaaaaagatttccttaaatattcatctcattttaatgtatttgtgtaaatgtttaaatcataaaataaggtataaatgacttgcaccaaaagtttcttggctaatgttggaaagctttgggtcctaaattttgagtcctaacactctgaagtgagaaatttccatatagaattgctttgatctcccaaaaattaaggataaggagaaaaagcaatcattttaaaccacatgaaatgggaggcattctttgctgtagctgaagatatctgtgttggaaggtaactgcatcattaggcctctctggatgcattatgttgtataacttacccccctgcttcagagcctgatggtgatcgccaagagaatgatctactcattactgcataactctgagccctgcaagtcagctaaacagaaacagtgctatttgcagattgttaaaggaaacccctgcctcctgtgacttctgtagttcctcttgccttctcaacttggcttaagcattgtgaagataactgtagcttggagaaataccccaagtcctcttggattgcccttttaattagatgttttgttaaagtaattataaaaccaaaccacattgtttgttcagcgttccctggaaagcacgttgctattactgacagctgggaagttttaaaatatttattttgtgcctcaaaatttcagcttaaaaaaaaaagcaaaccaagatcattagaattccctagggttttcatgtaaatgtcttgcataaagaaatgagagaatttgtgatagagtgatagagttcaacaaagtatccttcaagaaactgagcttggaaatctgtttatgatacttttgtttttggagtgaagaggtgaaaattgctatacgctatcaataatcatgtgatttaaaatcgactctctaccctgaagtggaggagtttagctatcaaaagtcggcagtgcagacttaagaaagtgcaacagtgatgcagcaaaaaaatgtgaatctaggagctggccctaatttcttgcccccaggaaataggtaatcagccttattaacccaaactggtaataaatgggttcgctgcaaattcatttcatttaagaattggggtaaggagtgcgatttacaccagtgagcaaaagaatgtgttcttctggtgatttcacttgatgctcatatgggatttggtgtgcacagaggagtgaaggtggcatgtcatagaatagattttctttcttgtacttttgatagggaccatttatgatattctgtgatttatgatatgctatgatttatgataattgacagataggcttggggaatttgatggaccagtggtacagtagctattccactgtgaaatttaagactcagccccttattaccattcaagtggatttcatcttacacataaggagcatagcaggcaaagcaaaaactgatttttaaaagcaatatggtatctgtttcagttccggtgcaagtggttgttcagaatctcaaagttccactgtacaaaggatggcacaggttgctttgacttagataaaagttcagtgaagttgcaagtattttacttggttataacaaactttaatgtgcccatggaatgtctgatccttctatgagttgcttgacttttttctaagtaccatgtaaaggatcaggtgggttttgcagtcttaatgactaggtttggatccagctccatttaccctatattcttgggcaaataactttcccatgccttggtttttctcatgtgtaaagagggcataacaacagtatccatcacagtgggtttttgtgagaattaactatgataatggcaacaaagtgctcaacagtgtgttgttcttctgatttttctggttttgatacataagaagatctcagactttgactgttgtgttgttgttgttgttgctgctgctgttttagacagaatctggctctgtcaccaaggctggagtgcaatggtgtgatctcggctcactgcaactttcacctctcgggttcaagtgattctcctgcctcagcctcctgagtagctatgattacaggcatccaccaccatgcttggctaatttttgtatttttagtagagacagggtttcaccacgtgggccaggctggtcttgaactcctgacctcaggtgatctgcctgcctcttgaactcctgacctcaggtgatctgcctgcctcagcctcccagagtgctgagattacaggcatgagccactgcacctggccatgactgcagttctttctgacagtaatatgaaatactcagaccattggttttatgaaacttctccttgttcatgatggtaaagctttgttgtctacatttagggaacagatgtatccatttctgttacaaaaggagagtgtacattcagtacatcttaaaagcccatcatctaattaaggtataatttaatggggcatcatataattatagcaatagattgaagagggcgttttgtggaattaggcagttttttaaaaaaatattataggaatataagcaagctttcaaaattgtattgtttttgcaaaaaactaaaacattatgccaaatggtaaaatactaaacacatttgttttaagatccaaacaagcttaaaaacttcctacaatttctgttattaaagaagatagaggttttggcaagaaaaactttaaaaattcataacattttattacaaaaggaaagaaatcttattattataaatggtgttattgaatatttgaatattacaagacactgcactaaaaacctattagagctaataagagaatttaataaggttgtatgtttcaaaaacatagcttttctttatagtagcaataattagtttaaacattgaaaagaaaggcatttataaagcaacctaaaatataatatctaggactaaatttaacaagatgtaaacaaatgtatatcataaaaaatacaacattttactaaaaactataaaagacatgagtaaatagcaagttacatatgttcctggatgaaaaaactgatcattattacattagttatttccaaatcaatgaataattttagacaattctaatcagagtaaattttaaatgattaaggattttctggggtggaaaaagaaatttatatggaagaataaatgtaaaagaatcccaagaaattttggaaaaggataataaaaacgtttactataaagcctgatttagaatcagcatagtactatctggcattggaatggacagataaatgtaacagaacatagaaacagcccctatctaggtatatttgagaaataaatataaaaataaagctagcttctcaagctgcagattagttactaaatagtgtgaaactattgccagtacttttagcagaacagaaaatgtttttcttctcttacatcaaactagttgacagtggttgattctggtgatggaactgaaggcaaaggagggtaaagtcatcacatcttatataattcaaaactggaaaggccccaggtggctgtaaggattttgtcatcattttttcttcaggtatttttaaatataacaaagatgggtgactcaaccacaagtctttttatacaattggaggttttgagctgatctttcaaagtatcatttcccttaagattgattgtattcttcactttgtgactagtaccaataatcacttgtcatccaagccaaaagcctccctatcaccctcaactccatttcactccctgtcaatatccattcaatcaccaagatctgtaatttctaccttcagaatggatttggaatccatcctcccttctccacacccaccaccacactttatgtcaggctcacatcatttgtcacctgaaagtagcctcaggtttgctatttttctggatacctgtttgctctccctcctctctagaccccatagtgttgtcagagtgattttttcagaaccagatatgacgatgtcagttcgctgctcagattcttctccatgtggtccttccctcagcctcaagtgtgacatcccatcctgcctgcctacctgcactgccctccaggttcacttcctcagctgcatcctggatcaagcctttggacttagcaagctctttacccaagtgtattttcacatatatttcacacctgcttgtcctttaaaactcactagatgttttacttctaggaagctttctcttatctgagtttcactcagatgtcttttctctaaacacattttgacactcttctcaatagacttgaaacaaagaccatgctttgtcttgaacttctcgatatttcacacagtgcctgctacatagtactcaataataagtggatgggtgaatgtaaaatattcatagctgggtatttgtgtgaaatgtgtaacacttacatagtttgattcttcactgattttcatccttacatacgaactctaatttcagataaatgagctagaaacatccattgctctctgttgtattttttcataaatgtagaatgcatcctattatgcttatatacaatatgaaaatgaaaaccctagctttctagaagacagcttggcataagattttagagttacaatggtgtttttgtttgtttgttctgagacaaaccaataggtctgtagttttgagagcatacggtttgaatccacttcaaggaaaatgagcctaaagaattcatttagcataccacttggcaaggactaagatctctgcctccccatacagaataaggtttacggtttgaatggccatggagattattcagtgtaaggtagctgatcaaatgcttcatggtagaatgatacaaagttctagtgaggttttgcaatagttgaagctggtatccttaaactctaaagtgagagaacaatccccagatattgaagggctggtgtctgcagctgctccttgaaagccacatcaagagtatttgctctaacagtcaggattaggttatctcagtatttcaggaagttggcagtgtttaaataaaaccaaacttcattgtattttctctgtattgtgttggacatgccaacctgctaccctaaatatgtatcttaactccctggtgattcttgtcaaatcaagaacttgatagacagagaccacgcttgtctaatttttgggccaaaaaagggctgaatcctatctgtaatctggaattgggattctgcagctttgctgagcaagagaaaatcaaggaagggaagaatcttgatggttttgttaggataaaccttgggcatggcattgagggtctcttccctaaaaaatactttacatttttccctctttttccttttgagttataaccaatgtgaggcaaaggcaagtgtacaaaggtgcagagaggatgtggattctggtgaattattttagcatctacgtttcttttcactaggagtaagcgtgttgatattgggaattggaggacatgggagaagaaagattctccatccttagatctaccagtttaattggcttagatttaggagacacatattttcagaattacaattcattgttgtggttttcaagaagtagagctgtcaaaactcccttttaagagtgttggctaggtattcatcgactcctgttagacttctacattctttttctatctaggcaaaaaaagtagctaaaaataaagtaaaatatgaaataataagattaggttgacacaaaactattaagataaatagaaaacacatattaaaagtaaacaaaaagacaaaatgcagttaaaaattacaaaacaatgttgaactgtaaaaacttgtggtagtaacaaaatttgtagaatagctaagagtacaaactatatgtgaaatgctacatgagcaaaaatttgttaaattgatgagtatgacacatgcataataggtctccataaagtttagtcattattaggaacaagaataaaacctatatggtttgaaaatttttaatgatacaaatcaataagtaaatattagtaggaataactgattttccattcatggaggggaaaatattaatgttcattattaaaattaataatgagagattgggggagggcttgactataaaggggcagcctaaggaaattttggcagtgatgggatttttctgtattatggcaggagtggtggataccaaaattttacccatttatcaaaacccatagagctattaccactaagtaaatgttgctgcatatatatttttaaaataaattaaaaatgaatattcccagcctgggcaacacagggagaccccatttctacaaaaattttcttttaaaaattagccaagtgtggtggtgcatgcctgtggtcctagctactcaggaggctgaggtgggaagatcacttgagtcctagaggtcagggctgtagtgagctagcattgcgctactgcgctccagcctgggtgacagagtgagaacctgtctcaaaaaaaaaaaaaaaggagaatattgacaaaatattagaaataggatggtaaaagaatacaaagtagagttcagtggtgaatagaagtggttgtccactatgataaatacacaaacagcctttaaagtttatagaggtgagcggcctaagggaagtgatgtcctttggtgagaacaggccctgtctatagaaatgaacacatttgtaagcatcagacatgcctggaaaggcagagtgtgggtatatcaattgccttatgtagtttgctgtaaagaaatataggctattgaggactagaacaaaactctaacaaaatgatccataaaatgcagcacgctaaatggaggacaaatgtgtgaatatttgtcaaaagttccaactgcctgacacaacttgacagtgccatctatagcaggcagtatgtggtggcgactgtttgcattaccaagatctggcacagacaaatcttgctgtcccctaagaggaaaacaaagtatccagtgtagagtagatggctggagtgaggtgaacgaaggcaaaatgacaggtgaagaaggtaggagataagtggagagagagagagatcatttatggccttttaggccattgtaaagaacatggcctacaatgtggtttgagaacaccttggggggttttgagcagagcaataacatgatcttaattgcagttttctatatacatgctcacactatatctgtattcatacacatttattttaaataccacatatatgctgatggcttccacatctgtgtatatctagccatgacctttcaccaaaatcccagacttacatacccaactacttccttgagatagccacaggtttgactaataggcatctcacattgaacatgacccaaggaaatctcacctgtgtttcctcatttcagttcatcaaccaacagttaccaagtcaaagacctatgggttatgattaaatctcccttttcctgcaccactcacatctactctatagctctgttaactacacattacaaatgtcctaaatctatccactttatatcatcttcacaacagccatctagacaagagcaaaagcaattttatggtctccatgtttcattctatgcttcctctccaaacttctttttcacccagaaaaatagagtgatctttcagtaatatcaatgagaccacacttcacacctccattcctgccagtcaagaccatttaagatcttctccttctacttagaataaaacctaacttcttacttatcttgacttgccttgcctatagtaacctggtctgtaagtgactcactcttttttttctgtttttgtaattgtttacaattatggaaaaatagacaaaaccttaaatttaccatcctaacaatctttaagtatacagttcagtggcattaagcacattcatgttgtcatgcagccatcaccaccacccatctccagaactcttttcatcttgcaaaagtgaagtgctgtacccattaaataataactgccaacctccccaacccccagcctctggcaaccaccattctcttttctgtctccatgaatttaacttccctgggtacctcataaaaggagatttacacagtttttgtcattttgtgattggcctatttcatttaccatatcattgccaaggctcctgcatcttgtagcgtgtctcaaaaattcaattgtttcctttttagaggccaaatactattccattatgtgtatataccacattttaaaaatgcatttatacattggtggaaactttgatttcttccaccttttggctattgtaaatgatgctgctatcaacatggatgtacaaatatttgtttgagtccctgctttcaattctttttgcatttatacttagatgaggaattgcaggatcatatgttaattctattttaaatttcttgagggacccttatatggtttctttatagcaggtatactattgtacattcctactggctgactctctttttatctttttcattctctctcttacccttgatgttccagatgtgatgatcctctttggtttctctgaataccaaactcatccctgcagtacagcatttgcagtagttgtttcctctccctacagagctcaccactctgatgtttgcttgactggccctttcaggtcatccaccttagactcaaatggggagaatttcctggatgggtcagttattgtcccatcagcatagcacttatcaagatctcacgattgtcttatttgtttattaggacttatgttttgtctttcctctcccaccactatatttttagtacctagaactacaactagtatataggagatgcatagtagttgttgaaatgtcacagggattaatataatacatgaccgagtatgctgcatgtgaacattacacattagtggaaacctgtgtaacatgtctgcattcatgttacagagaataacacgtctacatatattacatatgttacaaagaataacatgcctacatacatgttacagaaaataacatgttctttagaaccaaactataccaagagagaatccataattcaataatataatcaagagtggcaattgacctagttatttgatcattcagactctagtaaaaatttggggccttgtattagtctgttttcatgctgctgataaagacatacccgagacagggcaatttacagaagcaagaggtttaatggactcacagctccacatagctggggaggtctcacaatcacggcagaaggtgaaaggcacatctcacatggcggcagacaagagaagagaacttgtgcagggaaagtcccctttataaaaccatcagatctcaagagacttactcattatcacgataatagcacaggaaagaccgcccctgtgagttaattacctcccaacgggtacctcccacaacacgtaggaattgtgacacctacaattcaagatgagatttgggtgggaacacaaccaaaccatatcaggcttcattaatttaaatatttcaggcaaaatgtgctctttggtttcaaattaactcaataactactctactattcctctgtgcttcatatgtgcaagcagcatcttagagatacttgtaaaatgtttcatgtacttctgagcagcaaatttcagttgcagactccaagcaagtaatagtcatattatatatcttccacagcaaattttctaaattgatgttttatagttcattccagtagtaaccactttcctaatccataaggtcatctatgttagagaaaaatcactcaggtagcataaaaggaaaattgttatttctgcctttgtattaagaagtgagtgggcataaattggctatcatggattatgaacaatctcctggcgtagttatcatgatgatgaggccatatattatgaatggcttaggtctaatactaccttgaaggaactgtccttttggtcctgtgagcttaatttggtgataaagggtcattaaggctgggcatgtagactcacatcgataattccaacactttaggaggccaaggcaggtggactgcttgagtccaggagttcaagaccagcctgaacaacatagcaaaactctgtctctacaaaaacataaaaataaaataagtagatagataaatacattagctgggcgtggtggcacatgcctgtagtcccagctactagggaggttgaggtgggaggttggcttgagtcagagggttagaggctgcaatgagctttgatctcaccactgcaatccagcctgggagatagaacaagatcttgtctctctctctcaaacacacaaaactaattaggatttagatgaagaggcaacatatcttcttacgtactaacattttttttctaatgttaaaaattattttgaggcttgcctctaggattgaaacattttcatgcagtgaaggataaagtggagtcttacgttcttcaagagccagttggtgtacacattacaatgatatgtttaaagctccgatgaataaaattgtgtagttactaacttaaccaatttgcaagagaactattctatggtttgcagaaatattaagaaatagttactgttctgaaaacatttttaacagttgaacagtttttccttttattctaaaagatgttaaatattgtcattaaaatcattatgatttcatattgcttttaaaaagtcataaatgcagaagatctagtttattttcttagtgtacgattaggcagattatcttgttgttttaatagttagtgcaaacacttcaaatatgctaaacagaactgactgagagtccattacatttcaagggcactggtgagactgtggcagtagggttgaaaactattaatccatccttttcatctcttttattacttttacttagagtttatattaggaaatatttcacaaacattgtgtttctgctgttaaggcttatatccacgttttgagacataatttttttatgatgtctttgcatattatatcataggcttttttagggcagactaataatagctttccctttttgcccacaaagggccatctttgggggaaaaaaaagcatctttagaaaattctgtcgatgtggcaactttagaatcttttgaaaagctttagaatcttttgaaaatgttacctattttgaaaactttaataagaacatgcttctatctatcacttaagctagaagtgggaatgctgcatatggataaaagtggagggggctgtgccagtttttggtactacattaaggagaaaaatgtaatattacctctagtcatcagatttccttgcataatttggcatatgttaccttcagagattttctaaatcactggacacagacatttctggaacataaataatgaacagaatcactttaataaaattcaaatcactgatatttttgagtacttattaattgccaagaactgtgttaagcacttattgaagtttggatgggcacattctttcttacatatctttgcataatacttccctgattttcaaagaataggttacatgtgcttgtatttagccaatcaaaatatttaccataatctatcgtagctgcctttttacttgcctgtttctcattagactataaactccaatagtgcaggtttaatgtctgccatatttgttcttcctgtatcctgaacattacaggcacctaggctcacacctcaaacataatagttgttgtataaatatttattaattggctgggcacgatggctcaagcctgtaatcccagaactttgggaggccaaggcaggtggatcacgaggtcagaagttcaagataatcctggccaagatggtgaaaccccgtctctactaaaaatacaaaaattagccaaatgtggtggcaggcacctgtaatctcagccacttgggaggctgaggcagagaattgcttgaacccaggaggcggaggttgcagtgagccgagatcgtgccactgcactctagcctgggcgacagagtgagactccgtctcaacaaataaataaatattaattgaataatgatcagtgtccagaaaaaaatatttttttaagactaggaaacagcgaagaatgacaacataaaaatcagaacaatttattattaaaacatattaattttcaacacacaatccctttaaaagaaaatatatgtcagggtggcatgcacattctctttttaatatctagcaatatttgagaatttatttgctactcataatgggtaagtttgcatgaattatctcattaaatcttttcaacaccataccttcattctacaggtagggaactgaggcttagagaggataaatgatatctcaaaatctcacagacagtgagtatacaatacaagtttgaactctgctctttcttacttcccgagctcaagctttgagtcaatcaatatttggaatgccaacttaatcagaagggaaactcagagaagtgaaataatttcatgaggacacagagctggtaaatgacagaacgtggcattaaaccaaatttgcacaggtccaaaggttgtgaggctttaatccaggccactgtcttctttcttttaataataaatgcatttttcactgatttaataaaccatgaatcaagtaccatcctaatcatgctggacagatcatggcccttaactgtttctcctgacaattacataagaaaggactggttagtttgttattgtttttagctaaatcagagtaaataattattggataagacaacattgacattttattttccagtctattattcttacatctgccttggttttcacccttcattaatgatacctaagaagagatatgtaaaaagaaaaaaagcccaagtaagacgctattggaataaagatgcattgatgctacctaccatgcccatggaaagaactcggtattcttgtatgcttaagaaattttgtgaaagtcaaatcaaacatagaaaatatatcatatgctaaaataaagagtgacttgggcaataggtgatgcattatttatgcatctatgaaatatgatttctcttgcttaaatggtgttctgccgtgctacattttctgttatgagacatgctgatgatgcctctttttgaatgctagaatctcaagttcctgatcaaccaagctctcttcatgtgaggccccagactaactgcatcatcatgagttggactcctcccttgaacccaaacatcgtggtgcgaggttatattatcggttatggcgttgggagcccttacgctgagacagtgcgtgtggacagcaagcagcgatattattccattgagaggttaggtgagtatctgtgattttttttattctattaaggggaattaatgatttattttgaattattgtatttcttggaaaactgttccctggtatgatggtttcaacttacagcatgtattagctctgaaagcaactgtctatctacacacacacacacacacacacacacacatacacacacacacaggcacacatatacatttctttgaatttgggatttcaggaatttgatctagagagatctgtaatggcagttgctctggtgtgtgcccttgcttatgggttataggatacaaaaagtgcgttgggccatttttctttttccagtggtcaatggaaacttctgatcctaataatttctataaaaagaaagtcaacacatttttcatctttgttgttgtcactgggaaaatgttctgttaatttttctttaaccttgaaatatctagtcatagtgccttctttaccgttaacattccaaatatgaatgttaaaggctgtgtcattatgactgcaaaagaagatgaaagaaggaattttcagtcaagacaatacattagaatgataaaactccatcctgcatgtttccctgcccctaccaatctaggttctcttattgtactcaactcaacctcattttttactgaatacaatacttcagttgtgatattctgaattcattgaaaacgtgttcattcagagaggtctaatgtgtgtaaaagtgttcatattcattttagatctgatttcccatagtgctgtaggagtttgtattattaacacagagaaataaagtaaatataatatatcaggatgccagtaagttaaacaattttcataaagcaaaatgtaagttgattctacctgttgatttaataccgtattacatgaccccactggaaatgcagcttgattgggcaggcagggtgtagggggtggggggatctgctacttatttgcagtgtctctcacaaacagaacatttgtgatgagaagcctgatttgaatttgaatagctaaaatgcagtagcaagaaaagattttctcagtaaaggaagaaaattgcactgacccattctctctataattgcttcaaacactaataagagaaacacctactggaaatctccacaatttatttagcttggcgtttagaaataatattctttccatcagttcctgagtttgaatgtaaaggcaatcacaaaactcatattttatggctatcaagcctatgtcaagggactctcacttatccattattcagcatccaccatctttgacagttcatcttgatgccactcaacagacagagggagggaggtgcccatggcagtaaatggctcccaggcaatgagaatgtgctgcaaactcagaaggaagtcaggagggaaactgcattgttgaccctatcctttttctaatgattctcttcgttaccaaaaaaaacttgccagaggtctccaaatttagtcaagttgacgcatttgggagattaacgttggcaaatctccccaaatgcttaacaagaaaaacagaaaactctggaaaatatattctaaagagctaggaatatttttaaaggtaaattgggatatgaacctgtctcagtaataattatgagtttgcactctacaacttacctggaaagagtaattacatacacacatagataggtatgtaagttctactagttgatactcttttaacatagtctcatgtgttaatatgaaatacagtaattagcatgttgttgttcattaaatatcctcatggttatgcaaatgaactgctatttttccaatatgtgttttcactatttagccaaagtgtgtgtgagagacataccctaagctctaatctttataaagataaggatttattcaagtccacgttcatgctgcaaataaatcaccaattgttttatttattctattgagcattaaaatcaacacatcagtttccatagtaactttttgagaaggtatttataactttttttaatttttaaagtttttggaaggcaaagctctctagtcattacatatacataataaagaaaatgaaattttatgttttaaggactgtatgacagttatacaactaaaagtgaattaaagtaagtttaattcatttaagcatagggtcagccataacttcaagtatcatggttgtatattaaactataaaaaagctatttgttttataattgactaataaaccccttcatctatttcatgagagagcaagacttctaaacagcattttatttgcagtttagacaccagacactgtgatcagcttcaggactggaaatacaagaacattttgagtaatatctaatattacctaattaaaagcaaacaaacaacttgcctgctataggcatagagcttcattaatcaatgactattaaatatttataattaatctattgacattttactccttttagttcaagagccctagtgccagacttgaagtatgatatagacccaaaattaatttgaaaccaaaccacttttaaaactcactatctacctaccaattgatctatttatctatcaatttatctatctttatatctttattcagatattatttatatacagtacattgtgtacattaaaagtgtactttttggcatttttaaaagagcattattgaggtataatatttgtttaataaagtatatctttataatttctctaatttatctcagtaatattttatagtttcaaatgtaaaggtcttcaatgtttatgttaaacttattcctaaatacatatgtatatgtaggaatatacatatattagaaatacccaaatatatatatatatatatggatataaatacatatatatttggatatatatatttgaatatatgaacatatatttaggactgtttaaattatgcatatatatttgaatattcctaaatatatatacatatgtatattatatatatttgaattattttaaatagaactgtttttaaaatttattttaaataaatttttactatagtggatttatagatgtattatataatgtatatatagatgtattgtggtatttataaatgtgtagaatacaagagattttttaatgctaaccttgtatcctaatatctgctaaatttacctatatattccattagttttttagattatctaaaattttctgtttaatcaaacatatctatgtgaacagaaagttttatatttagtttctgatctctgtcccttttatttctttctgttgccttatttcagtgattaggatctgtagtaaaatactggataaaagtgctgaaagcaggtatctttcctttgtgtctgatcttaggagaaaaaaatttagtctttaccatgaaataggttattacctctggtctctttaagccttttgtgagattaaagaaatgctatactctttctagttttctagaaattctggtcatgaatatttgttgaattttattagataactttctatcttttgaaatgaactttttttttctttttttaaaatacggtgaattacattgattgatttttgaagggtaaccaaccttgaatttcctatataaatcctgtgtggccatcatgtattatccttttcttatgttgtttaatttgatttgttaatgcttattaaggattttttgtgcctatattcagtaggttatatatttgtctacaattttcttttcctatagtgtctatatactgtttctcttttactccagttagattggctcataaaatgagctggatagtatttactccccttctgttacagaaaatttgtgtaaaatggattttatttatttcttaagtattttatagatttcactaatgaaatcatctggacctgagattttttttataggaaggctttgataatagatttaattttttatacagatataggtctgatttgcaaactttcttgtattgattttgctaagttaaatttttaataaaatccatccatttcattttgtctcttgttggcacagttattcataatgttttctttatctgttatctatggttattaactgatttttcatttctcatattggtcttttcttgttcctgtcttttttttgtgatatctagacagagatttactaattttgttgatcttgtcaaagaaagagcctttgacattactaacttttctattatctatctattttatttctttcatttctactgttatcttgactacttccctcctgatacttattttagttctggtcttctcttctatttctaatttattgacatatgaactttataatgtatacatccattgttgttcctctaggtatcattttacttgcattccacaaattttgatatgttgtatttttattaccatttagttcaaagcatttcctaattttcctgtgatgtgttattctccctaagttatttagcaaggtgttacttaattttcaaattttgggattttcctagttatcttgttattattggttttcttttctttcttttcgtttttcttttttttttttttttttttgagccacagtctcactttgttgcccaggctggagtgcagtggtgtgatcttggctcacttctacctctgcctcccaggttcaagcaatctcctgcctcagcttcccaagtagctgggattacaagcgtgcgccatcgtgcctggctaatttttgtatttttagtggagacggggttgcacaatcttgtccatgctggtcttgaactcctgatgtcatgatccatccacctcagcctctcaagtgctgggactgcaggtatgaaccaccacacccagcctaaatttgagttattaatagcactttagcaatatgtctgatattgcatattgcagtaagattatattgcatattgcagtgaggttgcagtgagccaagatcttgcctttgcactccagcctgggtgacagagcaagactctgtcttggaaaaaaaaaaaaaaggaaagaaaagaaaagaaatatgtcttataagagatcagctgactttttctataatggaccagagactaaatactttaggcttcacagaccatataatagtctctgtcaccactcctcaactctgctattagagcatgaaagcagccaaagacaatacatacacaaataaacatagctgtgtcctaataaaactttatttgtggacccaagaatccataatttaatataatttttatatattataaacttttatatgttataaaattctgtcttttttaattttagcaactatttaaatatataaaaaccattattaactcatggtctatacaaaaacagtggcccctcaactataatttactgattcctgctcttagtgattgctctaggagataccatatatgtatttaatctttcccactttatttaggctaacattgtagcacatcatataaaacatagaaacctgcaactgcacaggtctctttatcatatggactattccttttgttgtaattgtcatatgtattacatgtacatgcattgaaaatcccattagacagtcttatatatttattgtattatgcagtcatgattttttttaagacataaggggaaactatgatgttttctatttacccagatatatgacatttcttatgcttttcatttgtacctgaagatgaagttcttatccaatgttatttccctttagattgaaaatcttcctttaccatttctttgtagttcagtcaggtggcaacaacttttcttcgttttgctttatctgaaaatatcttaattctactttttttttctgaaggatattttcactggatatagaattccgcattgacagattttttttttctttcctccagttctttcaagttgttgtctctctgtattcttgactctatggtttttgatgaaaaaccattagagttttagaccattgcaatttaatgtaattatacatatggttgaattttatttttgtttactgtttgtcagattgcttttttgtgtccctgttttccctttcctgacttcttttggattatttgaatttttttgttttaagttttattattattattattttttcctgagatgacatgtggttctgttggccaggttggagtacagtggagctctcatggctcactgcagccttgacctcccaggctcaagtaatcctgctgcctcagcctcctaagtagctaggaaaacaggcatgtgtcaacatgacattcaaaatgttgttaacctgtagtaatatatacttttttatttttttgctgggtgcttttaagacttctttaaaatatttgatttccagcagctagattatattatatagaggcatagtcattttttactatatcttgcctgtgtgttttatgcttattaaatctgtaaatttatgatttcaccaattttggtcattttgtcttcaaatatttttccccactattcaccacattccctctgagactataattatatgtattttagacatttgaattttatcttatacattctcacaactgtgatgttttctttcgttttttaacctttttactcttttcttgatattgagtgatttatcctgttctattatcatgcttactgataaattccttcattacctctatctcattgttaggctcatatggtaaaggtcattatattttaaaacattgtcctctttttaatattacaatctccatttttttctacattttctactactctgttgagattttctatactccttgcaagtatactttacctctgagagcatagttataaaagttactttagcatgtttctctgataatttcaacatctgcaccatttgggttgggcatctatttgctttttcacttgagaatggactatatttaccatttttttggtatgttgtataattttagactatatgttaggcattgtcaatgttaagttgtagaatctgagttttattacaatccttgaaaattttttgatatattggttttagaaggcaatcaacagttagattcagattgtgagatctatcttgctttctcttcacagcaattaaaatcttggttaagtttcccaaggctttgctctgctgttagtgtttaggctgagacttaggcaagttttaactcagaatcagaacatctctatctccagaactcctttttgtatactttttgtaaactgtttccctcatcccctgaaactactttcagtgattcttctggcacaaagtggtgagggtttctactggagtgacagctgacagtactggggtgctttccatactgcaaaattttcttggagcaaaacagaaaactaattccaacgctggtcgcttcatcaagatcttacttaattccaaaatccgcctagttttgtaaaatactcagacctcatatagttgggattttggtttttggggggattgttttgtatcttgtttagagccagtggctgttatcagtgagatggatgagccaaaaagagcttacaccatcagagaataattggaaactcacagtcccattttaaatatttttgggcagctgttattgtgaacattcttgataaaaataagatgacttcctgggcagtgtatttaacatctgaattacatttggcactatcgcacttatttactaacaacatgtgttagaggaactaaaaatgactctgaaatatataacttagttgctatattagtctgttttcatgctgctaataaagacatacttgagactgtgcaatttacaaaagaaagaggtttaattggacttacagttccatgtggctggggaagcatcacaattatggcagaaggcaaggagaagcaagtcacatcttacatagagggcaacaggcaaaaagagagcttgtgcagagaaacgcccctttaaaaaaccatgagatctcatgaggctcattcactatcataagaacagtgcaggaaagacctgttcctataattcagccacctcccactagattcctcctacaacatgtgagaattgttggagttacaattcaagatgagatttgggtggggacacagcgaaaccatatcattctgcccctggcccctcccaaatcatatgtcctcacatttcaaaaccaaacatgccttcccagcagtcccccaaagtcttatttcagcattaactcaaaagtccacagtccaatgtctcatctgacacgaaggaagtccctttcgcctatgatcctgtaaaatcaaaaccaagttaattatttcctagatacaatgcagggacagacatcgggtaaatacagccattccaaatgggagaaattggccaaaacaaagggctataggccccatgaaagtccaaagtccagagggacagtcaaatcttaaagctccaaaatgatctcctttgactccatgtctcatatccaggtcacactgatgcaagacgtgggttcccatcttcttgggaagctccactcctgtggttttgcagggcacagcctccctcctggctgcttttataggctggcattgagtgtctgtggcttttccaaatgcacactacaagctgtcagtggatctagcattctggggtctggaggacagtggccctcttctgatagctccactaggcagtgccccagtagggactctgtatgggggctctgatcccacattttccttctgcactgccctagcagaggttctccactgccagaaacttctgcctggacatccaggttcccaaaccccaattcttgacttctgtgcactggcaggctcaacactacatggaagctgccaagacttgaggcttacacccactgaaaccatggccctatctctacattggcacctttcagtcatggcaggagtggctggaacacaaggcaccaagtccctaggctgtacacagcacagggaccctgggcccagcccacagaaccactttttcctctgaggcatccaggcctgtcatgggaggggctgcactgaagacctctgaccagccctggagacattttctccattgtgttggtgattaatatttggctccttgttacttatgcaactttctgcagctggtttgaatttctcctcagaaaaatcggattttctttgctatcacattgtctggctgcaaattttgcaaacttttatgctttggttcccttataaaactggatgcctttaatggcaccaaagtcacctcttgaatgctttgctgctgagaaatttattccgctagataccccaaatcatctccctcaagttgaaagttccacagatctctagggcaggggcagatgccaccagtctctttgccaaaatataacaagagtcacctttgctccagttcccaacaagttcctcatttccatctgagaccacctcagcctggactttattgttcatatcgctatcagccttttgggcaaagccattcaacaagtctctaggaagttccaaacgtttccacattgtcctatcttcttctgagccctccacactgtttcaacctctgcctgttacccagttccgaagtcacttcccacattttcaggtatcttttcagcaacctccaactcctggtaccaatttactatgttagtctattttcacactgcttgtaagacatacccaagactgggcaatttacaaaagaaaggggtttaattggacttacagttccatgtggctggggaaacctcacaatcatagctgaaggcaaggaagagcaaatcacaacctacatgactggcagcaggccaaaagagagcttgtgcatagaaactcccttttttaaaaccatcaaatctcatgagactcattcactatcacgagagcaatgcaggaaagtcctgcccccttaattcaatcaccacaaaccaggttcctcccatgacgtgggaattgtgggagttacaagtcaagatgagatttgggcggggacacagccaaaccatgtcagttgcaaaaatagaattttaaagcaatcttctcactaaagttgaacttctgactagtaattttaaaaaactgaatttggcttaggcagttaaataatcattttataaagtatagtgttcaacttcttaaacaatggaaaagataaaaagtaacataaaatacatttacaattcatgagaatcagaaaaaaaacagattatatataaatatacagacacagccattgtttttccaactgatattaaacaaacatggcaaatattcctgtgaggatttatgttcttccaattctaattagtccatgtaaaactatcatgtcttaaggaaaatgaatcgaactcgttcaccgccattgatgtggattaacaaagatgtatcgggaattaagttcttagaatttagcattgccatagaaaggaagactatacaattaaaacttttagggttttacatctgttactcctgaaatattttaaccatagtacataaataacataggttatttccatgaatactcaattgtaatttccttttattcttatcatcctttcagtgatgcttactagaagacattgtcttagtagactagcaatttaaaaacataagctaagcatacaaaaaagtaaataaatatggaattaagtggaactcttaatctgagtgtagatccatattttttgcctctccataatgtttaatactggaaaagttttttgagctctggctttgtaatagctcagtaaaaatagaaaacaaaagatgcttttagtccctgtatcatggtatcagagggttaacagattttgaaaaaagtcactagaagttggaaagttggtaattcaagagctgtaaatgtcaaactttatattgtggtcattgcaataatatgaaaatttaattagtattaatttaaaaatctaaaccacacagtgatgctcagtttgatgtgaaagacaaaaacagaaattcctagttttaactataatattctgattagaaaatcttgactgacagaattacattcattcaacatgagtactacttgctcagagagaagtgagcggggataagaaaaggtcactccatgagatcattactcagagtatatcaggaagaatggattttctcttttatgatttttttttgagatgagtgtcttctaaacctatagctgttttcaagaagtctttaaggatagccacagggtgattcattaataatacatactattctatttgtaactgttttcttactttctactccctgaggtccaaagcacaggaattgtcttatacctggtgaattttctaaagctatttggaaaaactccattacaaaagatactagtattgtatattagcattgaacaggagaagaaaagatcttctcattgagtacagtatatatatatatatatatatatacactgtatatatatatacagtgtatatatatatacacagtatatatatatactgtatatatatatacagtatatatatatacagtgtatatatatatatatacacactgtgtatatatatatacagtgtatatatatatatacacagtgtgtatatatatatatatatatatatagtgtgtatatatatatatatataattggaatatatgtgtcattggaaatctccaaatagaggtgtcttcatcattttccttttgttaaaataacactttcacattttattttgtattttataatctgagttgttatttgtaaaacaaaccggtgaagtattatgtaggtcattcattctaccaacattaaattcaagcattcaaagaataaaaataattttcttcatcatctctgtttttcaagaaaatgttttatctgagtcagaatagcttagatctcattcttaattcctcacgtcagtgtttacagacagcaacttgctgtgtttcttctaagcacttcagaaataacaaatctatttcttcatccccctcactatgtcaggtattatcccaattttaaaaattaggtaagacagagaaataactaagtaaataggaaaagcccaagctattttgttaaattttttcaaagttaaatgttactttaacaccatcagataaatattgtaataaacagtaaagacttgactcattagtataaagaaaggagcctggtatcaaatcaaaatctgatcagaacttgcagatagagcactctattgcaggaaaatccctctttctatagggaaaaacaaggtattttagcaaaattaaatatcttcaattcaccaacaaaataatataatccagctacataggacacagcctaaagtttctgattaaatacaagtgatagattcagtacaagtgccagagtttaatcatagaggtatttattatttgttctgtgagctggattcatagccaacttggaggaaagagacagaaaagcaaatgctgtatctgggcattttcctttattaaacaattgatttgtgtgtttttccttttaattctatcagatgcataattatttaggattgttatgtcttgttgatgaatactttatcatttatgaactatcccttttcactagtgatactattgtttactctgaaatctattttgatgttagtgcatccactccagactatacatttttggcttttgttagcattatacatatcatgctataatgggtacatatattcattattttactttaaaactatgtgtgtttttataattacagtgggttttttgttggcagcacacacttggagttttcatcatatccaatctgtcaatctctgacttttaatcaaagtgtttagaccatttacatttaatgtgaatatagatctggtttagtttataactgctatcctgctattcatgttttatgtatttcatctgttgtcccacctttgtatatgtgtatgtgtgtgtgaatttttttctaagtttctgcatttttatttaatatttttaatcattcatcttacactctttctggactcattagctataactgttttgcttcttcagtggttgctttaaaatttatattatatatcttgaccttaccattattgaccttaagtaaatactataccacttaataatacatggttgttattacatttaaagtggggtggtttgaaagagttttattagagtggagaaaataatatgtgagttcgagactggcctgaccaacatggagaaatctcgtttctactaaaaatacaaaattagccagatgtggtgacacatgcctgtaatctcagctactcaggaggctgaggcaggaatcacttgaacccagaggcagaggttgcagtaagccgagatcacgccattgcactccagcatgggcaacaagagtgaaactccacttgagaggaaaaaaaaaaaaaggtatttgataaaatataggagccaattctatttttttaaaaaaactataaaacccaccaacgttatattcaacaagaaaatgctaaagctatttcattaaaacctgagctaagacaaaaatagataaataaatatcctttaaaggttaaaaaaataacgtattgtctaactacacagttagcaattttggtgctcttcagtccttcttgttattttagatatttaactggtgtcatttttttttacatcttgaaggacttctttaatgttaaatatttcttgtaacatcattgtgctggtgattaattttccatctttgttatgtgtgaaaaagttttaagtttgctattaaaacttattttcactggtcatagaattctaggttgataaattattttctttctgtatttttaaggatgttccaccattatttcatatattaccttgtttccaacaaaactattgcacttgttctttttttttatttttattatactttaagttctagggtacatgtgcacaacgtgcaggtttgttacatatgtatacatgtgccatgttggtgtgctgcacccattaacttgtcatttacattacgtatctctcctaatgctatccctcccccgacctcacgacaggccccggtgtgtgatgttccccttcctgtgtccaagtgttctcgttgttcaattcccacctatgagtgagaacatgcggtgtttggttttctgtccttgcgatagtttgctgagaatgatggtttccagtttcatccatgtccctacaaaggacatgaactcacccttttttatggctgcatagtatcccatggtgtatatgtgccacattttcttaatccattctatcattgatggacatttgggttggttccaagtctttgctattgtgaatagtgccataataaacatacgtgtgcatgtgtctttatagcagcatgctttataatcctttgggtatatacccagtaatgggatggctgagtcaaatggtatttctagttctagatccctgaggaatcgccacactgtcttccacaatggttgaactcatttacagtcccaccaacagtgtaaaagtgttcctatttctccacatcctctccagcatctgttgtttcctgactttttaatgctcgccattctaactggtgtgagatggtatctcattgtggttttgatttgcatttctctgatggccagtgatgatgagcatttcttcatgtgtctgttggctgcataaatgtcttcttttgagaagtgtctgttcatatccttcgcccactttttgatgggcttctttgtttttttcttgtaaatttaagttctttgtacattctggatattagcccttttcagatgagtagattgcaaaaattttctcccattctgtaggttgcctgttcactctgatggtagtttcttttgctgtgcagaagctctttagtttaattagattccatttgtcaattttggcttttgttgccaatggggttttctaactaaaacttttggtgttttagacatgaagtccttgcccatgcctatgtcctgaatggtattgcctaggttttcttctaggtttttatggttttaggtctaatatttaagtctttaatccatcttgaattaatttttgtataaggtgtaaggaagggatccggtttcagctttctacatatggctagccagttttcccagcaccatttattaaatagggaatcctttccccatttcttgtttttgtcaggtttgtctaagatcagatggttgtagatgtgtggtattatttctgagggctctgttctgttccattgatctatatctctgttttggtaccagtaccaggctgttttggttactgtaggcttgtagtatagtttgaagtcaggtagcatgatgcttccagctttgttcttttggcttaggattgacttggcaatgcgggctcttttttggttccatatgaaccttaaagtaggtttttccaattcttgaaaaaagtcattggtagcttgatggagatggcattgaatctataaattaccttgggcagtatgaccattttcaggatattgattcttcctatccatgagcatggaacgttcttccatttgtttgtgtcctcttttattttgctgagcagtggtttgtagttctccttgaagaggtccttcacatcccttgtaagttgtattcctaggtatttcattctctttgaagcaattgtgaatgggagttcactcatgatttggttctctgtctgttattagtgtataagaatgctcgcgatttttgcacgttgattttgtatcctgagactttgctgaagttgcttatcagcttaaggagatttggggctgagacaatggggttttctaactataaaatcatgtcatctgtgaacagggacagtttgacttcctcttttcctaattgaataccctttatttctttctcctgcctggcactcgttcttatttttgtaccactgcctctgcacataatatgatttttatttctcactgctttgaagaattatgtccttgtcatggattttatacaattttatttttatatactggtatagttttcattatgcttcttctgattgggaattgttgagatacttcatcaaatttaggagttttcagttattatttcttcacatagtttttctttctcccaatatcactgttctcaactcagaactgcaattaaacagataccttattttattttattcacttatttatttttttgagacagggtctcactctgtcacccaggctggagtgcggtggtgtgatcatggctcactgcagcctcaaattcctgggctcaagcaattctgctgccttagcttcccaaagtgctaggatttccagtgtgagctatgcacatgctgtaccactcagtctctcctctaccttcttgaatatatagaatacagtcataataacactttcattgttcatgtctacaaattattttatctgtctcatttccaggtctgtttctatttattatgtttttttcttcattatgagttgtattttctggtttttatgtttttattttgttgggtgctagagatgttcgtgtttttaaaatattcttgcattttgttctaacatgcagttatgttactttgaaatacatcaacaccttttaggtttgcttttagtctattagatgttactagagtactggggatagtttgtgccactactgagacaataccacctgagtacccaaatttctatgagttacatggttgtccatctggccggatggagtcctgactcagcaccaaagatgtttaactttgttactattgaatggttttgtcctcagccttgggaagtgtcctcatacacatgcactgataagtactcagatgatgacttaagagggacaaaatatctgtagacctccagagctctcctgagaatttctgttctctgtggtattcttccccatcaaactcttgctgctttaagtcacatcagactttcaactttgtgtcttcaatttagggaaactgctaggctgggctccttctgagttgctcttttctcttttgcagcctggaaactttccatataatcagataaagaaatcaaagtgctcactttatttttcttctcttagaagtcgctgaagtgatcttcttcatatccaaagtctcaaaattactgttttacatattttgtctgtttgctttttaagttgatccaggcaagcgggatacatccactccctattaatccattttgaccagaagttggagttctttaataagtgattaaacaatcattttatgatttcagtatgccaaaacttttagctttttaaaggtaccaaaaatgccaaactgcattatatctatttcctgatttctgccacaaatctcatcaagaatgaatcctaactgtcatattgtatttttagagggtaaatttaacctgagtgcttttagaaataggtcttttatcctgtggagaaatgaacctttataactcccagagtgcattctaagttcagtgaattcaatgtaaattacaatgttaacttcagcatctccccccatcaaaaaatcccttcatgcatggaatacagaagttttaagtttatgaaatgcaaacatttaaaattggaaaaatcaatgcactttagccgactcaagaatagctgacatacatgaataaaaaatgaataagtaccatgtagagaacatttattattttgaaacaaagtgcatcataagtattggttaacaaaattctgctttgtattttttgaagcagtttaagaagaattatgtagaatgatgtttgacctaaaatttagaaagcctgatcacaaagacctcactgaaagaagtcatttaatggtaaatgaaattagaaaggagggtagatttattccctgctttttcccaaagtatcttactgagagcatttatgtacagtgcagcaatagtgaacacggacttcagctgcatttcagactgcgggatcagaatagttcattgaaaattcatattgtgtgctgtataagccattctagaaggaaattcatttaccttgatattattttataatttcacgattcacacagagaatccctgcttattcttaagctaataacagtaatttctgagaatataattttattcctagagttttaatgtgtgggctctaaaatggagttttatctcaaatttgattgtaaatgcttcttatttatgttgtttattatttctgtgtgccaatagtttgtccaattactatattctaaatgtgagtagaatatggaatctaatgaatccaaagaaaaatatatcttgtttttttagctttcataaatgctttgaaattcagtttagtgtgtttcggtgcttttattttataaatgtagatgaattcagtataatataatgcattattatctgagttacagttttcttttcaaatgttcttgatcatttagttgacattaatcaaaacactaaatgagtaaattttccatatggcaggcagttgtttacttacaaaaaaaatttcttgtaatagatagtaggcttaaagaccaaatgatttattatttcttaccaaaattattttataaaatggcttattgagtcactttaagcataagaaaccatatttaggaacgtggaggatactaagaaatgtaagacatattctctctctcttttttttttttttttttttttgcgacagagtctggctctgttgcccaggcatggtctcggctcactgcaacctctgccttccaggttcaaccgattctcctgcctcagcctcccaagtagctgggattacaggtgcctgccaccacaccaggctaaatttttgtatttttagtaaagatgaggtttcaccatgttggccaggctggtctcaaactcctgacctcgtgatctgcccacctcagcctctcaaagtcatgggactacaggcgtgagccaccacacccagccataagacatattatctaacatattctaggctaccaaagacctatgtaataaatataagattatttcatgaaaagaataagtgtggtcacatagtttctataagaccagtgattgcattagtagtttgaaagtttactttggtatgaggttgttagaagatttttcctagaaatgttgggtggagaattttgacttaaagataaagtaagattcatcctcatgggacgatatgttatgtactgtgtataagactgcagagtcaaggaaaagcaaaagaggctcaaggttcagtgaacaaactaattgaaccatgaatgcaagttcatataagagagttgcaggagttataaatagagagataacttgagtgcaggttttggaggttcaaaaattgtgacccatgatattcttggatttttctcttaccaaattattccaagagtccatgctgtatatttaacagccattttgctgcagtactgaatcacaaatactggggacttgcgtgcaagtcattaattaagctagttagacttacctgtcacctaccctttattatctttcttatgcttttttgtttgttttagccttctcttctcatttttcacatatctatttttatgagaaaaaaatattctccactgttaaaactcctggtaaaacaagaatccagagttaaaagagaagctgcagctacattgtagttgtatttgaatagactaagcctttctaagatgcagtttattaataggagatattagttactcattattttctgaaaaaatgtgaataattattgttaaatgcctcttcccctcttcacaatgtctgctctaaagaatgagccatgaaaaggaaagatgattaatctgttattatttaattaatcctagttagccctaggaagttctgccctacctcttggtctctttctttaaatccagaattcctcaaggagaagccccttctagttttataatgacatccagagcctaatttctgatgctcttactttggagaaccctgactcagtacccatttcagtgacccctgacttatccatcttcgaggcttgtatcccatcttcttctgcataatatcatttcctgtatctgtgtggctcagaatgatatgaatcctgttcccttcttaggactagtcatgtccgggcatttaaattgttttgagggtgctgggagaagagcaagatttgggccagatagttaagatttatatataattaatatttatatagttcataatttaaagaaattaacctttaaaagtggcaaatcactttataagatagtttctgtaagaattttttgtttattaggtattgtgtgtttgtgtgttttaatcagtactttgttagacaaatgtggaaaataagatactgtatatcttatatatactagtcatgtgactggtacagatatatttggcaagttaaagacagcaatagaatagagttgattacttctagcaatgtctattctgaaacattatcagttaatcagatagattattcatatgtgagttatttacatattttatttagttagcataatcatttgagagaggtgagtgggtatatacagcccaattcttagaaaagtcttttaatcatacttagaaatattatatgttgtctcaaattttgttcattcaataggaatgacatttccctaaactaggcatttactgtctcattgaaatgagaaaaaaaagtggccatacagttcataaatagcatgctataaatcatttaaaaaatagaagcttgtatgtctaaagctccattgtaaattaacttgtataaatgagaagtgcaaacagaactacaataaagcaggcctttacacccttacacgtcattatgtcatttgtcatgtctttcattaggacaggttaaatctttgtgccgatagcatagaatattactgaaaagtcatagtgttatgacataagggatcattttcttctacaagcatttaggggaaagtcaacatagcctccttcataattagcagagaagtgacattttagaaattttttatttctgagatgcttctttaaaaggtgtactggtttgaaggggagcctctaagacggtatgtgcatgttctaacctccagaacctgtgactgtgaccttagatggaaaaggggtcttagcagatgtcaataagttaaggaagtctagatgagatcatccttattaatcaggtgggccctaaatcccatgatgtgtccatataagaggcacatggtggagagatacaagaggagaaggtcatgtgaacacagacacagagatgggaatgatacagtgacaaggaattaggatccagaaaaggcaaaaaaggatcctctcataggccttcagggaccgtgcggccctgctgacacctcagttttggacgtttggacttcagaactgtgaagaaacgatttttgttgtttaagtttgtgtatttgttatggcagctctagaaaatcaatacaaaaccgtagttgttggactttcccccccaatctcctaaacattgttttttaatttctgaaccagcatttcctacttaataaagcagcataactaacaaatatatttttaatgaaaacttgagaaataatttaacacaacactattggagaaagaaagcattagagtgacagggaatgatcacattagaagactctaggcagtgaagttggatgaataagatggttttacctttttagtcaaagggaatattacctcagctatccgaaagaactgtgtcagtcaattgttggccagtcaaacacatctcttatgttagtgtacagcagatacaaattagaaacaataccaatttcaaattcatcctatctaccttttttgtaatgtggcaaggtttttgctttccagaaagaagcagaaaataaatgtgaatggaatacaatgaatactgcataattttttcttgttaagagaaaagcatatttacagcaaagaaattatgtattttttttaaatgtagagcctggaattttaaacacaagagtaaaagtagatgatttttctttatgataatctagttcgcaaggcttgcacaacaatcatttctgagcagacattagggaattctataaaagtattggacaaaacagtacttatggaaagcttgaagaaatggggcagaaaggtgattattttcttttatatttggccctcttcttatcattatctttttctaatatgttacttcatgatggtaatgatacaataataattaaattctcaactgttactttctattttctcaagtctcttacattattgccataccatcttttattatttgaacttgcagtaaaactttggggacgattattttgatcacaactgtaggacttgtgcctctgttgaatcacatacagaaatcaaaagcatggataaatattttgtcaaataaaatttatttaaagaatatttggtaatgagtgacaaatgtttgcaactctgggtaataatagagttatgtgtccattttttcttttggtacatttttcacttatctgaatgggagccggaagtgctttaaagtttcagaatgcaagtgcatgcattgcagtgatttttctgttgttggtcaagttacttaaacgctgtgtcctgctttcctccatctgtcgaaggaacataatggccactcatggccttcacaagaaaaagtgtaggaagagaaaacagatcttgtcagtgtggggtggaggatgaagttatttttaaagcaagtatcttgtaccttcaggaagcaaaatctggcttaaggtatttttttttcttcttttctgaataggctatcatcatcaacattttaaactgctttttaatgtgaagactatacttttgttttctgtgagttatattttattattagacattgaggagaaaacaagaagggacccttccaccgccttacaaatagtgttcactaaaagaagtagatattattacttacgctgctgtattatctacacctaggaaacacacttaatacatgcattatgaacaatggaaggcttgcatggcccataataatggtaatgaataacacttattgaacatttactctgtgccaactctatgtattgtctatgctctgtctcctttgctcctcacaatgtacctaaaaggagggtgttctgattgacgccatcttacaatgcattaacaccaattacttcaagttaaactgaggcttagaaggtttaagggacttgtaccaaatcccttagctagttaagtgatagaaccaggactcaaacagcctgactcaaaagcattccttacccactgggctgtgttacattaggtgacgtacctttcacatgctctctcttgaaaggcaaatacagctttgaaaaatatctagcaagtggagccaattctgctgaaattctatagcaattttctcctgtctgtcatttcttcactggcatttagcatctgaaaaattcttcagagattttcttttctctaaaattacagaagtttaaaattaaagcaagcacaatattaactagtttccaaaaatgaaagttctaaccagctttttgaaagtttgtgataaaagataatatattcttacagtcatactcagaagaataaaggtatgcaagggacagagtggtcagtgaatgtgctcatgtgggagctgcgttcttttataactctccattctctcccgtggccctctctcttcctcaccggcatagacatttacacacacatatggtcgctttgaacttctcccacaggcttctttgtccactgccatttctatatgttttcttcccagataaattccctacctcagctctccagagtctcccatagtattgacagaatgtgtacgatttgttttaggtttttcaaatatattgaattgagtagtagtgacttgtaccacaacttttaagtagaatgatttagtctctctgaaaacaagttgcctcctttccaagtatgagtcttcagtgttttgcctggcttcactgagagtcagtgagcagactaaggtttgaatattactatccatgagatacataccagaggtgcaaaaatcataataaatgttcaagatcattaacgttataataacaacaaaatagatttacttggataagtctgttaagttaattagagttattggagcattaatgtgtttggagtttaatgccataaatcagcaattcaatcaatatgtatcaagtgccaaagaggaaatcactattgccaattatggttgaatagaaagagccgtacacttggaataaaaattgtaacctagtatctggtccttctttttattatctgggagatcattgacacataatagactctctccagtcctcaatttccacaccgtcaaattagggatggaaataagatttcttgaggttgttacaaagattaaataggtaaagtatataaaagaacttaatatttctatttttttttcttttttcataattagcaggaaattgcccctgtttttttcagggaaacatagctgcaaagtcaactgggaaatgtagtctaattctaccataacattggcccagcaaatttttatggattttctcatgagaaagaaatgaagtatgatcagagagagaacactgtgagtttctggcactatattcaccatagtacaaaatgcaaaatgactcacagaattcaaaaattacaaccttcatcgaccattaagtggaaacttaatgaaaataaaaataaatgggtaaatggggatggtgactcgggggaaaaataattttatatctgttccaattgactcctaccttctctttttcatacatgtataaatgaagtcataacatctctattttccagattcttatttatcccctggctttccacatacattatttcataaacttgaaatttatgaacattagacatcatcttggggcttgtaaaggtgtcctaaccatcccacaaatgtacatgtgcacatgtgcacacatgcacacatacatacacagatacgtaacatggaaagcaaaatggctttctatagatccttaccacgatgttttccacattgatggaaattttttcctatgttaaatattcagcaaactatctctgaattctatctttaaggatttgaaaaaagcagcaaactgcgcccattaacttgtcatttacattaggtatatctcctaatactatccctcccccctcctcccaccccacaacaggccctggtgtgcgatgtcccccttcctgtgtctaagtgttttcattgttcaattcccacctatgagtgagaacgtgagatgtttggttttttgtccttgcaatagtttactgagaatgatggtttccagcctcatccatgtccctacgaaggacatgaactcatctttttaaggctgcatagtattccatggtgcatatgtgccacattttcttaatccagtctatcattgtcggacatttgggttggttccaagtctttgctattgtgcacaggtaccctagaacttaaagtacagtaatatatatatatataaaagaaaagtaaaagcattttatgatttcatcccactgaaaaaaaaaaaaaagaaaaaagcagcaaactttttattttctgagtgagcataaatacttaaacccatagatgggagcccagttagttcattaccaaatttaatggttttgaagatatctgtccaaaaattgttatagctgttgggtaaaggaagagacgaggaatgtgtgagtgtctagcattgagcactgttaaaacatccattaatcacatgttaatcctccaatttctagtcataagcaaaaatgcagcacactagaaatgagccttcttattagaattattaatttgagaatcagtcaactacatacttctgtgacatcaaaaaggctgagagaacagtggttgattgctcaggaaatttatgagaccaacatgaatatctttcacattccacaaaagaaatacaacaaatcctttgctgacaaagctctagtcattacagattttatgttctcgtttacagaggaagagcttctcaagccggtggtttgttttatcacaggaatgttcttgcaggagattcacttacaacaaaaacttcaagtagatttgggttgaatccttattctaccagctataagctgtttgctctttgacaaaaatacttaattgtttttttttttgagacagggtttcactcttactgcccaggctggagtgcagtggcgcgatcttggctcactgcaatctccgcctcctgggttcaagtgattctcctgcctcaacctcctgagtagctgggattggaggcactcgccaccatgaccagctaatttttgtgtttttagtagagacggggtttcaccaggttggtctagaacccctgacctcaggtgatctgcccgactcagcctcccaaagtggtgggattacaggtgtgagccaccacacccagcccttaatatgttaatatcatttttttacctttaaatttcatcgtttagctagtcattttttcattcagtgaataaatcattttaagttcttactatatgccagaaagaatggtaggcactaagaatattataaaataaaataaagaaatggcccatgacttcattgtgaataaggacactcatttctccctggtgggatgttcattaaaggagatagcatgtctaaacagttttcaggttctgaaacatcctggaaattatctcctcttctggaagaaattttccatggattgtctcttttgatttcctccaaaagcaattactttaataatagactcgcctatctgagttttaacaagacacgtaaccacccagctaaaaatgggtttcatggccttctttatggttgtgcatggttgtatgactgagttctggccagtgaaggtgagcaaaggtgccaatgccatcctccggccttgcccactcacagaatgcagtagaacgtgtgagcactcagggtccttccctgttattgcaagctgggagatgacaaggacttacacccagagatggaagccacaggggataacagtgtcacatgaccaacactggaatgctcatttctgttttatttaagctgctgcattttggtgtttctttattgtcacagctttgtctgtaccctaactaataaaatatgtttttgacacagtttatgccattatttattgtattgcacacaagaatggacaagtatgtgaagattcatcattgaaaaatatgttttaactcatttttgaaattattacaatattgttcaaatatatttctctaattatgtatcttccccacttaattatttttattttgagccacattatcttataataattacaatgtaagatgaacagcttatgcttcaaagaaaaaaatgagtatagccctctcatttcaagagacgttcaataaaataaaattcttgaaaaacaacaaaacaataagagtgctctccttaggatttgagttctttaatatatttttacaatatttttgaaatttccttagtcttaagagcacccaggaagttttgaaatataacaaagtatagaagtggtatttacataagtcctacatagatatcatttttttccatttttaattatggtataattcacatgacataaaatttattttcttaatcattttaaagtatacaactcaatgtcattaaacacacttgtaatgttgcgcagccatcgaaccgtacatctctagaactcttttaatcttgtaaagctgaaattctatacccattaaatgacacctgcccattctcctccctccctgtccctggcagccaccacactaatttccatctctatgattttgactactctatacatcacatattagtgaaatgatataatatttacctttttgcaactggcttatttcacttagcataagggcctgaagattaatctgtgttaaagcatgcaacaatgccctcagaatttccttctttttaaaggctgaataatatttcattgtatattgtacctcatacctgcttttaaggtttgagagtgtaatactcagaaatggaattgctagatcatatggtaattctatttttaattgcttgaggctctaccatactgtttttcatagcagttgtactattttacattcccacaagcagtgcacaagggttcctatttctctacaaccctgccaacacttgttgttttgtttttagtgttcctcttttcaatagcagccatcctgataagtatgaggtggtagctcattgtagttttgattttcacttttctaataattagggatgttgaactcttttcttgtacttattggccattgtatatcctctttggagaagtgtctattcatgtcctttttctgcttttgaattaggctgtttgtatttgatgttgagtttaggagttcactatgtattgtgcatattaatattttatcagctatataacttacaaaccctttattctatagtatgggttatctttttactttgttggtactttattttgatgtacaatgtttttaaattttatgaagtcagaggcaaattgcctatttttccttttgttacttacctcttctgttggtgtcatatccaagaaaacattgccaaatctaacatcgtgaatttttgcctgatgttttcttctaagagttttatagtgttacatctgacatttaaatcttttaccattttgggtcgattttttgtagtggtattaaaaagggtccaacttcaaccatttgcatgtgaatatccaggtttcccagcaccatttgttgaaaagactgtcctttctccattaaatcgtcttgaaatcttgtcaacattatttgactgtatatcgcaagggtttatttctgggttccctattctattctgttgatttatatcactgtatatatgctagtaccacactattttgattactgtagccttatagtaagttttgaaatcaaaaagtatgcgtcttcccctttattctcctttttcaaaattgttttggctatttggactcctttaagattacatatgagttttagatgagttttctgttctaaaaaaaatcactagaatttttaatagagattgcattgaatctgtaaaacacattgggttgtactgacttcttaacaatgttatagttcttctagtacgtgaacacgggctgcgtttctatatatttaaagtctttaatttcttttgcagtgcttaattgtttttactatagaagtcttttatctccttggctcagttaattttgaaggattttattttttgtactattataaattgaatgctttttgtaatttctttttcagattgttcattgttattttatggaaacacaactgattttttgtgttattttgctaaattcgtgtatttgctctaaaaggtgttttggtttttttgtacgtgtttctgtagaatctttacacttgattttagctaaaaactgaaaagttatatttgcaaaatcttagggttttatatgcataagactttatcatctgcaaacaataaaattttacttcttttttttccagttcagaatccttctatttctttttcttgcctaattgctctgactaaaactttcaagtactattagagtagaagtgttgaaagtgggcatccttgtctttttcctgatcttagaggaaaagtctcaccattgggcattgtgtttgctgtggctttttcatatatgacttttattatgttgagataatttcctttgattcctagtttgttgagtatttctactgaaagggtgttgaattttgtcaaatgctttttctgcatcaattgatgacgtggtggtttttcttcactttattagtctggtggattacattgattaatttttgtacgtcaaatcatttttaccttccaggaataaatctcacttggccttaatataatatatgctgctgaatttggtttgctagtattttattgtggattttggcataaatatttataggagatattggtctgtagctctctttttttatagtgtctatgtctgactttggtaataggaaaatgctggcctcatagaatgagttaggaagtgttccctcctcttcagttttttgaaagattttaaaaagaactggtactaatttttttaatgtttggtagaattcacctacaaacccatgaggtcctggacttttacttgttggggaatttttgattagtgatcaaatctcctaaatagttgcagttctattcagattttctattgtgatttagtcttggttggtagtatgtttgtaggaatgtgtccattttatctttgttatccgatttgttgatgtacagttgtttctagtactctgttgtaatccttcttatttctttaaatcaggaatggtatccccattttaatttctcacttcagtaatttgagtcttctatttttcttagttcatcaagccaaaggtttgccaatttggtttatcttttcaaagaactagctttgggtttcattgacattctccattttcctattctctatttatctctgctctagtctttgttatttccttccttctagctttggatttagtttattattttttaatttaagcatttacagctgtaaactttaccccagcactacttctgctgcaactcatgtgttttggtacactgtctttttattttcacttggttccatgtattttctaatttcctttgttgtttaagagtgtattgtgttatttaatttccatacatttgtgattttccagttttacttctgttattgatttataacttcatcccattacggccagagaagatactttatatgatctttatctctcactatgcattgaaacttacttaataggatatggcctatcctggaaaatgggaagaatgtgtatgctgttgttgttagagtgttctacatatgcctgttaaatctagttggtttgttttgttaagtcctctattttcttatttatcttatgattcatgcttaaccaacaaaaaaaaattttaccgaaacaagtgatgttctctcgtctaagatattttcttagaatactaaacacttctaccagtgatactgctgttaacaatattttttggaaattattgttggcaaagtcttttagaaattatagcatgaccttttgaatttctttattgatagaaatattttatcagtggatttggtttaatacaaccaacagtgattcaaggccaaatcttataagatgagcaacaagttataaagtaacatttcagggtatcttttaaagaaaagtctaaaaatgacaagatcatctgtctatttgcagcttattttaaactgtgtttctcccttaaattatatactcaaaatagttgggagtaaacagcagagacatctcttacctaaagttattctagggctagttcatcttgtcagaagtataatcccagtccacagttttcaaagaagtgggactggtgagtgtcagaaaaatattatcactagtcaaaagcatgattgcatttcctcttgtaatctgcaaagtgtcagaggaacagttattctcagtgttattgcataggcatggaagtggtaaagaaaaaatgtttttggtcacagctaccctaggatgatggttcttgcaggtttttaaaagacagaataggcatcagagataaattagggccctaaaataaaaagaaaatgaacaaaactttaattaaatttataatgaattgttatgagaagtgtcagccagtacagatcataataataaaacaaataccttctattgaatgttaacccaatatctagttgttttaaaatattatatcaactattttataattataatgtccagaatttacaagaaaaaaagcccattaaaaagtgggcaaataatacgaacaacgcttttcaaagaagacatacatgcagccaacaagcatatgaaacaatcctaagcatcactaatcattagaaatatgcaaatcaaaaccacaatgagatactgtcacacaccagtcagaatggccatcattaagaagtcaaaaaatagcagatgctgatgaggttgtggagagaaagaaacagttatacactgttagtgaaagtgtaaattagttcagttattgtggaaagcaatgtgacagttcctcaaaggacttaaaagagaattaccatttgactgagcaatcctattactggaaatatacacaaagaaatataaattgttctaccataaagacacatgtgtgtgtatgttcattgttgtacttactattcaaataagcaaagacatagaatcaacctaaatgcccatccatggtagactggataaagaaaatgtggtacatatacatcgtggaatactatgcagccataaaaaagaatgatatggcctttgcagcatggatggaactggaagccattatcctaagccactaacaggaatagaaaaccaaatactacatgttctcacttataagtgtttgctaaacagtaagaacatatgaacacaaagagggcaacagcagacactgaggcctacttgagggtaaagggtagggggagggagaagattagaaaaaatacccattgagtactatgcttattacctggtaataataatctgtacaccaaacccccgtgaatgctgtttacctatataacaaacttgcacacgtacccatgaacctaaaagttaaaaaaaatcaactatatatgtattaaataaaagtgatataatttacatttgcaaattacagaagacaagcatatatgaaacctagagaagttaaaaaatttttcaagaatagtagttgaaaattcacttctaatgctggtgtgtctaatcccaattccacggccttccactctcttgtgcctccttagggagaaatctgtcctgaaataattctgtacttctgggccttgatcctcagaactctgtaatacccactgaaagtcagagaccatgtgatttcattagagtcataaccccttctaggtttgtagccccttttaagtttgcatctctgtatttttctctggcttcatatcttcttcccacttctcactaaacaaaaggctaaagaaagctgagcctaaccacatgtttgcctctccacaaatgaataagttgctattcatcattttcttttgtttgctttcctttatcagaattttccaaacatgcagctgtattaaaaactaggtcaatttaaagcaatcatgcacaaaattgtttattaaaatacaaatatacaccagtaatgttataattgaatgtatttttctgggacccataagtcttttgtgcctttgatttctctggtttcctcatgtggatagtaatttttaccaagaattttactatgaatagatctagtgaatattcctgcggatgctgacatttggtagcttcttgactcatttatgttaagtccatttaattttttctgtttttatcccctctctctcctctactcccccgaaataatccaagtgagcaactaaaatgctacttgattttcttgagaactttggccagaagctatatttatttataatcacatgtcctaatgctatattgtttgtacgactcattattgtagttattattctttaccagttgtttatttttacataattattctaacttcatttcatcatgttttattaaagcacaaggttaaaaatgagttcagttttactgtcatcttagaattatcattaacttaatgtccctttttgttagttacaatttttccacctactcaggtgttcatgagttgagtatatactcaaatgcacaacaaacccaaattttagagcacagaattgaaaatcatgagtttttgaaagtttcatgaactgaggcaatcttattgccattgccatgaggagagaaattgattaggtcatatagaaggaattgaatgagataaggcaaatgctttatttttgttatcttcaagtgtgatatatgtatgcaaactattaaactcctacccatgctataaagtcatagtatgtgtatgtactgacttactttacatttgaatataaaacagataaatagtaacaggaatcctttacactgaatctgcttcatctgcccttggcattgtccacaggctgtagcaactacagcaatgccatgggaggcaaaggtaaacagagcttttatgtaggtgtgctgtccagtgtggaagctgctgtccatatatggctatttaaatttgaatgaattaaataaaatgaaaaaaaaatagatccacatttcttctactcacattgtaagtactcaacagccacatgtggccagtgactaccacattggacagcaataatacagaaaacttcatcatcacagaaggtaccatggggcaatgctgttttatagtatttagtagattgccttaattgggacttagcctctgaataatgaaaaaagcagaagcaacagtgcacaaatagatgacatccaagattttaaataaatacacacatatatgcatgaaactatgtattatttgtgtgagcatcatctaactggcatgctgggtgattaggttagcatttaggtaacaaaagatgtcacccattgaagacaagatcctgagcaggctagttcaatgcacacattcatacacacacgtacacactcacatacacacaaagtcttaatgcttgttgagtgaaaaggcaaaataaaaatataaaagatagtcaaccatgacatatgctaacatactatgatgttaggagaaaattaaatggtattcatacacgtacccacacacatacacacagtctcagacacttgttgagtgaaatggcaaaataaaagtataaaagatagtcaccatgacatatattaacatactgtgatgttaggagaaaattaaatgttggttaatatttattactaaagagttaaaaatgcaatctgcactcttcttaaagtgaggtatggtaaagcctccagattatttctgtcttgtcattatttccacctttgcatttcaaagagagtgtaaaccatttgggcctacttgctgtcttactcagtgtttatcctgcagtgacccatgggtggattggaaagtaggacagacctggcttggaatctgagcactgctacttaatgagctctgttttctcatctcctgaatggggacaatcactgtgcctaccttttagggttcctacgaagataagtgcatcagagcacttcaggattgacatctggtgcaggaagtgctcataaacagggactcaggttcatatactaacctctgatcttccttcctagcctctctgtatctttatctttatagttctttctgttcatgtcttctgttttaatgctctgctatgtctttgatcccttgccctcactcagaaacccaaaggaatgaatatggagattaagaaagagaaggctaccagaaagtaaagtaaaaggagaaaggaaatgggaagaggaaggaattacaaacatctataaaaagatatgcttcctctttttgttcctgactaaaactcattttgttttattttgttctctttatgctaaagagtcagtttgactgactttttaaaataatgatttgtttgcttgaattaactaaatgaacaatatttatatttcttaataattgagtccttaggtgatcatacaatgttaccaccttatatttaattctttttttttttttttttttgagaaatgtgaacaaaaagaggaaaacctgtgtgtttggttataaggtctctggttaattttctgatgtaaagctttactgaaaaatcatttcattaagtgctccacttgtgagctgcttgtagtgctttgtaatctaagcatttcttcagtcatttctctgactctgagggctctctgccaaagcacggcttaccaactggagcaggtaaggaatgtttattttgctgtaattggtgaccaaaggctgctctgcataatggctcagaggaaaactcagaccttctattcctgacactatggaggagaaaacctgaacttaaaaaggcactcgggtcttacctatatcttttttgatgaggtgattgcaactggacctcagccttgccatttctaaaatagggatgatcattcctactctatctattttctaacgttgttgagataattgatacaaatattattttaaaaatcaagccagacgcggtgacgtgtggctgtaatcccagcactctgagaggctgaggcaggcggatcacttgaggtcaggagttcgagaacaacctggccaacatggtgaaacactgtctctactgaaaatcagccgggcgtgttggtgggtgcctgtactcccagctactcgggagactgaggcaggaaaattgcttgaacctaggaggcggaggttgcagtgagccaagatagcgccactgaactctagccccggcgagtgagcaaaactgtgtctcaaaaataaataaataaatatttaaaaataaacaaacaaaaagcaaagcacagtatgcatgagtttgctttttctaaatgtgatgatgaaagctatcatataaatttggtagtactcaccaacgtagagccaacaattctaagcagcttatctccagtctgagtctaaagaaccctaagacatctagttaattcagtggtaacaatagggaagcaattatttggaagagtgtctggagtacacgtgctgctttcctgagctccaaagaaagaggccaccataccacaggtttttttacacaattcttacactatgaccggagcccaaggcagacagtcatctttagctatgctgccctttcttccctatatcaaatatgacagcagaaatatcttttctcccctcttgacttcctaatactagcaataactttatctcattatcaaactcaaaatttaagagtcactcttgatttttccctttcttcattgagtaacaaattatgttactcacgtccattgtttgctcttaatttatactttaccacctcagttcaggcccctatggtctttgcccagacaattgcaatagcttctgtagtattcctactttcaatatcttttccactttccctggactgcctagttctgaggaatcaatttccctaaaagtgcagtttgaaacttgttgaaaatcttcttcaactcacatctcttattctataaaaggtagataacacagaggatacaaggctgagctttaagaattagacatgataccactgtcttagtctattttgtgatgttataacagaatatctgagactgggtaatttacaaagaaaaggaatttatttctcacaattctagaggctgagaagtccaaggacaaggagctgctgcatctggtgagggacttcttgctacattatcccatggtggaaggcagaaggacaagaaaagatgcatttgagagagagagagagagagagagagagagagagagaggaagaaggccaaactcatccttttcaacaggaacccactcctgcaataactactccactcatacaatagcagcattaatccattcatgaggccagagcccttgtgaccaatcacctcttacatgtcccacctcacaacactcttgcactggtgattaaatttccaacgcatgaaccttgagggacacattcaaacaaaccatagcaatcacctacctataaaaagaggacactcatctattcaataaatatttatggagtccttactgtatgtcacactggattaaggtgagaaataaatgaagtaagggatgggaggtagttaaaaggcctaattaggcatccaacaaatgttactattaggaaaaagagaatgaggaggagttgctgttattattgtcttcaagtttgattctaatatgcatgacgcatccacaatgaactgtgcccttgcatttgcttgtttcactcttttccctcagccattgttcatcaaaagattcagcaaaactgccaccttcacagagaatgctctctgattccagaaggctttgctctggtttatttatttattttaattaattaatttatttttttaagacggggtctggctctgttgctggagtgcagtggcgcaatctcagctcactgcaacttctgcgtcctgggttcaagtgattcttgtgcctcagccttcacagtagctgggattacaggcacgtgcctccttacccagctaatttttctatttttattagaaacagggttttgcctgttggtcgggctggtctcgaactcctggcctcaggttatccacctgcctcagcctcccaaagtgctggaattacaggtgtgagcccgaccctgattttcttttaaacctccaacacaatttttttattaaaaggttcattagggaaaataatggtttttgtttttgttttttaatctttatgtactctagagagcttataaaatacataatatatcttacagaagatgttcaatggcgattgttgagtgtccctttgaatgaacaaatggaaggatgaagattgaatgtgaatatgcaagtgagagaggaaaatattataaaatatctttggattcattttttcacacacctactggtatcagtatgtgcagtttaggatcaggaaatctgagttccatgatcaaattgattagggacttgctattcaaccttcagtaaataatttagcctttctgtgtctcatacattcagcaattcaacaaatatttgttaagcaccttctatctgcccagcactgaaacatttctcactaagcatgttttgacctgattttcttcccggtaatacactttagtagaagattgaaaatgtaccctaatttttcttccttggagtcaaatactttctcacactgagtaggtgagtagctggtatctgcaagactgataaatgagaaaacatgtcataaactgaccattctttggacagtatttctagaaaagaaaaaaagaaaaatctttatcaggatgccattagattagctattaattacgtttataaaggagtatatgtaatgaagtagaattgaatgcattatacaaatggcatctttctcaaatatgtgttgctcatccttttaagagaccaatgcaatcatccatattgtctctccacccactacatttaattaaacagtttgggtccagtggggtcaaaggtgttcagtaacatttaccgtctgacagcaatcccatggcctatattctgtgaatgtggaagccctggttcattgcaatgagcaggtatctgcgttagcaaagcagctaccactctaattttctctaattgacttgttggcagtgctaacagagagggcaaaagatgcaggaacatgcagagtgggccccgacaagaacttggcatggatgaggccagtgagtgaagtatataatctgtaatgaataaaggactctgggctgtcaatctggcacatgccactggcatttaattcacacaaaatattaattaaaaataatgatgttctccccagcttttgtcgccaagtacagcatcttggtctagccctgaagagctgtctacaggtttcttgattcattccctcagccccagagaaagacattcatctcttaccttcagggaagcctcaaaaaaagctcttagaataatgggtctctcacctaccaagtctcaggggaaggagaacccaggcttttcctgattacccatttcttgtctttttcaatctctgtgatcaacgaatgtgcatttattttctcctttcctggccacagagaatatactggccaagagccatctattttggatgctcaacgagttactaaatatttcttcagtttcctttatcccaaactgaggtgttctacaagaaaggttggccaaacaataatgaaaatctgatcaataatttcaaatctgctaaataacccagaatattcttgatttaaaagaattcccgtggacttccaaattattatttggaaatttattttcaaattatttcagtatgattaaatcacagtaaattcaaagaagaaaatactgctgagctttattttgcagaggcaactgataaatttttaagcctatatatttgcaacattttagcaagtacaaaaaaatacacttactgtcatgattgtcactaagtgtattcctgcacaatggggtctggccataattaatgattaattcatttggaatcatcatgataatattaaatgtgtttaactcatttgatgcttctgtagagggagcaattctaggcaattcttttgtgatttactggttttaaagtttaagagctctgagcatgtgcaggaaaatagttccacattgctctccagtggcacagtggtaaattacacccttcttacatactggtagaaaaccctcattctctcttgctcccaattcacacttaaagcatctttcctcttccatatacattcaaacaaaatacctccatcacaatataaaaggatatcaaagcactatagcccacttgttaactaataaatgtacaatattttcttgttttttgttctggaagatcaattattggatcaaactttatcaggaccggaacaaaatcctattgtttcctcagtaggtccagaatgcagtttggcaagagcacaatacagaggctagactccccaaaagatgtttatgagcagttaaagtgtgaaaagcataaaagaaagctcctggaaaaggcagtcaaaggggttgtggagtcttcccaagcctttattacttaggtagttctgcattactttagaaaaaccattgaccttacctgagcctcaagttactaactgacgataggaaaacattgagccaaaacatcttcaggactcctagctctatgggatattcttataccagttacaagtccattgcaagtgtgtttactttttacggggctaagctgttaccactttttgtttaagtgtaaggttgatcttctctaagatgtgcacagcatagtaggtattggtgaaatacagtgattagtataattcattaatccaacagagagtaaattataaagctctcgactcagcatattctataccatggctaaagatcaagtgaaagaagctgtcattactcagatgactcgagatttggtaggtatcaatattagcaagagtctgttttggaatgacagttacctcaaatttatgggggttaggagatgaagaaatgatgactgcttcagattaagttaaaaattcaaaccaatacaatgagaatcttgtattctcagtaccaagtaaggtatttttaattttttttcttttttaaaaaagaaataatatacaccctgaaagactgaaaggtaataatccagtaatgttacagaagcttttacagagtgcattttctatggagctataaattaagcatctgggtggtgggaacagaaaaatgaagacatgaatttagtgtctcatggactatgctgaccatccataagctacagctgttaaccctgattaggaagtcaaaggcttcctattaagtagaacattctttgaatcctaatccaaattggacctgtgaatataaaacaatcacttcaaatctcctagcataaacacctgtttcattcttttatatttaccccccaccccccccccaccaccaccttaccacatcatataaagtttctagtttgttgttgctctaaaggttgacggcttgactatggaagaccagacttcagtatctatttttccgggattatatgtatattggcatgtagttgggtatgtaggaatctgtccaaggttatagactaatgaccacaggcttggattcagtccagagagatagtttttccaggataggaaatttattgtatttattgtattttccaggacaggaatttattgtatttatttaaattatctgccaacactgaaaaatttgataatttctcataaaaatctggatttccagataatctgacaaaactgggactaccttccatacactaatattatcttggacctgaatagtggctccactctttagatcaatcatatactttccaagatcctctctgacctagtggctctcatacactgtagccaaatctagccgtttttcttttctctctctctctgattaaaaacaacacacacacacacacacacacacacacacacacacccctacctcctaagcacttgagtgtggaatttctgatcactttttcactcttttgataaacacttagatagatgcaaatacggagatgtattcaaattgcgaatggaatttgaactgcaaaaaggcaattttaaatggctcaagcctaataaaaatgtttacatttttggtgcatagatgattcatatatttgaaatcagacgtagtccatcctgcaataactcaaaagaatatatttcccagtggaaaaaaaagtgtactttttgatctacctaattgtattttcaccattttttcactgaaatgttttcttcctcctatagtgcttcttagtcctacccttattcacaagccctagttcaaagttcatatattccaaaagtcttctttgatgacctaaatcctcactaatttttcagacctctaaatgtatagcattcataagctatatcacatactttattgtttaattttacatagtctttcattgttttctctgcccagaattatattagtaacctgacagaaattcatcttctccaagtacttggatctcaaagcgcatttaacacttgttgattgattactttcttattaggaaaatagcttgacaacatacattttcaaaaaagaaatattcccttttggagggaaagcaattcactgaatagaagccctttgactacattagatataatcttattttattcttcttgctgtattatagctcttgaatccatgtggtttagagtctcaatatctttaacattaatacttaggtcacatacaaattttatgaagaaaactcaatcagatcaatttttatagatgtctatcagagataaatacactcatttttaaggcttttttattttgatataaaacccagatacagaaaaccacatgcaacaaatgtgtaatttaatgaagtattataaattgaagttcaccatgtttccttgctctgttttctgcaatctgtcatttaggtccagaggctagatcagactaagtaggtttgatccctttggcaaaactctggagagtagtctgttctttcatcaggaagcacatactgtctcgttgtctctattttatcttagcaattattaatgcttaatgcttagatccattcattaatgggggctgtaaaacagcaatattttaattttactgttttgtttttatttgttagctagaattatgttctgatttcacaacctcagaaatgaccaactgttattctttaaaatacctttatcaaattatgcatttatgtatatttggtgagtttccatacatcacagcatttatgcttttctgtttgcagattatccttatctctggtctgagggagtctcttcaaattgactactgaacccatttgacatgattttattagttgcttccgttctatctagtatgtcaaaatatttcaggttcatttggcatgttttctactttaagaatcaaccagttctgcgagaagctgcttctttttaataggaattaattttcccccaaactgcagtctgtgtattagggatggttattgctaccgagtccaggtttccagacattttttagcagacagagctggaagagagaaaaagtacaattttgagttcaaacttatttttccaattcaattttaggaacacagactttatttaaccttttctgtattacatctctaggtcttttcatctacaccaagaatctggttctcagggacagaggggatgatagaatatctcatgtttacccatttgctttattccatattacattagtctcaaaataataaaagtgtcaacatcaataataattattgaagtatttatctttgcatatactgtcattagtctttaattttgttttatgattgtaccatatctataatatcaaaacatttagccattacaaaataaaatatctttcctttaacttagtcttagtttattaaatttttattcaccagttagctattaaatcagtatctcttctggtcatcgtatatgcctaaagctcatttactagtagttctggggatcagggaacaatattcctgagtacttgcaagtggataagtttgtaccctttatgtttaaagttaatttttgttgactataaaactttgaattacattttcttatgttgagtatctaaagttactctaatttcttctgccgtaaaatgttatataaagcctgataatctaatttttttttctaagtcatatattatttttgtctggatgcctaaaacattattttaaatcagcagattttttatttagtgattctgtttttattttcctttggattttcctcatcaaggactcctattatctgtacgttagatcttccttctctaacttcaatatttatcactttctcctgaatcctttttcagtcttcttaatttcttttgttatgtttttgcttttgacttgtattcatctagttaccgttcatgtctaaaattttttaatttacatatatctattccttgagttatgccacctcatttctgagttttctgatttatgttactttttcatatctggcattttcttaatgtagtttagttcattttgaaatcataaattgcagttttgatctatttttcttgggtgttttcttctactttttatccattttctgtacttttctataggaatgatattctcctattttattttttcttgtgctaattttgtaaagaagtttacctcaataatttttttttcttttttttgaggcagagtctcgctgtgtcgcgcaggatggagtgcaatggcgctatctcggctcactgcaagctccgcctcccaggttcacgccattctcctgcctcagcttcccgagtagctgggactcgggcacccgccacagtgcccggctaatttttttctttttttttttttttttgtatttttagtagagacggggtttcaccgtgttagccaggatgctcaatacatttttattgcttacatttatgtaatttgtttttcctgttctttcagaaattcagagagctcttctcaatacatagagctccctgtcctgttcttttcaatagacagggttcagcaaactacaggttacaagtagaatctggagcaggtcttgttcttgtatggacccctgaattataagtggttcttacatttttgaagtgttgtaaacaaataaacagagataaaaattgacagaaacaatgtgacattcaaagctaaagtatttactctccgggcctacgaaagcttgccagctctggatacagactgaaaactatggcagcttgctttctgaattttcatggttcttcttctcccctacttttaactggactttctctccccttcatcaatattgtttcaatcttggttatatcttacatcagttcacaggaggttgtccccagtttgggcccagtgctagagaggagactttgcaggtcagttttgagtgtttaaatttgttgttctggaactgatctgctgtgctttccagcattagctgatacctattttagaattatcctgtttttaggtttgatgcttccctttgatgtttcttacacagatgcagacaacaaacagatgatgaggctgtcggttgtttattcacacccacttgtatattagggttcgagggcacacatcatcacataggtttgcagcaagcagataaatgctttcggttttctacctagtagttcagtatgttttcatatggggattgaggaagatcaaaaaaccctactgctaccacccactgccactttcctttctgaatccaactcactcattcttaaacaatttaccaagtagattatatgaaatttgttttgaggaaaatgtttgccttgagtattttgatacattaaatatatcaacacgttcatattgtttctgttttttctccagagtcaagttcccattatgtaatctccctaaaagcttttaacaatgccggagaaggagttcctctttatgaaagtgccaccaccaggtctataaccggtaagtgaaattgttaatcttcctctgacaaagtatatttgatttatggtgaaaaaagaaaaactaaaataaaatacaaagaaacaaaaatgaatatatcctatcattatcctctgataatcctcagagaataattatcctctgagtctgataagtacatatgtatacttgcacacatatgcatgcatttttttatttctttggttgtcgaaattaagtaggaggaattcagtttataaatttgcacatggacttagagaatatagatctctcaatctgttccttcccaatagcatcatggttttggtgccctgataccatgcttccatctcctgagcagtttgtctcaaatcaatgccatctttgtccctgcataaaggttgccaaatgcctaaatagacacttgcttctccacacagggtctttcaaactaagatgacaaggaagagctggccttctggggtggtttgcattaggctgagtgacatatgtggtatcttcctgagctgggcctccaggtcaccccagcagtgcccagggcctcaggaccttaaagggatagctgatttaaggccttgtcacccttaggaatttttctgttagttggactgtaaaggcagtacataagagtgaaagggctcaagatactgagaaagaaatgggtaagatggtgagatccaaactatttatggaggttatttgttagcatgtgtaggcttagtccaaaatacaataagcaacacatttgtagggctattcagagtccctggaaagtcacttgactacttccccaaacccctgccacagacttatgtctgaaatctccaagtaaaacccaagttccctctctaattaatacattgaatctgccccctcacacccttcggacgtcgtttaacttgtcagatattgtccccttaacgaaaacagaggatctgagatagcaagcatcggagaacgtgagatgttactgatgtttgaaatttggatgagttggaagaaatggttataaaataaatagtggaatcccgtggcttctactcctgcccaaatttatgtgaacttagtgcagtttgtttgccaaatgtacaagcttcattcatagactatcttaagaatacagttgttctttgaattcataattgttatgtcatggcctttagaaaatactgtcactatattgattttagtagtattatttaaggcaaagttgctattgtagtctctttgaatctttgaccattgtttccaggtctacaatctgtctaaagtagaatgcaaaattttgggcagatgtcaatatgtttatttatctgtggagacagtatatatcattcattgtataatcaaaggggttcatgacttctctaaaagagtaaataattaccccagagaatatttactatcaaacgtgttatctccaaatatagaaagatgagaaaacttgaggtttgggttacaaactaagagctaacagatgggtgtctgggattttaactttattcccttgctctgctagcaacaagattctttgtgagcaaacaggccactttggctgcaccattgtgtctcataattttcctttagtgaccatctctgtcctgcctatggtaaaagatccccagtagccgctcattgccatggtgacttggcacttgtgatcaggccatgcaaaatgatactacagtcggtcttttcaagctcttattctcttaccaaagctaatggccccaaggaaggaccactgaggtggcaaataaaaatcgcttttcaatcagaaactggaaaaggtgaaagaattcaaataaactgaaagtaagttgttcagaaagaaccactggagtcattatcagcttcattcttcttagcatttgttgcattaattctagcatatgacattcccaaggtggtttcaaaaacaccagtgatccaggcaatttttattttctgatgactcagatcttaaaggaactgagaattgaaataatactaaaagttggaatttgtgtgaggaattttcttattggagaaaagccagttaaggggttcgagaagaatgcgtgattccagcccttttcaaaaaggaaagaaaacactttttctggaagtggcagaattattttattttgcttccacatgtcatggagaacaaagaacaaataaatgaaatcaaaggttaaggaaactccattaataaaagtgtcagtgccacatagacggcatcctctatctctaagcttctgcaaaggcataccatggacagtctcgaacaagggcccgtgtaaagtaactacaaaatatatcacaggcaataaaacctcaagtcagaataagcatcaggctatagagttttctgcacacatgtgctcacagatgttggtgagctctggagcctcatcccatactgggaatatcagcattagagctgctgaaagtctcacgtggccacatgcattaagagtctcatttttgctgtaaagccctttatttcttgttgtcttaaggacaagatatcttgagcctggagaaggaaagaagatgaaaagaagaagactaataaaacacgctgtttcattgatttattctcaactgctttatcaatgttaaaatgaagtacaatccacatgtaaaattgcatcattatttttaaagttcattttttttgagatagggtctcattctgttgcccaagctggagtgcagtggtgcagtcatggctcactgtagacttgacctcttaggctcaagtgatcctcccacctaagtctcctgggtagctgggactgcaggtgtgccccactatacctggtattttttgtttgtttgtttgagatggagtcttgctatgttgcccaggctggtcttgaactcttagcctcaaacaatccttctgcctcagccttccaaaatgctgggtttacaggtgtgagtcaccacacccatctaaagttcattttgaatgttagtgtaatgactcaacattcatgggcacttacaaaaacacctgttaggaattgaacggatttctttctcagcaaaagtttggaggctatattttgtcttttactaaattttttttcaattctcttgaatgtaaccactcagagtcagcgtataaatcacccagtggtaggaagagaaaagaaaaaagttctgtagcaacaaaagaatgtgttaaattcaattattcaaatattaatagtttctgacctgagagaaaaagacaattaatatatgcaatatgtattaatagctgtgcttgctgtgcacgataacgctctgctttgctggaaatgctctatatctgcatcagacactaggtttttatagcaatttaacacttgaaattgcctagtgctacacaggaagtgaattttttgttattctaatttatttaaacttaactagttcatataactagtggtcattgtactagcacagctctggaggaagtgtcaagaaggatgacaagccacacctgaaaaaatattattccataaaatgggaaagaaaaaacttggccaaggatagaaatttctggactgtgtaagtccatcaagaaataccacccaacacccttgcttgaaatttcagagaagcattctggaactgactccaagaaactcagtaagaatggtcatgaatagtatacccatttaagatcagaaatagcaggattgactatttccatttcttgaagaagaatcaccctatttcaaaacgttatgtatggcacctgtgaaaaaactatacagttaatgtatgtttaccaataaaactggattaagaaaacagtaaaataggtcaaaagaggagtttgtaaattagaaaacgtcccatatgtgtatcacgttcttcttgtaaagccagctaaaactagaaacaagtaaaacaaagtagcacctgctttaatttggcaaaaatgtcttccactgctacacaaaccgatgaatgattggaatccttgtggagactgcaacgtcttctctttccccttcatcgttttataaatctatttgagtttaaaggatcccttaataaaaagagacatcaaataaaatacagaaagcctgggctctgtcattaaattttaaacacaactctctttctctttctctctctctctccttttatttttgtttttgttttcagttttatattttgctccaaagaccacaaactagtaaactactgaataattcattggaaaacagagtgatgaataggggataggcatttgaaatgcagtggacaaagtgaagtaatcatcaaaaccagccagcagtcactccactttaaactaggctgttgaaaaaaataaaccctgtattatgctgctgtagacacccagcatattagtaggtctcatctccccaaatgttatcatatgcccagcctgagagttatattatcacatattatttttcttagaatatgcactacataatataaagattttttaagtgtaaatgtcttaagtacaaaatcaaatgctcaaagttaggctgttactgtggccacaaaatcagcttctcttattctgatatcacagcataaacatgattacaaggtgttttggagaattttgtaaaaacacacacatcattttgcagattcccattatattatggatcaaagcatgtatatacctcagtgcaaatctcataagtctgtaggtagttaatcctgtcttgccatccaataatataaaattgtaggaatgtgtaatatgggaactcctaccaagactaaaaacttagctaattactctgtgagaatgtgggtaaaatcacacttctacattttcaagggtttcagtctaagaaagcctgacaaaccaggtgctgtctgaaacttaattatcaaatatataattgatccatgggatcatgtgtacctggtcactctggttttgtgcaatcacagccacacacaggttgctgtggatgtcagggtactttgttctttattatttatttgtttcttgcccaggaaatgtgtttgcagatataagctaagcaacaatgaaaacagagaaaccctattaagttagagaaggaggagaaaataaacaaaaaattaggtattagataagcaattagctttttgtaggcagaaataaactggaacccccatttttatcttattattttaaattatatagtaataaaactgatcgatcctgtaactagatcttttaagaagcaatgtgcaacatttaaaaaatagtctttaaaatatataagcagaagtgacagtcaaattgataaaaccactctaagagaatgagtaaattatagaaaatattcaattacttttttgcaatatagcaatactgtttctaatgtgttttccgattgaattaattacatttttttctgttcttctcatgttccctttcatcattattgccatgcatttaactcattgtgatgtgttaccactgatatttattttttaacgcttttatttacgtatttatttgtttgtttcatttggtgggtttttaaacccagatcccactgacccagttgattattatcctttgcttgatgatttccccacctcggtcccagatctctccacccccatgctcccaccagtaggtgtacaggctgtggctcttacccatgatgctgtgagggtcagctgggcagacaactctgtccctaagaaccaaaagacgtctgaggtgcgactttacaccgtccggtggagaaccagcttttctgcaagtgcaaaatacaaggtgaagttctaattgatagcatgaaatttaaaatgaactgacatttgtttaacacattgttttaaacctctcctggactgtcatgagtcgttttgctgctgtgtatctatgtagaaaaacaaagcattttaataactcaatatctaagattaacatgagaataattgtattttaggaaacaattctaaggcaaggtaggaaaacatcaagtgctgtaaaacgttatttgcttttcaccagatgctgagtttgtataaatgatttgattctgtgcaagagaatgccattgtccctttaaaatagcagagatctatgttaattttctggattttggtatcttttttttttttccatttggaatctagattgatttacaaagcgaccctattaatgtcacagagactcatctttcagtgaatataactgggaatagataagttgaagatatttttttgtaacctcagcactctaagccattaacatctacttcatttagccttgaaaacacactattatggtaaagaaaactcacaatccacactcccatttagctaatatgaattcaccagctctctgttcttgtccttatcacagagttatctgacaacctctttaagagctcctcagagatacatatttgagacagtcattaccagtttcaaatctctatcaaccagcctcagggatcataacaacaagttatatactaagataattttgttacctcctaaaactgctatgatgttagtatatatagacaatatacaaatgtagacaaaaatgagaagatcaacaagtagttgtcaagaacctactatgtacctagaaatgtactacaccatagagatggtttattttgaaagaaaacatggtgtagtcattgttacttactacatataattttaggatgaattatacactcagctctatggataaacttaaaagaattcataagttatttgagagatataatgtataaaaacacatttagaacttaaaacttcacaagatactgattgggagtgaagaagtcagttttgaaaataagagcataaatgccacccaacaactaagaaatcaaatagttcaaccctggctgtcttcttcctactccttttgtgttctcttaaccgcttgattggggtagctcttgaggagattttaggtctccttatactttagccaatgttcttttcactgaactaccatcctcctgaatccagcctcaagctagtagtgattttggggggatgaaaatatttcgaggatgttttttaaccccaatcctggagctatagctaaatcccaccaccaatcctgtaagcttgcttctctctccccatagccatgctggatcttcctgtggtgtctttcaacttttaaatggcataaaattcacatttcatcataaatcagattttagttgaaaccatttaaagacagttttctttggtactgctgccctgttaggtgaggtatttggaagaactctccaggcaagtctaaatagtatcattgttataaggtatgtggtaagtaccctatccatctccttacagtagtagatttaagattcagcagaactataaataaagataacattatcagaaaagacaaccaatgaaacatatgagaccattaaagaatgtctctttttatatagattacccaattctctaagtttacttttagaaggctactttctccactttaaaaattttatgtcataattgctgtactttgtagatacattcatttcacagaatggccatggcgactttgccagaatgtgaaatgttctaaggaaaaatgattgttttcttcagaatggtttgagttccaaaatttcctgaagcaaattatttcagttgaatagttactacagcagacatggaattactgaatctcacaaagagtgcctgtgaggtgagactcagcccaaaaagattttaactgttcctcttcccttcatcctccctgacagaaggctttcaattactaatgtactattccctctctctctctccctctctccctccctccctccccctatatatccataccctgatatgaggagggttagagaaaactagaaagatataaaacaaatttaaattttacaaataatggtgatagactctttgagttttcactttgtacttttcaagccaatgtcatatctttacttcatctcacttccactacagctttaaaaggtaggcaggacatacacacaataggaaacaaacaaaatgtacatggagccacatgacctgggctcatgggttggctttgcaacctcctgtcatgaaacttaacctgctcagtctcatttttctcatctatatgatggaaatatccatacttactgtaaaaacaatgagattctttgtagttaagtaggaagacagaggtaggtgatataacttgacagaaattcctcattaaactagagcaggatctcaggtgacccaatggcatcatccagggatttccccacaagagtgtccttctagttccatttactcccaaatctataatacagatgctcatgttttgattgtctaaaaccctgtattaactttcctgatcaaatggagacattttctatatgtttttctattaaagtatttaatcatatgatgttttatatgaatttctattcaaaatatatccatcgagtgttgactagtgcttactagatataatatggatgttacagaggatatgaagttgtgcaggactcagtctcagctctcaaactgcatgcaactcaatgggaggagcatataacacatgcttaaaattacatacaacaagagacaatgcatgaaataatgtagttaagatttatttaatactttctctgggccaaacgctatgctttacttgtcttagtttgcactttaaataatgctatgaagtcagtgctatggtcgtctccattttacacacaagaaaactaaggctcaggctgggctcagtggttcacatctgtaatcccagcactctgggaggccgaggcgggtggatcgcctgaggtcaggagttcgagaccagcctggccaacatggtgaaactttgtctccactaaaaaaatacaaaaattagctgggcgtggtgggggggcggggcgcctgtaatcccagctacttgggaggctgaggcatgcgaatcacttgaacccgagaggctgaggttgcagcgagccaagatcgtgccattgcactccagcctgagtgacaagcacgaaactccatctcaaaaaaaaaaaaaaaaagtaaggctcagacaggtaccatctggttattctgtgctcacaaagataactggccatgttgctccaaagtatttctaggcttttttaagataagctgtagctttctatgaggttttagaggaaactcagtaattcatggtatttatagaatgcaaaggtgtcagtctagaacacaaagacgatcttacttgttggcctctcaaatgccagtggtgtctgtgctcagaaactgtttttattgagatatgatctttccctcttacctaaaatacttcttattgcctcatttctcccttttatttccatttctaagacttagagttgttcatgatcacgaaggaaagcaaaaatggaagtaatatatctgcatgtcagatactagctgaccactttgtgttttatttgatggaatttcatcttcctgattataccaaaaatatttacatttatttagggcatatatttttacaggtttttcttattttttatttttaagatggagtctcgctctgtggtccaggctggagtgcaatggcctgatcttggctcactgcaaccttcatctcccaggttcaagcaattctcctgtctcagcctcccaaggagcttggactacaggtgcatgctaccatgcccagttaatttttgtatttttaatagagatggggtttcaccatattggtcaggctagtcttgaactcctgacctcgagtgatccatccgcctcggcctcccaaagtgctgggattacaggcgtgagccacagcgccaacctacaattatttttaagaagacttctgataaatatttgaggtcatcactttaataggctggataggcaaatcaccgaaatgttattagtacagttacatatttatttggtggtgtaatgaaatatacaattttcataactataacctaagaaggattcgtagtagaattaaaaaaaaaaagatatcccttccttcagtagtaagggtaagatacgtatgatatgagtgggggaaaagagcttttcttaattattttagacataaatagataataaatgtaatgttttaaaataaaagtatttaacttcgaagaacgatacctcataccaagtacaaaatcatatttataagaggaatagtcccattttttttgcttatatggaaaatatactttaatggattaaaccttgcatcatgttttttctttattacccgttttggtattttgagtaagcaataaagaactataatttactttctactaaaatatctctaacttgtcatttaaaagacaaagaatgaattcagaagacttcaataataccaacaccactttaaacaccaatgtaatcctttagtatttatccaaattgctgttccttccttgatcaattgctccagttaccatcgttaaatgtttgtttaatgtgaagtctacacaaagaatgaaaaccatgtgactcagcattgcttttgtctcatgttctctataagatgtaaatggattctggaagcactaaaagtttaaaccttaaaggctttttgagatacatgatgagcagtagaactctaatcaattaacttcgttacaagtggaaaataataacaatggtctatttaaaatatacaacattaaaacttatgccaaaaaaaccacagattttgattataaatgaattaagttcaatgcagaaaatttcaaaaattgagttgacagaaggaagtggaatttgtcctgttgttctggttctgtaataaaggtaagtatttaactttgaaaaaagatatgtaaataccaagcacaaagtgatatttataagaggcatagtctcatatgcctgatcatatggaaaatatgctttaacctattagacctttcaacatatcttacctcggaaaattttctatctagtagcccctttggacaaccataatacctaattttattggttatattgtaaatgtataatcagccagcgtgaactggttaatagatgggaattcgagtcagtgctatgctctactcctctgctgtttgggagtagattacttttgtgttagcttatttaatagtctttttatatgtcttgatttaccaagttgatagagtttattttttatctctttgctatttcctacttgtatagtcagaagacacaacatctctaagttacacagcaacaggcctcaaaccaaacacaatgtatgaattctcggtcatggtaacaaaaaacagaaggtccagtacttggagcatgactgcacatgccaccacgtatgaagcaggtatgtgaggaaatgtctactttggacccttgataatggtgtttcccaggttctgtggaaattagaacatgtgttccctatggtgtctcaattataccttatcctatataaaatagttcatcctctatagttcatagcacttttatatctaagagtattctcctcacactagaaaaaacatgaatctccaatggcttaagtaatctgctttcatgattaatacacggtttcttcagggtgttaactcaggggatctgactataaatcttcttttcactacatttaagtaaagaacagaaatccatccaatgaacttggtccaaaacagttgtgtctttgaacaattgtcatggtaggtatttctcattttgaaaaaaagaaaaatagatgcaaaagaaagcattgcattacaaccgaagtctcatggatatttactgtgaataaccttggctggatatgggaaggagtttccaggtggttttgttcactcctgggaaatggggtaacataatagaagacctttatgcaattttaaatagttcaaatctagggtaatgcaattcactgtaatttttactggtcacatttactatggatcgtaaatgtagagtttataactttaacaaggatgcagtgtacttgacatttatagttcacagaaatccaacttctgaagaatccagggcttaacatgtttttttgatgggtttcataatatatcatatttgtgggtaaactgcaccaattttcaaattttaaaaaaatgctaataaagctgtttcctgggtaagttgaatttatctttccattagaatttgtcccatgggattgcagttctaatttttaactccaactattattttaactattagagttctagtgagaatatttttacatatctgtggatacttctttcaacaagaagatttctagttgacctaatttaattttaacatcctatttttctattttacctgttattatctcttcttctcagaattccaccctgaatgcacaatgttcacagcttcttagggttaataagaccagccggatgagatacatactattggatagagtaaacaagtaaacagtctactcttcctttttacttgaaaggagatgaatgtagataaatgtgaaatagtaagaaatttggccttccctgtgtgaaagagaagtagtagtattttcatcttaatacaagcaaattcattcatttttttcctctcataaacataaaatgcacaccaacatctgacttgatatatgcaccctattgatttctcatcaaccgcctagccttgtagggacaccagtggtgagacccattgctaacaaaaagatactaacttttagaaatgtggttagtagaaaaggtaataatctggacaaaggtgtaaatagcacatggataggatccctgagtgatgatgagaagtaagaagtaattcacaagtgtctgcaggtttataactgtgagaaggaaattcagtgaataaaataactctaaagtttgcttctagttctgcagtaagataaagaccatatggggctacaccattatgtgttgaaatggcttgtgataaagatacgagtgactggaaattttttgaaatcaagcatttcattctgtccagataatgaatccttcatttggttttggttaactgaagtaaaataaacgtgacaggaaggacactttaaataattaggccttggaaagagacaggcatcagccttattattcctaggctgtagaagtgaggaactgttggtttatcccttcaaggtgctaccatagtaattatttgactccaccttttttatttccttgtatgtagattcagtgtcacaaaagagagaatattattggcatcttttgagacaggtgatcacacagctaaggagaagatgggataagaccatggaattcccaactgatattgctaccaagctttcatgatatagaggagagcttgttttccaaagagaaaaaacaagtcctcctttaaaaggaagaggagaggatgggatgctggacagtgcaagtaacaaatgcccaatacaattcctatggctgaaatcttctgaaacttaaatgttaccttccattcatgtacttaataaagaaatggaagtataggaaaaaatgagagccaaagaaatcagagggggccgggcgcggtggctcacgcctgtaatcccagcactttgggaggccgaggcgggcggatcacgaggtcaggagatcgaggccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaagaaatcagagggcagtgcttgtctagtggaccaagatattaattaagggtttttaataatgttaatttataattgtcatgccttgagatacgaacttggtaaggagaatatagtctatgtctttgagcgaattgtggtccaataaaaaagaaaaagcatttttttaaattcctgaagtaatatcagaaatataatcataaaattgtggacaagttaaaatcagagcaaacaaagtacagattctgtctggaaaaataagaggaagtttcacaaaataaatgaggtttgagctatggcttagttgaattatcacatactaattccagggacttccaaagaatggaaaactcatgtgcaaaaatacccaagcaggtgtcagaaagatgatgtgttaaagagatacttatgattggctcaaagtgagttgagcacagtgttcatgggacaacaaggggaatgaagtacataaaataaaacagaatataaatcctagaggtcctggtgtttatttttatttatttatatttaatccaaagagaatgggtagacaatgaagaatttctagaaatcattccaggcagaactcaagaactcaggagaagagcaaggcagaggaattctgctcgacttagtagggattattgaaattgtgagggccatattatttttcaaatattaaggaacagtgtgcagttcacataataatgctagacatttaggtcattaattccaataccaaatttttattcaccaatattcacatgacttgaggaaaaataagagcttgcacagcacctgaattagattggttgttagatttttttaaattaaataactaattcttcattgtattatattgatagctaaagttgaagaatcactttatcctttttgaatgcgtaacagattcagtgaagcaatctaatcatcctcatttgactattttctaaacaaacatcaatttgaattttaacatagttaagacaaaacaggctattttcactagtaaaaaagacaaagattttaattacttccagaagtggaaaattccttattacgtttgatgtatactaatctaagttattttgtgactatatcttagcttcctattcatagccgggaaaatatcctgaatgacctctctgtgagaataatccttctttaagacagcattgtctttttagtattttgccataatgaatctgcatttcttgcaagaatgtccggatatggtttcattaagccatatatatcatattatattagactgcatatgttattttatactgtattagtatctatgcagtctttttactaagggatcaactatactccacctatgttttcttctccttcattcccccctcctcttctaattctctttctccatccatcccttcttcttttttgaaaatgtgaatatattaagtacattgtcaatgattaaaattaagtgcacgtttggttaacctggaatcccagtgactttgaagatcacggtgttggaaagaaaatagtatgatagatgggaatgattgatgtctcctctatttggctcatatttggaacactattcaggaagagatactagaaatacagtgttaataatgtccagattctgcaatatatgaccaacagaagtacgaaagagaatagggtgaagatgagttcagaattagagactgatttctaactatcttttcctacacagaatttttatgtggagaccaggaaattactccagatcccaaacacggaacccaatacgttctgaatctgcctttgttagactaagggtagcaaagttgccgtggataacagacttgtggcattgtgagctacccagaaggaaaacttgtcttccaaaacgtagaaagtgagagagcagattggaagaagcctggaagatccttggctagcttaaccagtttgctgccacctttaaatatttaaaattgttttgagtacaacatgtgggagaagtagtcttaggagcaggacttcgtgccatcttacttcatgctggattgatactaagacactcatagttattttttacgtcttctattttaatttctcatgtgtgccttcctgttggtttagaagatgcctaatatgtcacctagctaagatattttgaccccagttttatctcattttaaaaactttttggcttttaaggaagtatagacttaggtgacatttttatttataaatgcctgcagttgtaacagaattcttctgaagacatgtaatcatccagcgtggcaacatagacccatctctacaaaaatcaaaattaaaattaaaaattagagtagtggtgtgcaacagtggatccggctactcaggaggctgagatgggaggatcacttgagcccaggaggttgagtctgaagtgagctatgattgcaccactgcactccagcctaggtaacagagcaagaccctgtctcaaaaaaaaaaaaaaataaataaataaataataaactagaaaaagatatgtaatcatcaatctcactaagtatacatttcttcattcttataatgattcttttatttttagtgtgagcccacttgaaataccagttgtacttttctcctttatattcacacatactctcttctgttctctatagtcacaccttgggaatcatttgatttccataaaaattattaatttttgtatccttgtttgcttattcaaatccttgaaataaactgtaaatggcaaaatagacatgatatacttcttgatagattctgaatgtcaacatcatgatgaaatttccaacaatgtttattttctttcacatccaatgacaaggccttatctctgtctcacctcacagcccccacctctgctcccaaggacttgacagtcattactagggaagggaagcctcgtgccgtcattgtgagttggcagcctcccttggaagccaatgggaaaattactggtaagcatctccactttctctcccagcatagctctcccttgtcctataattgcttaccccctacatgagctgctcctgcctttcgtgtggcattattctgtccctacatctcagctgactccatgaccctttttgattgtttcttctttccccttttgaccatggaattcttctaatggtgcacacacacacacacacacacacacacacacacacacacacacacgtcatttgatttgcttcacgaaagatgtgtatttcaattagaatagacctttttgtttttcattctctgaagcattaagaccactttctaatggagtgccctgagtataaatgtctataaagaagctggttgtttggcaattatgaaacacaaaagatgcttaatgactgtgtttgtgtgtgtttgtgtgtatggcacatacggaggtttggggatttttagtttctcacttaggttttagcttcttacttaaatcataaagttcacaaaacacttaatattgactgacagaaattgaacataatgaatatttcacagtgacagattttattttgccaaatattgctgataacatcaatgcctaattaaagcatccattagaagcctgtaatgttaatttagtatgaaaaatataatggagttctatcagagattttgcatttaaatgatcactttaggcttttaatagatgtctccatagcatataattattatgaaaaatattgtataactcaaaatgtgaacattatagtctaattaacttgaaccattgggttaggaacatggaagagtcactccttttttccttctttttttgcatacaagagctggatagcactattataaattaacaaagtaattcagccgtcccgtgatacagagagataagcatggaaattatactttcagaaggcacacttactttatgtaatttactttctgaattttgcaaaatgaaaagataacgtgaaaattccaaataggattgaaatttaagttgaaaatttgttttctctaggaaattgctcttagcacaatagcaaacagaatttttattcgagctgacaaatatggaaaaagaagtgaggcacaaaatttccccaagatcttatatgttcacttgtcagtgtgccaggccttttaaaactgagactggctcattccaattttctttttttccccctcattgttataatctcttttcattggttctatgtcagtagttgtgtagcttttgatttgtttatattttattttgttataatcaattatttataagcttatgggaaatcaacagtaataagtctgaggagaaaaaaacagaaagctgtctaaataaaaacaggttctgatagaaaaagatgtttttggcaaaggaaaaataagtcatattctccactcatttgaattctccactcttatttaagtaaatcttatcagtcagtgtaaacaatagaataagtttttaactctggaagaaagcttaattttgcttcttcaggaaaaaaaaaaaaatagaagtctagcccatattaagaaatgcaaatttgactgggcgcggtggctcacacctgtaatcccagaactttgggaggccgaggcaggcagattacgaggtcaggagatcgagaccatcctggctaacacggtgaaaccctgtctctactaaaaatacgaaaaattagccgggcgtggtggtgggcacctgtagtcccagctactctggaggctgaggcaggagaatagcatgaacccacgaggcggagcttgcagtgagccccgttcgcgctactgcactccagcctgggcgacagagtaagactccgtctcaaaaataaaaaaataaaataaaaaattaaaaaaaaaagaaatgcaaattaatctaagcaataaaattgtatatgccaaaatcacagtgcatataaaagaaactttgtccacactctttacttagatttatacgttcaatggatcttactattaaaaatccattctctcacagtggaaaaataaaagtatgggagacaatgcttttgcctttaaaagcctggcttatttatgaaaacaaaattgtattatcaagttgagatattcctactcaatttaacagggagcaaacaataagaacccttaagagaatttctgtgtcatgtgtattttgatttatttattcaaattacttccagaaaatagaatgataaaatattcaaaatactacaccactaagcagagggcacaaatttgctattctcagcttcctgtggaagtgcaacaattaataataaaaagtaaaaaaaaaaaaaaagaaatgagctctttctcagtgcgaccaggtagatgtgtgccaaggagggatgtgctctcatgtaacctctgtattgttttgttttcctaaatctttcatgtgtatggcaggcagtagagcaggatagttaagaactcaggcttctaagggagacacatgaggaagtcatttaacatccttgagtcccactttctcggtttctcacctataaaataaagatagtaatagaaccgcactagaataattgttgtaatacagtgctgagaaaagcccctgatacccagtgggcactgacacgaatcggctattattattccagtttgaaatccattctagggtgaggctttactaatgtgctttatacagaatccagatcatcagtttttaaatataagtactcaaaaagattaaacaaaaaaggaggaaattcagataatcacagtgcctaaattctctgatcataaactggaaacttaggaatttggactgacattttcagaagaaaatgattcaaaatacattaagcatttattatatgcttggcattcttctgagatctttagtatgatataaatgattacatattcctattattccattttaaaatgaaaagcttaggcctttcctgagtaaataacttacccaaaatcaaataagcaagaagtggcagagctaggatttaaaactcaggtttatactcttaattattacactatgttttgctccaatttattagtattctactggtctaaatcagtgatttgcagctgagattttaatttaattcatatgagaagggactgagcatggtaatttttaaaagcttcccaagtgacttattgtatagccagagatatgaaacataggcctaaataaatgcagtgcccaacactatttaagatctgagactaacacaaatagaagagttaggtctttcagagattgtttccttattaatacagtctaatatgtaaggttatattctctttttctgtgtcatttgatagcctagtttaatttgtctcccttttgtaaaatcatcaaaccacttttcttcccaccaccaggatatagcttctcagtctgatttgcagaaatttcttccacttgatattgctttccagaaggcagatctttttattccctttgttactttctctggaaaagtgtctatagtagagttagggattctgaggtttaaaaaaaaaagagaaagaggccaggcgtagtagctcacgcctgtagtcccagcactttgagagaccaaggtgggaggatcacctgaggtcatgagttcaaaaccagcctggccaacaaggtgaaaccccgactctactaaaatacagaaattagccagacatgatagcagatgcctgtaatcccagctactggggaggctgaggcaggataattgcttgaacccgggaggcgggtgttgcagcgagccgagatccagctattgcattccagcccgggtgacagagcaagactctgtctcaaaaaaaaaaaaagaaagaaagaaaaaagaaaaaaagtacaggtacagaaatgtagtgagaaaccagtacatttgttcaacctgtgtggttatatagaaatttataaggtaagcttcaataatgaatttattatctctcaaatataccaaacatacacatcccaatgaagttgcttgttttctctgaggccattttttagacttttgaatgatgaggtctgtttctattctccatctcagttcttaaattttaagaaaagggtaggcttcaccacatatataaggaatttgctcagatacaatttggaattgtcagaaactgatgtctgcaccttcaactttagtttgatcccagagctgtcatttttaaatgcttaagtgaataattttacatagattaaaaacatagtgaagacaaatattttatcatcatctgataaatgaggagactcgggaatcagtgcagttgacctgggatgggggcaaaattctccaattttccagtttcatcatgcacttaaaacagcccatgaaaatttttaacgatttcattaaatatctaaatgtaaaacttatgtacttacaggctaaaggatttcattcaataagtgactttcgatacctcttatgtgaatatgattttattagatttttggggggaataaaaaagtaataagatatggctcctgaactaaagaaatgtttttatccttttgaagaggtaggacatgcacataatagaatatatacatatatatatacaaattttatatatatcttttatatttagctgcatatatatatctccagtgatttttattctggatatatatatatatatatatatatatattcactattactctctctctatatatatgttcagtaacttttacatagataaaaacatagtgaaggcaaatatttcatatatatctataacatatttatcttagatatattacatagtaatatatggatatttatagaaatgtatactcagaaatgtgtgtatgtacacacacatatatctccagtagcagggtcttctttttaatagatgtggagatgtggatcttcatggacaagattggagactgctctggttcaaagaatatgaggcaattttattgatgtttatcatgggggctgaattacaaagggatggacacacatgagacagaaaacaactcctttatcaaacgatattcataatcccttttgaattttagaactccaagtttaatatttaacagacagaaaggtcatacaactttttaaggtttgtggaattctttatgttggtaaggcttttagtttcgaagctctcaacatctcaagatattcatattttcatcattgacatcacaacaaatgccaaaaatgtacagatcccacatatccattatgtccctgaccttgttgatcacagtaatcatttggggtgtagattactgaggttacccttgacctgtagtattagaagcctattgttgtatagcaatattatcacaaatgtagcagggtaaaactgcacatatttgttatcttatggtttttgtgagtctggaatctgagcacagtttagctttggggtctcttacaaggctgcaaattcaaatgttcacctggctgaggtctcatctttggtttcacaggggaaatagttgcttttaagcttatgtaattgttgtcatggctgttggccagaaaccaccctcagttcctgccacaaagtattctccattgggcagacgtcttcatcaaaggcgaaagaagagagtcgggtatctgctagcaaggcagatgtcatgatcttatgtaacacaattgtgaaattgatattccattgcatttcctgtcttctatcggttagaaacaagacttagggcccatctacataccgacagaaaggaatacacaagggcatgatattactagaggatgaggataattggtggccatcaaagattgtttaccacatgtattaaatcaacatatcctgtcttggggtctgtattttatgatctgtacctatccttcaggtaactattatgattacgcagatttgggaaataccaaacctaggggaaaggtgaaagtcaatacaaaatagatgtaagttttcagcattgttcaaaatttaagagaaatgggcttccagatgttggagattgtaacattgcttaatcctacgtaatcagaaggacaaaatatccagtgacgcatcccccaagcccaggcataattctataaggcactatgggattaagtgatgagtgatataaaatggcacatgtgtttttactttattgaagtgtattaccatgtttatggagaggagagcttgtgattgaggaaggtttcataggccagatataccttaaagtagaccttaatggatgagtaggatttggatggagtgaagaaaggtggaatggtgtgggaataagcgggaaggaagaagaatcatggaatggagaatagtcttcctgtagcgaaggtttgtgctgagatgtacatagtgtgcatggctattttctgagtctgagaaccctctgacataacccttaaccactgcgaagacctgtgggtgaaggtccccagtccagctgggacaagagggactcaaaaggaaagaataggtaaatcaaaggaagacacttgttcttaagaaaacgacttacaaagaatgtatttgatgcataaatagaatgagggacacttatagcctatgttatatagatagcattgaagaattgtggcagaaatggagatcagcacgacatttgtttatcaatgacacctatcatgagcgcctttacggtgttatctggcaatataatataaaagttgttgattaatgtttttaaattagagctaggtcacaaattggttaagtataatgttagagtataaatatgtgacaggaatccatgaatttgttcgggtgcatattagactatcatgactgagtacacacaactagcactcaagtaacatatcccctaacacagaaaatcaataatactatataaacataggttattaatatctgagataataactagatcatgtacagttatccagcaatacttatttctttgacaagctagactggactgggagaaatagtatactggtaaagaatcccatacatagtctggtggtaaagaatattgcccagaccttttaccaatcagtttgggtcacctgcagcttcaccgtctgtgaaaggaaagcaacaccgcccctggcaacctcactaagttgttacagtgatcaaatatcatttatttatattacactttaaacatgtatagcattttataccttccaatacatttttattaagcacaagccaaaataaatattgtttattttcatcattggactacagggaaaattatacagacttgttatctctgttttacatttttcatcatgctttcatattagaacaaactaataatcaggatttataggtagcagaaagcacacatttttaaatgtggcagatatttttacttctaacagcttattctattttctgattctgtacattgcagcaattatttatctaatccttgcattatgaaaaaaagacattacttacagaactgctgtagtttacagattgtggacatataataattattgtaaattacatttgggaaacctgggtgtttggaagcagaactgcagcgtgtaggacaccaaattaagtcacatttgtctatttatgcagcttacatcttattttataccttggacaagaacatcccaattgatgactggattatggaaacaatcagtggtgataggcttactcatcaaatcatggatctcaaccttgatactatgtattactttcgaattcaagcacgaaattcaaaaggagtggggccactctctgatcctatcctcttcaggactctgaaaggtttgaataatttcctattatgcttttcttttcctgtgggattgttataaaatagctttgcactctgtgttagaaatggccctgcaccatctctattagcaacatggctgcagtggacattcaaaataaattaaaatgtagctttttatgctcaaagccgacatatcaaagaaagatctgccatcagcacatggcaaacatatttaacatgacttttttcatttacagtcctgctagaagtttattgatgtcatgtatattggttctattcaaaatataatgaaatgcttcagccattttatgtaaggggataaaaattaaaatgtattgaattatgtgaatagcatactattgccgactttaggtattttctttcaggtactattatcccttatatattaaagaaaattttgatatgacaagacagaaagttccaaaccaaaaaaaaagtctatttattgtaaagaaccaaggtagaaactataaaaaagttgcaatatgatatctagaagaaaaaatgttcatacagagaaacactaaagctgaatagtagtgattacatcaaaatattttcatgtaagtacttactattttagagcacagtattatttttctgggggacaaatggtttgaagagtcatttaacaattgaaaataatttgaaacattcaaatgattacaataatttgaatgtttaattcatttaacaattgaataatttgtaataagtttcacaactaatatttaaagttgtatatttaaggcatgatatgtgttgttctaaagaaggataacttagctcttaaatctgtgaccacatcatacctctatatctggcagaaatcttaatacatgatagtaaagtaaaaaattagaaacacacgtatgattggcttcttctgtttgacatactaaaagaagagtcttagtataactgtatagcctattcctcaaatcttctaggaaaggtaccctagtaaataagggacttttgaattctgatgagtgagctattcaaaagctgggttttggtagcagctaatctgaaaatttgccaacaacacacaagcaagcattcagccaaagcttgcatgacagttcttaatggcggagtagaagttgggaggaaagtaggatagaaatgagttcatctttgtcatctaaattttgaggacttcatgtctaaatcaggtttcactccaaatgagcaatcaaaaggcaactcgttattcattttgtggcagcatgaaatgtaactagatagtgttttgcaaatgcttcatttttatctatagatgagtgccaaattaatttcatactcataatgtttgccaactgagagatctgaggaaaggttgaagatgacttaaggcatccaaatgtgttaaacagcagagtgatgagttatcataagatttgcaggcccacattgatagccatcccaggaattgtttaatgagctcagtatttcatttggtactgtttaccctaagtgccctaaacacatctagaaaactaagaacaagttcaggaatttgttctatgacataatggttcaaagagttatttctaataccctgatttgaagtttaatattgtctaccctaaatgtcatgctcgataatagtcaattctattttaaacacatgttgtttatatgctaaaataagtttttgatcatttaaaattactcagaaatattgatattggtcacttttattaataattttgtacatgtatacatcttacaagacacctacaatggcaaatgttctaagacaaataaattactcatcataagagatttcaagctacaacataagcattttaaagatttggtgtagagccaaatctacaccaaagataaaatcatgctattgctctctgatttaagattttcacttcccaaagctgcagcagagcatactgtgctcatcagaatgtaactttgtttgcctgagacaaaggcttagatgtcccgaagctgagaaaactcccagtactcactgggtaatgggcaagtatttcatagtaatgcttgtgccaggcaggtgtccacgaacgtcattccttcatatttagcctttgcaaggatcgcagcattttattctagaggctagcatttggtctttttgatattaacaaccagtcagagaagtacaggaaactcagtcaataatcactgtttaattaaaaggacatttgtaattagaaagggattatcttactgtaaacttatgtaggtacacatatatgatgtatctaattctttctttggaatgttaattaaaagaatcttgaccttgattacttgaccacataggaacctgcacatacccacctttccactaatcctccccagggtcccactgggatacatacacactgtcaaactattggaagacttatgtctatctctgccctatcctgtgggtttttcctgctgataaagcatgcttccccatgctggcctatcgggtaatagagaggaaggatgctcccaatggagtagaccacagaggattctggtggagggagggagtcacttcctacacacaaaagagtggtattcagagtgaaagcccaatagagtacagtaaattctctgggcatccttagtcatcattctgaaatgtgcctctcccctatccaagaatatagcactgaaagctttggaccagtatagaaaaaagttctagtcgtcaaattcttttatgacaaaaatacatgatttttcttgacaaatgatagaaacatatgatagaaaaaaatcaaggcacaaatgtaagccatttttgtctctaataaaaggtagttatgagaatccatatggtccctgttggaaaatactcttcagtagataacattttgagacattcaaaatttctcaagttctattcagtgcagctttgctagtagaaaaataaattcaaaagataaaaatgagaatgggtttgtctatcattacatgtggttatttatcccttgctaaaaatatcttagactgcagacaatgcatgtatatgattaaagataaagggcagacaaagaatggagataagggtggtagtctcgtcttttttgacataattctaaagaattctcacctaaatatgagatgctgatgaggatagtttcttaaatgtgtcccagtctggctgccaaacctacatacttcctggattgggtgggcacttatgaccttgacatatcttgtcaaggatcaggtcattcttgctggggacctgtagcacttccaacaacatactgtcctttctcaacagctgtgttaggatctcagttcaaaatcgtattcctgtccataagctacatataatgcaactgcctgtcaaaagcatctttatcaatactataataaaacactataataaaatgtatttgagaagccattaattttcaatgggaaacagaagagaaactctagataaaattaaactgtggtgattaaattaaatggctggtaaacctttaaaaatgtttgttaaatcttgacaaggtacaagatttcataaaacttatttaaagctttcagagagcaccaaattctaaccactagcccatcagagagtgtcaagataaataaattctgcagctctactatgcagcatagttcctataaataatataactgtattatgtacttaaaatttagtaaggtggtagatcatatactgtgtttttaccacaataaataataataataataaaatgggtgggaggaaactttgggagtttggggcaagtctgtggctttgaaggtggtgatggtttcataagtatatccttactctcaaattcattgaattgcatacattaaatatgggcagctttttacttttcaattatatctcaataactttttaaaataacgcttatagaattgtaaaattataaacattggccgggcgtggtggctcacacctgtaatcccagcactttaggaggccgaggcgggtggatcacgaggtcaggagatcgagaccatcctgactaacatggtgaaaccacatctctactaaaaatacaaaaaattagccaggcgtggtggcacatgcctgtagtcccagctacttgagaggctgaggcaggagaattgcttgaacccaggaggcagaggttgcagtgagctgagattgcaccactgcactccagcctgggtgacagagcaataataaaaatcctggtatatgtagtgtttcccaaagagtaattcacaattcaaaatctactacttatcaagatatcttttcatagaatatgtgtatatgttatgtttaaatgaaagaaattgtaattgatttctgatttagaaatcactcttaggatgtaatagacataaaccctgttcatctgaaaggggctttcgttaacagaatcaatatctacgtatttcagttctaaacattcttattaggcaatgatttgtgctgctttatttagaaaaagaaggaccaccacctgtagggcgtttaaggtatttttcaaatgatgattgatttgctataatagcgccacatctgatgagagactgtattatcagttgctgcctattatattttctctatgtgaattttactgagacatatacaggaagcaatcggcaagtgttgtatcctacctatcaagtttgaatggaatcaagtgagttaaatacgcccaaaagactcaaagctcaaagacggtcaagtctaggtaaaaataattctactagtaattgagggagggaagcttatgaagatctgccttggtcaaaatgccatgtaattttcagaaatgtgataatactagagatttacctcttatttagtttcatctggttagcagaaaaaaaaagtcatctttaaaacaaaatttagcaatttaatttttatatttttaaatttaaatttcaaaaagtcatttttgagactattacttgtaagtcctctgaagttgtcaacaacaactcaggagctatcttcacaagggctaaagtttatcaagatatttagattatattgtaccatatttatggttgccaattattttacccagtctatgtgagaattggtgaagttgtttaaaaaatagtcacatacaagaaaatagcttcctgaattttcttaaatatatatatgggtgataattacttggtaattgcatgcagtttttttttactgttaattctagttttaattaaatttatataattgttctcagtttatgtttagagggatatgaaaagtaagataattttaggatgaatttgtacagcaaaaacattattttcaattttttttctctgaatacttatttaatagaaataaacatgtaagtttgggtccttatcaattttatttcaagagggcactagctttgaaataaaaacttactaaaaagaactgttggtttgatatgtcagctttcttgctaggaactgtcaaagtctaataatgttatttctttttcccccgcagtggaacaccctgacaaaatggctaatgaccaaggtatggtggctcaatctgtcattttgtgttccttgaatcaatcctgtctgttagacatgtcagtcattactttatattcctcttttcacctggaccatacacctgatgaagcagacactggcgtgacgattaatcttgttaatgaagttctgcttggctgaggctgcggctctgataaggaagatgtaaattttcttgagaggaaattgttttgtctccattctgaaggaccaattaaaatgtcaagcttctttgtatgaaataaatttttagtctctgtctgcacttctgaataattcacattaagtataattaagctcagcataattttcaagctgctcttgcaccctttcctgagctatggattaaagttctgtagctctacagagaaaacccgtaaattatgtgtgattttcctctgcaatgagcttcttttaatatataaaatcaaagttgggtcaccttttttagggcattatcattgttcattttgaagccagaaagctcttattcagtgaatcagatgctcatttgactcacagcacagtattttctcccttttccttatttatttactaaaagctgatttgtatagagaaacaggtaaagttttacacaaaggcaaaatggagataaataagagttatccatcaacttataagtggatatgaacttactattaccgtgatttgtagactgattgataaattaggattccgttatctttacacaaaggacaattagtagaaagctgagggagacaatgaatagtttatgagttttatttttttgaggatgttactttctttccagaagagttaggaaaaactataaactggttgtagtcagtgctgtcagtatttgtagattgagagtctgcagttcatatagtttgtttccttcctgctttggacacctactgtgggcagtgcttacttgcaaacgtgtctcataaggcaccatgtcgtgagattaggggaatgctttctttcaacaggaatactttttaacttttgacaaatactaagcctctggatgctggctctccctgacagcagaatgcttcctgcatgagtagcattttcttcagtggtcctgtgtttacattcttctctggcgatgtatactatgcagctgcttaacagaacatggctaggggtttacgtggaataattgaaatgggactgtgcacagcaatggctactcagggttaaggttttcattaatctagctgctcctacttgcttccactgaaaatgttttcatacaattaatatctactaaatgagatttgtaaaaaatattaatgatgagtaattatcacttggcatgtatttacataggtaacttaaatattagtcttggtcaaatccaaatctggaatagttaatagcaccagctttattattgcagttataaaacaattgaaacaacctctcataaccttctttacttaaataaatttgaagcttccgtagacagataactcctaagttttgaaattatattttaaaataatagagaaaaagattaaaataactgaactagttgaaatgtcattattagtcacttagttgacaacaaacatgtccaggcttctcaataaatggctttccacttctctctgggtactattatattgttttttcttttgttaattgcttttagttttttaaggtaactgttttgcataatattattttaaaccaccacacatatattctgtaaattgattattttatgaaaggcaaatgagtaaattatttcccagtccctatgatcacacatcctccatggattttactttgagtctcacatctacaataaatcaggctagttctcaggaacaaaaggaccccctcaagaattactgccagtggctgagtccattaatatatttagtcagttgttctttttcttcatctaatattactcagaaggattctgtcacatatgtaacttggagccatattcagtcatggttggcatgtagttagttgatcaagttgataggttctaaattttacatcaaactcaattcacttataaaattgagagggactgatgacatataatttagtggttataaataatatcttcaaattcttacaaagaaagcatataaaatttgctgcaccctcaaagcacgttttataaacaaaatcagtcttctgagttgatgaccacatgcatgagaaataacccagattaaagatccctctaagattgatgaaaataataggaagaggctgatcttaatactcccattcccagaacacagcaaattagttgaatatgttttaccattcccactgttagacctatttgcccccttctcatggagaaatgatcccactattacatttatgacaggagctgagtttctgctgagagaaaattccctcagagaaaaaaatgtggcatctggggtcagaattaaccttgcaaagatgaatcctaaataaagaagcaagaggttgaatttgacttatatgagagaaagtgagaccagttttgattgtcctaaaaaaagtatctgttcagattcttgtcacaattattattattttagggattgaagatctgccatgaagaacataaatgtgaaaacaatagtcatttgaaatggttttgatttggagaaaatattttcttctgagcaatggtatagtagttgtttgacaatgataggcaattaacatagaacccctgatttctttatgtaattgtaaattgatgaaatatagcatttttaaaactttctaatcttgaccacctctataattctccttttttgcatcaccctatctcttgctccatatcctaattatttctgtagattcttccaggcacaggtggcaaataagttgggaagtaaaagaaattttagagataaaccagagtttcgttttttgtagggttgggtaaggaaattgcacaggctctatgaagcgggtgcagaggttagatagaaaatctatgctttaaaaattatttttaatttttgtgtctacatagtaggtgtatatatttgtagggtacatgagatgctttgatacaagcatacagtgtgaaataagcacatcatggagaatggggtatccatcccttgaagcatttatctgttgacttacaaacaattccattacactgttcatttaaaaatgtacaattatattattgactatagttaccctgttgtgctatcaaatagtaggtcttactcattatttctaactatatttttatacccattaatcatcttcacctcccctctccccagccccccactaccattcccagcctctggtcaccatccttctattctctacatcgatgaattcaataattgttttgatttttgttttgacttttgattttttccctttttttctatattctgattaaaactccttcaatttgtctgtgctgttgtgggcctatgtaatggtaaaatgaaccgctatgcagctcttgccagcagtcactgttttaaaagctttacaggagtgactcacttaattctcgtaacaatactgtgagaaaggtattgtctccattttagcaaggaagaaagtgaagctcagagagatgttatttgtctattgaaacacagctagtaagtagaaaggccataaatccaaccccagaaaccacattccaaaagccttttttttttaattattctatttttatttattttttttaattttttgacacagaatctcactctattacccaggctggagtgcaatggcacaatcttggctcactgcaacctctgcctcccaggttcaagcgattctcctgcctcagcctcctgagtaactgggattacaagtgcgtgccaccacacctggctaatttttttgtctttttagtagagacaggatttcaccatgttggccaggatggtctcaatcctcctgaccttgtgatccgcctgtcttggcctcttaaagtgctgggattccaggagtaagccaccatgccccacccaaaagccctgattttaaccatcaactgcatgacaacagatatgttacatgtatatagccacacattcacattcgacgtatagctataaagttgctttaactgaagttttgtttgctgttatttgtcctatatagatcttccttttcacatctctgaatattctaaagaacaagggaaataactctcaatctgaggtcatcttgttagtggggtggcaacagcgctgattacatgatcctgacacttctttatttcaggaaacagggatggtgataattcactgtctaagccagcttgggttgtcaatacaaaacgctatatactgggtgggttaaacaacagaaagttatattctcagagctctggaagctggaagtcccagatcaaggttcagtgtggtcagtttctggtgagggtcctcttcctggcttgcaggtggccttctcgctgtgtcttcccgtggtggagagtgacctctctggtgtctcctcttcagaggacactaatcctattggattggggccctaccctatgatttcatttaaccttatgatttaattacttccataaaggccctatattcaaatataatcatattgggggttagagattcaatatacacatttttggggaagcaattcagtccatagcatccacatttaaaaagaaagctgttatttcactccttcactaattttttcccagtttttcagaagcagaaggtaaacattttacccaggatcacagaattagctgttggcagagttagaactcaaaacttttctttctggttcctagagtgtgcagtctttctactgtaaatggttactatatttaaacatttgatttccattcttctaaaatcagctccaacattttagtgtctcacagaagcattttagaaaatccctttgttttgagtttgcaatggaggttagctgtaactctgaaacatgactgcttcttaaaagtgattattagatcaaacttttaaggtatttttgtttgcatcgttatgtcccatttaatgtccaaatattgttctccactttgagatgtctttgtatgaaaatcgatattcttagcatgagcagaaatgtttactctttcatgtgtgtttctacgtctgctcattgtaacaataggtgctatggcgatgatacagtaccttaaagtgggcaggattctcatgaagtgattttcaccattgctgagatgaattacaaagaaaatgctcactttgagcactctcaagtgtatttaattctccatgacctggaaaaggggtgatctgaaacactagacctagagaagaggcctacgtacatagggcagtttacagatccagataaagacagcctgctgtaaactgcccgcccaacaaggaggaagaattactctcctgtgaattgtggtaatggctgataatggtctagcttttcatttggaagtcactcagtgtgtgctataggagcactggaatggaattagatactttcagttctagcacagtcctgccactgggacctcttgtgtaatgttgggcaggtgacttaacatctctcaacatcctcacctgtaaaatgataagttcagactaaattatcttttggtttctttcaagatttaagattctgaagttttaaggttggtattagaataaaaactcaggcataacatctttgcatagtgaagcatctcacatttatggcttttccactatgtgtcaattactcttctatgcattgtgcacatgcaatcctatttgattcttatagcacccttacagatgtagaaaaagagacagagaggttaaaacttgcccaaacactcacagtatgtaagtggtgtgaaagttgattatacaaaatggagtcactcatgtcatacccaactaaaatggagtcaggaggttataaggaaaagcactcagatcacatacatttattccaggaactgtcttgtgagactaaacccaaaacttcaaggacctggtcatgattctaagattccacatcttacttaacacctgctgacactcagcagctcctggaagacactaccagcaccaattaacttactttcaaaacaacttgcataaccttcctctattccacaataaaactccgcctttccctttattctctagactcacctggggctaccttggtttgggtgtcctgaattgcaattcatattctcaaataccttcttcgctcagagattcacctctatgtatctttattttaggttgacagtgattaggcccagatacatacccaggctacctaactggagaatctctgctcttgacgttgtgtaatttctggaaatgcagactcatgatctgtcatcaagaaagttatacctaaatggcatcaccataagttcacctagtttaaaggactttgtctttccttaatagggtattcaggcaaagtacttaacactgcacctgccattttacacctcagcagttttaatctcatgaataaacagaatgttaattgtttcaaatttcagggaaatagggtttttgaggcagtctagtcaagcttggaatttagttaatgtaatccagactttgcagggtttggattacagcagccagactgccgtttgaaaaatggaaacctttagtgccttctgatgggagctgtttaattgaaaattaaaacctcttcttaccctattattgtgcatagtttcaacacagtttattattcggctgcttgctacacccacttgaaaaagctattctcacctgggtttttcacaggttcaattctgtaaattaggactgtggtgaaacagtagtagcagaaaatgaataatgtgcttttaatggagtgttaaggtgcttatcatgttcccagcaagcagtcaagtagctgcctatgtcaacttctcagcagttttcatgttttaataggtaactctgaaggaacaaaaacgtactcagtactcataggaattgatgtgattcatgggataattttaaccttctcacacctgtaaggtagacatttttgtttatacacttcaaataaaattccataaacaggttcttcttgtaagagccactgtattttggatgccatttccttgtacagatattggccaagtacacggtcttcctagctttattttctgcccacttcaatcagccctagattctgccgcttcaattttctttccaaaacagatgggtcactgttgctttggggatgagtcagttctttgacatcaagaaccttggctatctgactgtaacgtctctttcctggtgtcatggccaatagatccctccacatatgccacaatcacaaatcaccctggaaaaagtgcatttttcacaactacatgctgtaatgtgtaccattttctcagccttagctgtgctttctctctttctcaactaagcaaagtcttctttgagactcccttctcaattttacttttttcaagaatcctttcttacctttcttgtcttttattcacctgtattttcataacacccatcctatttttattgtgttttccatttcttcttatactttgctatttatattcttagcttcttgaccagattttaaattcccaagaacagagaactggctagattcttcacattgtcatccctacctccctaatttagaatttatcctattttagttgtctgataagtgtttgtttaatagaatcataacacaaatgtttggggaagcagctacagagtaatctggaaagataagttttaccattgaatgaaaagtgtagattggacagctcaaagtaatagtgcacatggctgtgtatattggagatttactgatcttgggggagacgagaagttatgcatatatttccaacaggaaaaagtatattcaataatcacctactaaaataaatgctaaatagaaaaacaagttctctgtaattcagctgatggtagttacatttgtagatggctacgacctcctgcactcattttgtgacctccagtcttgctgtccttccttgttagcagaaaatttatagatttgaatttcaccagctgcttggaattctgagtacagaaaggagaaaatcaaaactaatggaagctgataagtttgttaaaattgtggctatgaagtatgaaaagaactagactcacttttgataacttgtggattactatgtatccagtactgtgctggcactagaaacattagaaggaaatggtcctggcaaagcattagaaggaagtatggttccgtgggtccattttcaagaagcttgcaatatagttaggaggaggatattaacacttccagtccagtatgaaaaatacaaaatgccaaatcagatggtactgtctacatgtgtatgttacgggatttcagataaatcattgtgggctggattagaaaagacttcttaaaacctaagactgggctttaaatatatgagtagaactagactcaatgcaaactattaccgggggaagagtagctgatcccttatgtagagaaattctaggatggaaaagttaggaagccaagatgctgggaaaatagtgaggactacaggatgggctccaggaacatttaggatataatttgctcaggcacaaacatatctcatgcctacctttgcagagtagtaccttatggcagagacctatgttggtgaagaggcttttgctatttctctctgctctaatgtagtagttctggggctttcctacttttcaacatatcagctagctattgtctacactggccagtgaaggcctgcctgctcccttgtatcccgagccctggaaacccatccactcttggttgctgatattgatcatttcctgcttggaggggtgtgactgtgggatagggagagaaaaggatgatgggatgggagtaggaatggggcctcagtagcagtcatcttcaaagaattttcttggccttttttttttctttttaaccacttctgttgtaccttttctgaagtggcaacttcactttttccagtactctgcatggttacaaggaaactatttttcattctctgccacagccttgttttgttctgcatgttcaattgagaatagagccaccatctcaagtcatacatacctaaactctcactcttacaccccaagaccaactctttgaagtgctctaatttctgtccacaattttccccgtttctcctctcttttttttttttttttttttgagacagagtctcactctctcacccgggctggagtgcagtggcatgatcttggctcactgcaatctctgcctcctgggttcaagcgattctcctgccccagcctcccgagtagatgggattacagtcccctgccccactatgcccggctaaatcttgtatttttagtagcggtggggtttcaccatgttggccaggttggtctcgaactcctgacctcaggtgacctgcccgcctcggcctcccaaagtgctgggattacaggaatgagccactgctcctggccccctattccttcttttagttatttattcacctataatgctaaaatcatcatcatcagagtcatacagtatcagccacttcaaatgaaaccctgtgtttattcatctttctgagctatagttttctcagctataaaatggggttagtaatgtctgcctcagagatgcataattaatattgccatatttattggaacagtttattctgatccatttagttccacagtcatccagaataatctttctaaaatatatgtgtaattagtcagagttttgcttaaaatatcttcagtggatccctatcctctataaaataaattctagaccattttgcagagcatttagggagttttattattgtacctctgccttttttttctaagctcatccacctcacggttctctacctaataaatcaagacagatctttatctgtccagctcctttggttccctaatttttgccttttcagtttttgtccactctcccttgtgagacatcaagaatgtgggaatgagaagtactagaattcacaggagtaaccaatgtgtttcttaaaatatatatgtatgtgtctgtgtatttatatatttatatataaatacatatatatttatatattacatatttataatatatatttataatatatattatatatttataaattttatgatatatatttataatatattttatgatatatatttatactatgttatatatcatatatatttatgatatatatttttatgatatatatttatatatttatattatttatatatttatgtaatatatatttattatatatatttttatatatgtatattttcccccactggttggcctggcaaagtatactgcttttactttggtgcttgcaaaaagaattctcacctcacatgccacctcctctgagaaaccttttgctaggcataagtagataatcatcctgtttttccactgggtcacgtgtttgtttgttttcttttttttgaatttttggaaattaccatatggttgtaagtattcacttaacattttccgtctcactgacttacaaacttctgcaatagtcattttatattcctaatgcttagcactgtgaatctacttaatgcatttgttgagtggatggatgaagcacggatggagacataaatgatgaaatactgtgctccaacagtgtcgttatctacacagactagcagggcaccagcagggtgctcatgttctagtgttttcagactgcagctgcaacttccagatctatagtcacttggaggagagaactctctcatcctcttctgcctcttcttcccgggatgcttggcaaatttgctcaggcacaaacatatctcacacctgcctttaggataagcttgtgaaccacgcagatgggggaggcttttatggatcattccgtggcctttgagaacagatgctcttttataagccaaaaaagattgtctcattctttatgttgtagcctggcaaatgaactagctcttggaaatatctagtcatccaaggcagtgcccatatttggaggaacagaatgctttttagattttaataaagactaagctgcatataaaagtggtttcttagacccctaggatgactgttacttcagatatactagaggcaagtgtgcataaaaggagattccaatgacaggaaggacttcagagaccaccatctaccaccatactactgatattatgaagccatctttatgttttattctattaagaattcaattgttattcagttgtttcattcctaacttgcatgaataataattataataactaataaacatattgggctttagctgtgtggaaggttgtgacaagggtgatcaggagcagctgacaagttatcagcagccgggcaagggagatagtcaagtgtagttattgtcacataggttagaacttatcatcttttctcacctgaaatctttaagaaggaggttaactactttcctgttaacaaaagatcttgatctgtccagctcctttggttccctaatatttgccttttcagtttttgtccactctcccttatgagacatcaagaatgtaagaatgagaaatagtagaattcagaggagtaaccaatgtgcttctaaaaacagaaatatatataatatattaatatatgatatataatatatatatttctttttatatataatatataaatatatacatatataatataataaattatatataatatataataatataatatataatataatataatatattataatatataatataataatataatatataatataatataatatattataataatatataatataatactataataatatagaatatatcatataataatatattataataatgtgtcatatatcatataatatattataataatatataatatataatataatataataatatataatatataatataatataataatatataatatataatataataatatataatatgtaatatataatatagaatatataatattatatataagtatatataattataattatatatataattaattatatatttaataatatattatatagaatataataaattatatagaatataataatatatagaatataatatataatataatataatatattgtatataatataatatatgttgtatataatataatattataatatattgtatataatataatataatatattacatatataatataatatattacatatataatatattatattattttatatatattatataatatataatatatattttttatatatttatattgtatattttatatattttatatatttatgtattttatatatatataaatatatttatatatatatttatatatataaaatatatatttttatatataattcatatatatttttatatataatgtatattttatataatatatatttttatatataatgtatattttatataatatatatttttatatataatgtatattttatatattatatatatttatatatattatattatatactatatattttatatataataaattatatattatatattttatatataataaattatatattatatattttatatataataaattatatattatatattttatatataataaattatatattatatattttatatataataaattatatattatatattttatatataataaattatatattatatattttatatataataaattatatataacatattatattttatatataacatatatatattttatatattttttatataatatatattttatatattttttatataatatatattttatatataatatattatatattttatatataatatatattttatataatatatattttatatataatatatatattttatatatatataaatatatatatatcggttggtctggcgaagtatactgcttttacttgttggcctggcaaagtgtactgcctttactttggtgcttgcaaaaaataatgcagtatttgtaaacgtttttcctactttagaagatggtctctgcaagagaccacatgcatgcctcagacagtcaagacccattatcaggctaagatgtaaaccaagagcagaaattaggataagaaattaatttgtttaaatttgtctaggatacccacagtttctattttgtatcctggtattttttttgtaataactgtatgctcactcaatttcattttattcgtgtgtgaaattattatcttagttttgaatttgatttctaaggatttttaaaaaatgaatttacttctcaggaagagtctaacctgttcatattttatggcctaaatacagaaattggaattgcaaaaatactactacttatgattaagagaaatatgggtaatggcatatttggttttcttgcactttggctcagagtagtttaccaaatgcattcctatcctgcagattattgcccttagactttccacaggtggaaaataaaaccaaaggttttgaagaagggaaagcagcaagaatttgtagagcaccagggctcaatattggacaggcatagcagtaacaatgtattttctttcaatcagtgaactttctttcatgttgttttgaaaacaatgtgttgaaccttaggaaaaggttaagagagctcattagttcttttctattaaaatatttgaaatatcctacgtgttggttatgattttgctttctggtttttgatgcccgatgcctttgtttaaaatcagcattgttatcaactgcctggtaaaccgatcttttagaaacacatttcagcctctgacaaatcacctactttaaatacggtctgtgtgtcagatggacagtaaaattatattcaggtaatattaatggatattctttatctgctggtatacaagacagaaaatcaatgcaatttctatcatcattagaattattttcagagaacaaattttaagatcaagaagatatctcagtgctcagcacccttggaaagatatacattgaacatttgttagatggccagtctgtccatttgatttagattatggacaatacgtttttctctagggattgattgtatgaacgtcgtcctggatgaccctctcttatgcccattcagggaagatggattaaacaaacgattagaactaccacatccacttttctccatgtcttctgcagattaattttccattctctcttctctgaacttataaacaatcacacagaaaaactagactctaggactgaaatcccaattgaattaatctttgttcagtgctgaaaattttttatcgtggaaaagattctcaatctgcccatgtgtgctgcaaataaggatttaatataaacattaatgttatttcattttatacgtacaccacaataaaaacatgcaaataattcaggtgacatgtaaggataataacataaataataaattgcataatagtaataacttaagatttgtacttattattaaaacattacaaagcatcctagctagcattagttactcataggacattgagaacacatttttgcacatcacttcagttagcacaaaggaatataacaatgaacagacttcctaaaggaagtcatattacttctgccaattttttcttcaattcagagaacaggtagcagggagatcaagaagacttttgtccaaggaagcatatggtatgtgccaaaaagggataaaaagaagattccttatgaggcccatcttttaaataaaatgtgtaaggcaaccccttaaacgactttatgacattttaaaaattcaaagaaaggagaggtatatgaaatttctgattaggacctgcctaagcattacctaaataaaatatatttaaatatataaaagctattttgaataactcaaaacagctacaaactccctctgttttaactcagccaatgcccatttaatatttatttaatttttgtttctgaagctaccatttcctggttccaaaatctaaggtaaaagtagaaaatcatttgcttttattatcaaaactttggcagaagctttttttttttttatgaaattagctgcataaaattccaaagttgttaagtgaaaatcaattaattactctttaatatctcattcctccccatcctcaatttgtgttattgagaaaatatgggtacatagtaatccaatacagaattcttctttatatcctgtagaattatattcatatagtacactttgttttttgttgttgttgttgttgttgttgtttttttactgagccagagtcttgctttatcgcctaggctggagtgcagtgtcgcagtctcggctcactgcaacctctacctcctgggttcaagcaattttgcctccacctccagagtagctgggactacaggcatgcgccaccgtgctctgctaattttcgtatttttagtagagacgaggttttgccatgttgcccaggctgtcttgatctcttgacctcaagtgatccaccctcctcggcctcccaaagttctgggattacaggcatgagctaccgcacctggccttcatatagtacatttgatcactattcatataaaattgtattattcatataaaaaggaaaaaataaactactgatttctaaaatgctttaagccatgttgaactttatttgagggaagaaaactgaaatttattacgtgatttcccccaaatttatatttgaatttccataaatccatttaattatttagaattttaatttgtaaaagtgttaaaaatttagtatgatatgcaaaaaagtaattcaagattttaaaataaatataactatgaaacatataaagttatgtgactgaaaataaaacatttttatttgcatgcagttcttttaataatacttttgataagaatactttaataataattaaaaagcatttttaattaaacctagtagtaagtttatagtaataaatgaattaagttattcttaaatctttaatgtcagaaaatattaagaaccatctgcagttggttaatattaaccataaataggcctgcataggatctgattacaatgaaccaactctccctgtcatggcaggatccatgtctaatatatctttttatactactccttccctgaggatctaggactatgcgttgcatgtagtaagcatttaataaatgtttgaaagaattattaccagttttatgcttcattaataaaatgacctctgggatagggaagtattttatatctttgcattagctgactttcactccagctgttttctaaattctgattactcctctctttctcgaaatcagtgcttatgaaattaaccaaggtaactaaacacatccaatatttgttctacagcaacaagctcttaaaaatgctgtgatatgccaagaagtaacacccataaacccatatcctttcctttttagcctttattgtctcttcatttgacaactttgtgatgctctccttaaagcaatgggagaatcttttatcattattattattattattattatgtattggccacataaagggagacttcctgaaatttaaaagacatatttcagagaatggaaacttaacatcactcaaaattaaaattaaaattaaaatctgatgcctctgtctttagatcaagagatcttaggctcatcaacatcccagaaatgggttttgtggttttttggctgaagtggtgcaagaaatgtgaatcactataaatctaaacttgctcgttggtgacatcaactttttaaaaagtgctttctgttggacttgttgagaattacatgatttccttttgtgatattaatctaattataagggacaaaaagttaacccacatcaatatactagattctgtgagtagaatgtccaagctttaagctactccttgttatttagaaacatttctagagttcctttatctcacccagcgctttgacctatacggcatctgatttcttctacctattgaaattcacgatgtaatcaatagcctcactaaatctaaggggtgctgtacccatagagctatatgtgtatgtaatatatgaatatgcttattggcttctttttgcatcctgccacaaattacagggagagttggaaacttcattaaaaagacatttgccaggctgctggaggaaaaggaaaatcctccataggctacctagctaatttccagccgatacaggattattcccaacaggaaacatgtattgctttactggcctaagtgatgatgttagcatctcttttggctgactgctttgcaatctagctgctttcagttgctagaaaagtcatcttaatatttatgtagagcttccacctcacatcagccaacgttgatctcacgatgtctcgtgggcaaagcttatccgctgctcattgaaaccccaaatgcatcacagttatataaacaaggtatttgtaaaagggttagacttgtccacatttttgtcagcccactaaaattttcacaatttcagctcattttgattgttcctctcaccaccaccttccccctgtacacacacataggagcctgcatcctatctcctacttccttacatactcacagtcattgtcccagcagatattaaacatgccgttttatgctgaagatataatataaggtgactgaattaatttatcttattgcttgctagaaatttgacatcctaacttcagctgtgacttgatatcaaaagaattttttaaattgtgaatatagagtcagttaacaggattctaagttgtttcttgaaagctgttttgcaaataaaatgataaaatcttgggaaagctttagtaagggtagtgtttgtcatgcaaaataaagtcacaaaaccaggacttgaaagttatagagatgaagaaaactgaaatctctaaatgtgagaaaacaacctatgttactgtatctgagtgtcctggttggctttctctatgtcatccactgattggaactgctttcagaaataactgttttaagcaaataaaatagaaaattacctatactctggtctttgtttgcatacagattcacctctcaaatgttttacataagtagtctacctagatattctagaactcaaaatctaatcaaatgatttcagttctatgaatgcaccagtagagaaaaagattatctgtggtgaaacaccattaattaaattttggatgatagtataattatttctggtgaattcctggcttatttctcttaaatacggctttcacatctgttacacacctaatggaaggcagaatttccaataatgctatactgaaggagctttcttccctttatggtgtatttgtaggaaatattcagaccatatggtttgtgacataacctccactcttacttccaatgtggaatttcatttccaggtactgtatttgacacctaacaaagagaatacccaaagcccagttataagatgaaatgtgctggccccttgtaggataacaataattttccataaagtcttgtcagttgggtgacagtatctgcaggacctaggagccaggacctgagttatttctgttctaaaaggttcaggagaatagcatttagaccggcactgctgctgcacctttaataaaagactttaataagaatattgggagaaataaaaagaatggaggatggcatatcagtgaaacactgaatttagtttaagagagtttacttttgcgacttgtttttctcacacatggaaaataacattttcttataggtgtaagggtatgagagttgtcaggctttcttgggggtgatcaaagtaatctgttctgttattgtgtgtgttaaaatatttattctttttgtcttcattttgtttcatttgtactgacattgtgacatgctctcccaatgaacaggtcgtcatggagatggaggttattggccagttgatactaatttgattgatagaagcaccctaaatggtaagtatataaattaggtaatattgaattagttatattaattaaatggttaattcaagagtgtctggggcaaattttctatcaactacaagtgccaggaaccttggatttagtgtcttagtgggataatagaaacatgaagttattaaaaaacaaaaacaaaaacaaaaaaaacaaaaaacttctagcacattctgccaggagatgatgccaataagagttgacaggtatgtaaaaaaggagtcagttagagaagcccagcatggagcactttgtaaatgacacaaagctgttaaataccaagatttttaaatgttacaatacatttaagatgtttgcaggaatctaattttatttgagagaggtgatatctaaggttggttaaattgaaacccacccagtttcatatattaaagttacttggatttttgcctgcagggtacatttaattcttcaaaatcctctaccatcttagggctaaattttctttgtgttgtctacattagacatttatttctgctcatcctagtggagcatgcccaaatatctgctggctttaaggatgaccagatggaggtactatctagagctacatagaaggacaaggttggtgtgggggctgcattccaggatcttatccttagttttgctgaaacaaactttaaaaggatggactaatactggccaaattttcaggggactaatgtatgtatgaggccatgttataagtttctttttcattattgctgttgtttggtttgacttactaaaaagaccttcagatattcaaaatgtgaagatgaacacttgtatacccatcagcaaggttaagatatgaaatatacagcatggaattgaaatatcttgtatgtctgtgttttctcacatgcttcttaacactgttcctcactctgatataagtgctctaatttgatgtttactacgtatgtatacgtatccctaaacattatattgttttacagttttacaaatttatagaaatgatattgtatcctgctacaacttgctttcttttttaacgtagttttgaagatgtatccatgtgtttacaaatagctctcactcatttatcttggctgctgtacagtattctattttatgaaacaacaaaattaaccatttttgcaggttttcttaagaaacttgattactgaactgataaatttccatttgtttgatctccttttaaaaaatccagaaaggaagtcaaaattccaatctaaaaatagtttgctgcatgtgaaatagaatagtggtgtaaattaagtgattatttcttatcataggctgtgataatctaatgcagcaattttcccaagaggatatatatatatacagagtacaccaaatgcttgcatcaaagacttagggttatctctcctctggccaatggtagacttagaaatatattttcacctcttgacttatttttgaattgcctggcaataccttcctctgttattaatgcctttttcctaaccagcaacacgtagaacgtcttatgtttaaactttgagtccatttctgctgctattaaaaaataccccagatttggggtaacttataaacaacagaaatttattgctcacagttttggatgctaggaagtccaagatcaaggtgccagcagactgggagtctgctgagggctcattctctgcttcacagttgatgccttccagctgtgttctcccatggtgtttggaaagggtgagcaagctccctcaggctttttctaaaataagggcactaatcccgtttatgaggccaccactctcatgacctaattatctcccaaagcctccacctcttaatgcctccctaacagggattaggtttcaacataagaattttggaaggacacaagcattcagaccatagcaagcttcccaggatgctctttccaggctactcacaacttcctattgtctcttagactcctcattttccttcatttaaataacatgactgtccctggtaggtatttgactttcagacacttgttttaactaacaccttgctctggcagtccctaacatacccaacaggtagtttaggaagcacacagggctgggtgtggtggctcacgcctgtaatcccagcactttgggaggccgaggcgggcagatcacgaggtcaggaaatcgagaccatcctggctaacacggtgaaaccctgtctctactaaaaacacaaaaaattagccaggagtggtggcacgcacctgtagtcccaggtactcaggaggctgaggcaacaggagaatcacttgaacccaggaggcagaggttgcagtgagccgagatcacaccactacactacagcctgggcaacagagcaaggctccatctcaaaaaaaaaaaaaaaaaaaaaaaaaaaagctcacagaaggtgagaggagggacttgttgagacagaaaacagaccccaggccatgctccataaaatgggcataagtaacaataattccctcctcccaactttgcaatttcattagctcactctcgtgctccaaattttatcttaaatttcaacaataagccaaaaacattatatgtattcaagcagtcagtcaagaaatgcgactaagccctcagcgagtgcagggcacttgcaatgagctatgggcgcaaactgaaggacagaccactgcaggaccaatacaccaagagggttaattgcctgggtggacaaagcagaaatatacaccccaggaagatgaaagaggatgagaaaatccctagagatatatagcagggtaaaaaaaggaagttgctgaaattgggagaaacataattgttgtattttataccctgagatacagagcttctgactttggagttcatgcaggaaattagcattgtcccctttagaatcatccaacagagccaattttaagaagctatttctacaaggattttcacattgaaattcattcccagtcaagggaatactatctatactggtacgggacagtactttttgaagagacatactgccagaaaattaaagagggatttggtatggatgaatgagagagagaaattaacctataggtttcaaccactactgagcagtggttatgaggcttaaagcttgggcaaatgtaagccacagacacaaaactatgtactctcttaaactgcatgtccaaaaggactccagtattgggaagaattgccagatattgcaattaaaaatataaagaggccaagtaacatttaaattatttctgtgagtaatagataaagaaaaattataaaagggattgccatctcaatttatatatgcacccctaggtatacatgaataggcaactagaaataattctaacctaattgggcctcctgtatttttaattgtgaaatctggaaatcccaatttcagattgaattcaaaagtttgttgttgactatttgaagttgctattcaaattaaaataaatttttggttgaaaagaaatcccagcccacatttgacatgagcatataagtcaacaatcactttccttttcaaaggtgtcagatgttagaagaagagaaagagaaatccacatcattgggttcatttttgttttaccatttaagattcctagtgagaaaactgaccaaaattaaatttgacctggtacacattatctcacaggagaaagtcgtgaagattaaatagaccgatgccattcagtagctttgaagcagtttagatgcgttattgacattacttcttcccaattttctgcatcacttaatgatgttttagggatttcatgctaaatgaatgagatgaataacgtatctgaaatatttctagattccctactggaataacaaattatttcaggctgtctggctgattaaggtgaactgataacttcagagagccagggatggtagaggccaaactttatctgcttcctattctattttgctagcaaataaatgatgataagtatataatataactttagccttggctattacaagcaaatcagcaaaggcatctgaaaacctcagatttctaattaaatttttgctaatgtcttaagctttaaaaggggggtatgttttccaagtagatgtgcaagtgaggcccctgagtaataaaactccaattgtacttcacccttataaagtgggctacatcaaaacatttaatgtctgagtttttaaaccttgtatacaataaaatttcatacgtctccccttagagtgacagaattatagaggtttcctagctccctctacacttgctggattcattcttcaaagcattgtaatagaataatggcttactgtcaggatactcaagccagttgcaaataaatttagaccttgctaatcatttactttctcttacagcgtgccactcttaaaaatgtactcttggaattcaaataaagaaaaaccaaactatagttcatgtttactcctgtagttggaagcccttaattaaatggtagaactgaaagaggcttcctaaattattttctgatggcaggtagaatcaaagctaatatgtggtgatgtagtagtatttttctttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcttgacctcgtgatccgcccgcctcggcctcccaaagtgctgggattacaggcgtgagccaccgcgcccggccgtatttttcttttatgatgcattcaattttagattatggtccacattcttaatgcagaaaaattcttcaatatctggaaatgtgttttgtagtttatatttgtataaatgacggaactatgaaaattgcttcaacataatcctccctttctgattagagaagataaaatggcaatttccttttttctatagctctacctataatttgtaaaatcagtgtaacaagtttgattaaaagatctataaacctcataatagtattttattgacctcaacctttaaagataaagttaaacttgatgagttttaaaactttggtacatcaatgttaataaatagatcaacattattaatttttaaatactcagaatcatattaagtgctctataaaatttgtcagaaaagaagcagtttgctctctatttttgcaaacctgtttttttttttttagaattcaataacattttaaccaatgtaaataaagtatacataaaactctttccacacttctataaaatgatcattccaaggttggtaactattagaagacacccaatgctacactcagcagaaatcttaatgcaaaagaaaagatacagaaacaaaattttacagctttttttccagatgaaaagaaaagataactagagtaatctgaggtcctaggttctagttcagtgattacaagagactgctcacctatcatccacccattatctttatcccaaaggatttttaaaagtcctagtctaaacccagattctagacctgactttgtagagcttagagctgtgtgacaaatcaagtcacttaaactccggatctcaattttcatctggacctagaaactgttaagctagagcagcacttctgaacctcaccagcattaacatgtaagattggatttttctttgttgtgggcacatgtcctgttcaggatgtttagcagcatctctggcctttacccactggatgccagtaatatctcctctcctccatgttgtagcaatccaaaatgtctgtagacattgccaaatttcccccttggcagggagggaatcttcccagttggaaaccactgagctagattagcataccctgtaggttgctccaaggtacatgggtcctcttgagaagctctgagaaaataaataaatcaagtgtcccattgtcagataagcatcaggaaagtggtatggcacctcactgcccttttgccaggcctttgtcttctgtttgaaaagtaggttttaaccttgacagtgcttctctgctcagtcttaacctcttgattttggtgatctcatcctttccatggatcggaattccatccatgtgccaactcccaaatgtatatcattaatgcagagagagatcaatgttctggctgtttctttaataattatcatgagatctccaccccgacgtattcaagactaaacttttgctcttccctctttgagccttccctttcaccctttccctcatctcaagacatgaggactactacttaggcttgaacctgagtctctcattctttcctcccccatatccaaccggtgttgtgctcatttactttcaaactgtattgtgtaactggccactttgcctgattgtaattgccactgtctcaggtcaagctatcatcatctctcatttggagaacttcaataacctcttagctgatctccatgcttccaccactgacccctctccacacaacagccagagtggtcttcttaaaacaaatcacgtctgtttctggcttgctgaaacccgttagagggtctgtgattgcatttaagataactgaatgtaatctacagactcagtaaaactgggtcctctttctctgtgtagcctcctcttatgccattatcccttttgctggctgtgttccaggcacatgggctgctctcagttctgtttaaaggaataggagctgatgcttagcaataactcatgcttcagcctgttgctttcataataagtcctttcatgagcccccaccaacagccatacattctcattgttatacctctctacatgaatctttctacttttctttttagcactagttataattgtaattttatacaggcatccttccttttattgtgcttcacattattgtgcttcacagatactgcagtttttccaaattgaaagcttgtgctaaccctgcattgtgcaagactattggcaacatttttctaacagcttgtgctcacttcatgtctctatgtgacattttggtaatttttctaatatttcaaacttttaaattattattatatctgctacgatggtctgtgatcagtgatctttgacattactattgtaattgctttggggcaccacaaactgcacccatataagatgatgatcttaaccgataaactgttgtgtgttccagctgccccaccaaccagcctgtctctctcccccttttggggcttctctattctctgagcacaacactgttgaaattaggcgaattaataaccctacaaggcttctaagtgtccgggtggaaggaagagtcacatgtctctcactttaaaattcaaaagctggaaatgattaggcttagtgatgaagacatgtcaaaagtcaagataggctgagagctagacctcttatgccaaaccaagatgtgaatacaaaggaaaagttcttgaaggaaattcaaagtgctattctagtgaacccatgaatgataagaaagcaaaacagccttattgctgacatgaagaaagtttttgtggtctggataaaagataaaaccagcgacaacattcccttcagtcaaagctttatccagagcaaggccctaagtctcttcaattctgtgaagatttatggaggtgagaagctgcagaagaagaattggaagctggcagaagttgattcatgtggtttaagaacagaagccgtctctataacagaaaagtgcaaagtgcaacagcaagtattgatatagaagctgcaggaagttatccagaagatctagctaagataattgatgaaggtggctgcactaaacaagagattttcaacacagacaaaagaaccgtatattggaagcagatgccatttaggactttcatagctagagacaggtcaatagttggcttcaaagtttcaaaggacaggctgactctctcatcagggtatagtgcagctggattttaagttgaaaccaatgcttatttactattctgaaaatcctagggcccttaagaattatgctaaatctactctgcctgtaccctataaatggtgcaacaaagtctggttaactacacacctgtttacagcatggtttactaaacattttaagcccactgtagagacctattgcttagacaaaaagattcatttcaaaatattactgcacattgacaatgctcgtagtcacccaagagctctgatggaaatgtacaagagattaatgctgttttcatgcctgctaacacaacatccattctgcagcccatggatcaatgagtcatgctttcaagtcttattatttaagaaagatatttcatagatatgtcttccagctgccataaagtgtgatttcctctgatggatctgagcaaagtaaattgaaaacgttttggaaaggattcaccactctagatgccattaagaacatttgtgattcatgggaaaaagtcaaaatattaacactaacagaagtttggaatagattccaataaggagtagattccaatccttacagatgattttgagaggctcacgacttcagtggaggaagtaagtgtgatcgaaatcccagtaactgcgatcgaaatagcaagagagccagaatgataagaggagccttgaagaagtgactgaactgctgcaatctcatgataaaattttaacagatgaggagttgtttcctatggaggagcaaagaaagtgattcattgagatgaaatctactgctagtgaagatgttgtgaatatttttgaagtgacaatgaaagattggtaatattacgtaaacttagttgataaagcagtggtagggtttgagaaaattgactccaattataaaagaatttctcctatgggtaaaatgctatcaaatacatcccatgctacagagaaatatttcttgaaaggaatgatcaattgatgcagcaaactttattgttttcttattttaagagattgccacaggctgggcatggtggcttatgcctataatcccagcattttgggaagccaagttgggcagaccatttgagatcaggagttcgagaccagcctgtccaacatggtgaaacaccatctatactgaaaatacgaaaaggaacctgaggcaagagaatctcttgaacccaggatgcggagattgcaatgagctgagatcacaccactgcacttcagcctgagtgacagaacgagagtctgtctcaagaaaagaaaagaaaaaagagagattgccacagccaccccacccttcagcaattcccaacctcatcactcagcagccatcaacataaaggcaaaagcctccatcagcaaaaggtctgtgactcgctgaaggttcagatgatgcttagcattttttagaaatgaagtatttttaaattaaggtgtgccatttttagatgtaatgctattgcacacttaatagactacagtatagtgtaaacttttatatgcactggaagaccaaaaaactagtgcaacttgctttattccagtgtgtggaaccaaaaccacagtatttctgcagtatgcctatatttatttccctcatgatttgttgaacatctacctttttttagtaaattgcaagttccatgaagtccataatcatgcttcttttggttacaacattgtatctccaacatctaactggatcttcaacacatatttatggaataattgaatctgttttctaccacccctgccccactcctcctggcaattaacaattcacatcagcatattaaaaatccaaatttttttaaaataaatatgttctgaaacttagttgtccaaggaactgtacccccataacgctgataaatatcttattttagggtacaatgggctaaattatctgtgagttgtcttccagctgattgattacagcatcttatttcagggggaaatactttgaaacgatcaaggccgtatgaactttggttcaaattcaaatgcttataaaattattaagacatatgtagagctcaaagtgttctaataattataaagccattatcagggtaaactgcaattgtaggagtgaagttaaatccccaactatacactttcattggacctctttccttcctcggaagtgaacttgtcattcttacattcacattgtttgcctattgatattgtgtagctattggggcacagccattacagccattgtgccaaggggaccaggtcctcaaagtaggagccagggctcttagagtcaatatctagctttcttttcaatgataattaagtactcagagctctggtctatcaatgagcttgctgcagagtgtttatgagagcaaaatatgataagaaatataaaacatttttgacagtctataaaatttttataaaaacaagttacttcaatgaaccaattttttaatatttaataagtctttattaaatatatgtatttgctttattaaatttagaaggaaaaggctgaaacattttatcatgttcaaacatcatggaaataaaaaataaatggaatgcccatgagatggtaaaaaatgtgacacccttattactaattttaatggaacacatctaggtcttgattactcaggcactggatacccacactattatgctaacagcagagacaggtatattatgatacaaggttttttttcctttaaactgggaacattacataggatataatacattgggtggacctggtcgttcatgcctgtaatcccagcactttgggaggctgaggtaggagggttgcttgaggccaggagtttgagaccagcctgggcaacataagaagaccctgtctctacaaaaaaaaaaaaaaaacaaaaaaaaacacttaaaaattttccagggatggtggcatgcacctctgtagtcctagctactagggaaactgagatgggagaattgcttgaggctaagagttcaaggctacagtgagctatgattgtgccactgcactccagcagtagtcacagagtgagaccctgtttctaaaaaaggaaaaaaacacattgagccacatcataatgtctaacgagtgccaactttgtgccagggcttgtggtcactgtggtgcaactattatctcatgaaatcatcacagtgccctataggatatttgcaagtctttgaatgactttatgcagcttccccactgaagctggaaagggggcaatgtcacttgccccttctggagccagcctgtctcccagatctcctaactacactaatctaggtttgagagctctaaaatttgtttctaatttgtagcagtcttttgatgtattaagatatagatcctcattacttgcagaatctgaatttgtgaatttacctgcatgctaaaatttatttgtaacccccaaatcaatactcacagtgttttcatggccattcatggatgtgtgcagagctgcaaaaattttgggttgcccagtgctcatgtcaccacctaagacagaaaaaaaggtactctctgtcttctcgtttcagcccccatactataagaaagtgccccttttttggtatgtttctgccaatttttccatttttttctttttgttggtgacttcactgtttaaaatggtccccaaatgtagtgctgaagtgctttctaggttcctaaacacaataagggtgtggtgtgacttacagagaaaatatgttctctctacaaattttgaaaagctttgctcaggcattagttatagtgctattggatgtttcagtattaatgaatcgacattatatattaaataagatgtctctaaacagaaacacacaaaaaacaaagtgtatattaattggttgataaaacagtgtgatcagaggctcacaggaagctaaccttgtgtttcctctagaagtaatcattcagtattcactaattagcatttgtggcaactttatagaacacaactcctgcaaataacaagaattgactgccactaaagacaccattgcacttgacttttttaattgcctgcttgatgtcaggtaatctgattattcagcctttgatttcagattgagtgattaatgaaagaccttgaatacaaaattttaaactggtgggaacttttatgaggaagtcataaaggcctgcagtcaaagatttgtaatgggagtcctcatgaaccccgactctcccaggcaaatgacatcaatataatctcactggtactcagcagaattcagagttattttttttgacttggaatatgatgtcttccagggtgaaaagaaagaaatagaagtagaaatttgagtaatttcagtttaccatgcttttaaaaatgttgacaaggtgtactgttatgtatgattcaagctaagtttgtcagaaacagtgaattgttaaatttaagtcatgcttataaaaatctatgagatccctaactatcttccttgtaagttctcacataaaaggttaatttattccaatctattaacttattaagtacaaaaagggcatattgaaatactactgtaaaataactttttaaataataagtaaaactgtgaaaaaagggagttttgacctttcattttttgcttcattcttttatggtaagtgtaaaaattacttcaaggaaatcctatttctttcatttgtaatcataattttttaacagaaagtgctgttatttaaaaacttttgatgagttttttcctccaagagtcaacttatagtagaagtacttctgtttccaataataatgaatgagctataatttatttaaattttgatgagtttttttttttttttttttttttacaaaagcaatgattcttaggcaacttgtcaaaagacgtcatttcagttttgaggcaagtactgggttattatattaaattgtgagaataggttaatttagctatcacaatgagtatttgtattaatacgttcttacaatgctaataaagacatagctgagactgggtaatttataaaggaaagaggtttaattgactcacagttcagcgtggcttgggatgcttcaggaaacatacagtcatggtggaagtggaagcaaacacatccttcctcacatggagaaggacagcaaggagaaatgctgagcaaaaggggggaaaggaccttataaaaccatcagaccttgttgtgagaattcactatcacaagaccagcatgcgggtaaacacccccatgattaaattagctcccactgggtcccttctgggacacatggggattatgggaactacaattcaagatgagatttaggtggggatgcagccaaatcacgtcagtattattcctaaaaatgtggtggctcacacctgcaatcccagcactttgggagactgaggctggcagatcacctgaagtaaggtgttcaagaccagcctggtcaacatggcaaaacccgtctctactaaaaatacaaaaattagtgtggtggcacatgcctgtaatcccagatacttgggaggctgaggcaagagaatcgcttgaacccagaaggcagaggttgtcgtgagccgagatcatgccagtgcactccagcatgggtgatagagcaagactctgtctcaaaaaaaaatcctttacagtctggaagttcacaccataagtcccaaatgctattgtagatattataaatttaggcaacattttattattgcgttagtcatgtaattttattataagcacctcctctgtatcaggtgctgagatggttgttttacatgtattttatctaattctgtcagtaactgcacacaataagtattacattctttatacagatggaggcactgaggtacagaaggtctaaatattttgctcaagatgtatagaaaattaatataggttattaaagaaaaataatcaaatttaggtataggaaaacatacaaattccttgcttttttatactttctaaattatttgtaaataatataacctaatgtttaatttttaagaaatgtgtaacttgtaatgacaaacatgactgacatagaacagagtattgctagttgatttatcattgactgagagcttaagaaagctacgtcaagggtcattagtcattcttatttagcaagtaactcatcacagatgtcttattattctgttattttccacctacatattttctgccacgaggtactgaggcaattcaggaaaacatttgtgttaggactttgtggcttttgaacccggtggctgcttttaggtgggattcatacacctttaacaggttgaaaattaaattgctttatagatggcatcttcaaaggaatggtggtaaattgtgagtgattggtatcaagcagtttgtcttttacagcatcaaatagtgtttcctcataaaccatagcctctctcgttcttgtcactcaggaattcttatggtacaaagtagcatctcttctcctctccgtaccttccactcagtaggaaagcttaatcttgtttttattgagatatatcttatgcgccataaactcaccctttgaaaatgtacaattcagcggtgttcagtgtattcataagcttgggctgccatcactgctatttagttccagaacattgtcatcattccaaaagtataccctgtatctgttagctatccctccccattcacccctctttccatccactggaaaacaccagtctactttctgtctctctagatttgcctattctggatatttcatataaatagaatcatataatatatgtccttttgtgtctggcttctctcacttagcacagtgtttccatagtttatccatattatagtaggtattagtgcttcatttctttttatgcctgggtaatattccatcatagggggatatatatatatatatatatatacacacacacatacacacatacatatgcatacatacatacacacacacacacaccacacatttgtttattcatttatcagtccatagacatttagcttgtttccacttttggctattctgaacagtgctactatgaacgtttctctataaggttttttgtgcaggcataggtttttatttatattgtgtaaataggtgtttcctctcattttttcattgcttccctcgaactcccatcactacccctaagttcagaaaagcccagaacattaggaactttgtatatcccaagagagcttggtaaaacttctgccacatcttcctaaacctgaactccattttcctgtcttttcccagagccgccaattggacaaatgcaccccccgcatggcagtgtcactcctcagaagaacagcaacctgcttgtgatcattgtggtcaccgttggtgtcatcacagtgctggtagtggtcatcgtggctgtgatttgcacccgacgctcttcagcccagcagagaaagtaggtaacagctggttcccaagaggaaagaagtcattgtcttttggggttatatttttgatggtcctctttctgcgttctttcataattcaccccatgtccttacttcctaaccctggcaaaaccttgcgttttgtctattccaggcctatcattaagtgagtgagggctagactcgcagataagataactaacaaaatccatctgggacccacttatatttctgtttgcttttacttctctgaccccttctcattttcaagtgagcgcaggtgttccttaggtaacacctagagaatagactccaccatgcccctgtttctggccttccctgaaatcatgtacacgagatttgaggaatgtgtttctctgtgtgcacttatttaccactttttacaaggagccctgtaggcagttaatcaatacttattggagagatgactaaatatagaatgccagactctgtacagttacaatcctgttggtgcttagtttggaggcagtagttaagaaagaagagagagttctgagattcaaaatggtttattttctgtggttaattgtcagaaattaaaagtgttgagggctttaagaatattttcatattatgcagctttaggttctagcagatgcagagaatgatacatcaaagtacaaagtttaaaatggaaaagtgatttttattcagcctatatccttgcagcaacaccctgtaactggccagttagtctgtgtcagccagtgctgggagtcagcaataatctcacagccattctctgcctctttgactttctagtccttttaaaattcagcctgatgtgtctttttcagctacactctctcactgagttgactatcttaggctcttccatgagtttttggttctggttttaggtttttccattggcctcaggcatgacattacctctgaaagcctgaggtatgggttcataggtggctggtttgacaactgtgtactttacactttgctagaaaagattctccagcaaataatgttcccccttctgttgctaatagctcgctcttgctctctctctctctctctctctccatctctctctctctctgtctgtctttctttaagtcctgtaactctatttgtagatctctagtttaccttccagcactctgaagtgacatgtttagaaagagaacaggggaagatatacatactgaagaaaagtaacatggggtgtagatgcaggctttgtatttaatttatttctatggcaggacaaattttctaaccagctgatttatgagatttgactagtttgaagctggtgatagctggtgtgctgctccattgtgcctaagcaagaaacctgctagagtgagcttagctgggccagcctcatgtgtgagcattctgggaagtcataatcactcacagagcttccacagtgcagggctgttaataaggctctggaggggaaagtaactaattgagtaaggcattgaacaatctcttggtgctgtgttatcaggaaaggggttgtgaaatcacggaacagtggaacatcaaggcagcaggtctctgaagcagagttaagagggactcatgtaaaagaaggtggggaggcggtaccaaaatgacacctggcctaccatataactgctttcaagacactgaagcattcactaaactagccaaatgtaactaagctatctgtagtgggtttgtttttgatttgggttcccccccgccccgtgtcatttctgtgagaagaatgttcgagcattagattgacctgatgaactggattcctggatatattttgtttctccacagagagaacaccagtcttctcaatgtgcaaaagtgggatttggtgccatgttgagaaaatctccagtcatcttaaatcctaccctaagcactttggcaaaagcttcagggctttatttggaaaagggagactctgagccctgagtatgacttgtttttaaaaatagggacctaattaaagaataagtggttctattaatgactgaaaatccaagaacagttagttgtagagtcactttggtttttcctcactgcactctcaaagtcttttaatagttacttgtgttcacactttgtttcatatctttcttcagtagcagacccgttggcattcatttttcatccctttgtgtgcatattttcatagagaaaaagaaaatgtttccttcaagttatttctgaactatagtttagtggggtttgtttgtttgtttgtttgtttgtttgtttgtttgttttttgagatggagtctcactctattgcccaggctggagtgcagtggtgcaatctcagctcactgcaacctctgcctcccattttcatgccattctcctgcctcagcctcccgagtagctgggactacaggtgcccgccaccacgcccagctaatttcttgaatttttagtagagacagggtttcaccgtgttagccacgatggtcttgatctcctgacttcatgatctgcccgcctcagcctcccaaagtgctggaattacaggtgtgagccaccgcgcccggccccttatagtttagttttttgttatttgttccattgaggaccgctactcctctgcatcacaattgagcccttcagaacaaactggataatgcaggtgaaagcaaaatcaattccaatctgaaacagaaataagatcccctccaaagctcttagaaaattggactttaatgtaattaataagttgaagtagaaaacgcattcacgagcttcttcaatatctcttttggggttctagagaatataaatttttctttatgttttttttgggggacttgaattacatccaagtgaattgaaaaagttctatggactctcagtaatatcttattcaggttaagtgtctatgcatttaataaacctaacctttttataaaatcatacatatattcaacaattaggctatccagttgattcagactagtgggtaagatttcatttttattatataaaatagctaatgaaagtcagtacccaagttctagttctgggttctactgcttctatagtaaactaatcatatcacctaaatgaagacccttaatacttgggtggcagtttctttaaatataatgataatttgggctaaatgctttctatcattctctttagctttttttgttggtttttttgtccagagccaggtaacaatcttctacttttaaaacataaaaattcccaatggaatacttctaatttatagaatcacatggtagcattaagctttaaattactgcagttcttttcagttatttattaaacttttttactactgtactttgaagagaccccttccacagtttctattagtgagattatcgtatgacatctaatacagaaaaaattatattttatgaaaacttaaggctggacacacctgtaaccccagccttttgggaggccaagacatgaggatggcttgagaccaggagtttgagaccagcctgggccacatagtgagaccttatctctaaaaaattttaaatcagccagatatggtggtgcttacctgcagtcccagatactcaggaggctgaggttgggggatcacttaagcctgggatgtggaagctgcagtgagccatgattgcatcactgtactccggcctgggtgacagagtgaggcctgtctcaaaagagaaaaaaagaaacaaaacttaagttgatttttgtccctgtttctctgttttttaataaggcaataacattttctcgcccaacatatggaacacatgttattagttagactttatccacagatactaaggacaaaaatatatgaaattgagcaaatccaggagatctagaacgcatggttattacatttctaaggcagttacctgggtaggtgatctacagtcttgtctgaatgctttaaatttaaacatgtaaataaaacctaaggtgtacttgttagaaccactggctggctgggccttctatttgacttgacatgtggacagcaagttttaaagattagtatgcattcaaatcttgacaaaaataattatttttagtactgacgatgaaatgtctaggctcttaaatgaaatctacagtattttaactattataggtcacttttactgatttttcacttgttaacgttttaattggttttcaatattcacctcataagagatttgaactatcagctaccttaagacttcattatatcttaattccatctcagaattttttctgagatatatttgagtatctggaatttgacctgggtttctaatacaaatttttggttttgtttttatttttattccactaactgctattaatcaaaatggacaattaggggctagaagcctttggaaaagatttggaaagaaagcagagaaatgtttctacttatcaatatatctttttctgattaacttgtaattatttattcacactcacttcaagcttccttccttcctgaagacttcccccaaacccctggtgggtcagaatgttcctgcctcaatccctatcagatgttgggcatgtcttttaaccacgggaattagtacagcactctttatttgtctgcctaataaagttgggaacaactttagcagacgatgcctgagtccgtagtggaaatttaataatttattatgatgtgccaaaataacctatatggtaacagctgcattttagaacttcaatggacacagtcttgcataaaatggacactcaaccaatgttggtttttactcattcacatccccagcatactaattaaaagtgaaaaggaaaaaaaactccccttacagtaataggttatgcataaagtaaggaatgggtaaaccagtacagaaccagagaagaagctttcagataaatacttgcatgtcaataatggaaagtaattcttattatttaattcaagtaattattgtgtgctttatatgggatctgcatcatacaaagtaacaaatctgattaatattaactctcaagctaaaaatctttttgcaatttcccactgacttcttgatattattaaaaatgtatctatttgggccaaggcctcctatgtttttgtcccttctactttttcatgcacacaaactgtcatgccgcagtgcatgctcctcattccaacaatgcagaaattcccaggagccatgccatgttacaatcattttttaagctttcaatgcctccctgatctttacatttgtagtacttagcacatttcttgacacatagtcaatcatccataaatattgattgaataaataaataagtgttgtaaaacaatggatgatgttgaagaagtaaaggaaacagagtttgctccactttcactgaaggaactgaattatcacaaagggagcagctggacagctcaataagacacacggtgatcaatgccaaggtgagtggtacagagagagatgagggaaatgatttagattctctaagattacagtgacctgagatggtcaggaaggttccctgaaggagagagtcttgaaaggagacttaaagaataagtcatttgcaagttaggattttgaaggcactgtgggcagaaattaaataagtaaacaaacaaaacaaaaaatagagcaccagcacctgaccatgctgtcaaagttttgccatgatctgagaaggagaaaacagagagcctgggagggttctttgtttgcctttatcaagaatacctggggtagaaggagaccctcctattctagggctattttagaagcagaaggatgactggtgcctgagggaaaagatacatttggtatttgcagaggggccaaacatgaaatactctatgtcaaatagaaaaactagctttaaaatacaaacaaaaccaaataattcactatgatagtgcttcttaaattttagacagattcacctggagagtgttaaaagacagactgccccctgcaaccaagtttctgattcagtggttctgcagtggggcctgagaatgtgcatttctaacaagttcccaggcagtggcagtgctgatgcctctggtttagagaccccactttggcaaccactgtactaggagcacctgaatacacatttcgaagaatctaatggtgagacacaggaaccgtgggctgcaatgagcagcagtcgtgtcaagaaccaacagatgggcagaaggtcagggtgacacctgttcctataggttttaagacaaatttcagacaatttaattatgagcacatgttagttttattacaaacctgctgtggtagaggttggagggacaaaagaaggagaggctctccaaggccaaagatttctcctttaataagagatacgataggaaataaaagtggttagatggtcatggctagaataaatacaaaaaggaaataaagtctatttagagatctttagcttcttgactgacagtcagctgggtgggtgagcaacttcttagaacttgtcttgatctgattaaaatccagcagaaaaatgcctgttcattttatgaggaactacaatttcttccccagtggagattatgaatcacaacatacaaaaaggttctgccaggtttggaactcttttaaaaacagaagccatctggggctcgttggtactgaagtcatggaaactagcaaataaatgaataagtgaaaaggcatgcttgtaagcaaggggaaaccagaatttgtaatttattgctggtttcaattttatcttgactactttctttattccaggttatttaaatattgagttaaataaggagtttggctatgttttcctgaatttgggaactggtacttctctgtgtgcagccacacagatgctggtgttaagttatttagcattttgatcttctagaaagagagataacagggtgaaacatccaagtttgagaatgacattacattttctatgaagttaccaggagtagattacacagggagctgtgtgtgagttgcagatcagtttgccgtgggcaagtgaagtatatagaaatgaattcaggaaataaatggttatcagtgagttattatcttagacacatagacacttagaaaataggggttgtttcagaccattgttttaaaacattgtggggctgccaccaggaaatcagcaaagtgcaggtagtgttattttttctctgctaaaatacaaaatagatactaggtctgggattctttatctcctatcctcatcagcacgcttcaagaaagacaaaaaaaaggatgtcagggaaaattcaacaaattacaccaccaaatatttattaattacctagtatttacaaagctacttattcatcatcggaaaaccaaagccactccaatgactttgcacaggttacaggtgttttcactgagagtagcttgtatgaactattgagcagccatggaaggtagttattataataaactgttcactgcaaattaaggaagtgggaagtagatgcttctctagtctgctgtcaaaactagattttaacagtttgcattatttcttacaagagacattatttttaaagaaatagaagttacaagtagagatttaaaagttataaaactagggaaagggtcaaaaatgatttctgaaaaggaccaaataatacatggtttaggatttttgagccatatagtatctgtcacaactattcaattctgccattgcagtgcaaaaataaatgagcttggccatgttccaataaaactttatttacaaaactaggctgtgggcagatttggcttgcaaactgtagtttactgaccccctgctgtagagaatgactaacatgaacattgtgttacttcacttatcacacagggaacatttaatctcactagcctcaagaagagattatcaccccaaaaataaatttatagttgttaaagccttattgaggcaaataagaaacatgtgaaatacattttcaaactgtgttcttctcctttcaaaggatctgtctcactgtgtttgaatctggacactcagtgatgccaaggcaaaagtgttttattctcctaagaatatcctcatgtggccttttgtcttcaaataacaagtttcccagttgcacattaaattatacagctgaggtatagactttcttctaagacctcatcttagctattggcataaattctggccttttttatttctatttgccctttcaaagcaactccttcatttatctcctaaacagatgttgccatcaggtaccttatgcctggctccaaagattggcatatggttccatctaacccattttcaccttgcacatgaatctgcagccgctgaagctggagaaaggagctctctgccaggaagccgaggccctggggattcagcactgcatcctttataatgtggtgaagctccaggggggaagaggaaaggcagccaagacaagtctgccaattcctgggtttcacagggctcattctgcgagtccttttgtttcctttcctgcttctaacttgaattgactgatgaaagaaaggaagtgccattgaatagaggttctcacatttgccttctaactttgttccataggaaacgggccacccacagtgctggcaaaaggaagggcagccagaaggacctccgaccccctgatctttggatccatcatgaagaaatggagatgaaaaatattgaaaagccatctggcactgaccctgcaggaagggactctcccatccaaagttgccaagacctcacaccagtcagccacagccagtcagaaacccaactgggaagcaaaagcacctctcattcaggtaattatcttttcactggcattagggaaaacataccattctgaacccaagggagtttttcactccttttatggaaatgtcttccctactaatttgcatgtcattatgggtcatttatcaatagttaaatggatctaatataaatttggttgattaaccaattatatgtctttcttcatcctgtgacttgatataattttaataattcttttataattttgataattcttgaattttctatgaggttggaagtaggacagttgggaaatacagaaacttaaatcctaaatggattgactgctttttgttaattgttaaacaaatgttttgtcaaggcaataaaatttgaagccatctgtacattttccagttccttatttcgatagataattgaaagttaattctaaatttactgtcaattccctgttttaaaaatcacatcagggcacttgaagtacaaaaaaactgaatattctgttactttggccttgattactatggaaatcaactgtcatccacatacagtcaccttatgtgatccccagactagtttgatgggattctgtctgaaaactatgttgttatacaaagggatctgaaaaaaaaaaaaaaaaaaagcctactgttcaatgaattggtgcagaacaatcactggtgtccagggataagtaagaacactagaaaataattgtaagatagttcactttctctgggtcttcatattatctaagtgcttatgggaatcatcaaccaaatactatcatcaaaaaatcccttggtctactcataatgtgattatagaatgaggagctcctgtttttttttttttttttttttttttttttaagttttagggtacatgtgcacaatgtgcaggttagatatatacgtatacatgtgccatgctggtgcgctgcacccactaactcatcatctagcatgaggtatatctcccagtgctatccctcccccctccccccaccccacaacagtccccagagtgtgatgttccccttcctgtgtccatgtgttctcattgttcaattcccacctataagtgagaatatgtggtgtttggttttttgttcttgtcatagtttactgagaatgatgatttccagtttcatccatgtccctacaaaggacatgaactcatcatttttatggctgcatagtattccatggtgtatatgtgccacattttcttaatccagtctatcattgttggacatttgggttggttccaagtctttgctattgtgaataatgcctcaataaacatacgtgtgcatgtgtctttatagcagcacgatttatagtcctttgggtatatccccagtaatgggatgcctgggtcaaatggtatttctagttctagatccctgaggaatcgccacactgacttccacaatggttgaactagtttacagtcccaccaacagtgtaaaagtgttcctatttctccacatcctctccaggacctgttgtttcctgactttttaatgattgccattctaactggtgtgagatgatatctcattgtggttttgatttgcatttctctgatggccagtgatggtgaacattttttcatgtgttttttggctgcataaatgtcttcttttgagaagtgtctgttcatgtccttcgcccactttttgatggggttgtttgttattttcttgtaaatttgtttgcgttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttagacctgaagtccttgcccatgcctatgtcctgaatggtaatgcctaggttttcttctagggtttttatggttttaggtctaacgtttaagtccttaatccaccttgaattgatttttgtataaggtgtaaggaagggatccagtttcagctttctacatatggctagccagttttcccagcaccatttattaaatagggaatcctttccccattgcttgtttttctcaggtttgtcaaagatcacatagttgtagatatgtggctttatttcctgtttttaaagtgaattatttgaatgtgttgctgttttactgtactctgtcatctcagaattgcataaacaagaaatacaagtattgactgtcaaccatggattgttgaatatttcttttcaagctctcaaatgatgtcttaggcagatttcctaacttccttgtcactccagttattgaaggacagtctagttccattaaaaactatcatctgaaatttaattaaagattctcctttctcatgctcagctagatatttggctctagggactgggggtcagaatttgttttctcaatcctccagtacattggagtgaaatggaacggtgggattgagaagaagctggaacaaagtctgtttcagaaacactgttacatcttttccccttctctccacttttcctgagcatgtgagagaagagggatggagtgaagagggaggggaggtgaggataaagagaagaaagtaccatttgaagttcttcatagcttttgtggacacgtgggctaacctctatgtggtatccaaattctgggtctcttatgaaacagaagtatgacttatttatggcaggggtactcaacccctggaccatggatcagtactggttcatggcctgttaggaactgggccacacagcaggaggtgagcaacgggcaaaagagcaaagcttcatatgtatttacagccattccctatcactcccattactgcctgagctctgcctcctgtcagaccagcagcagcactggattcttataggagcatgaaccctattgtgaagtgcacatgtgagggatctaggctgcacgctccttataagaatctaatgtctgatgatctgtcactgtctcccataacccccagatgggaccatctagttgcaggaaaacaagctcagggctcccactgcttctacattatggtgagttgtataattattccattatatattacaatgtaataataatagaaataaagtgcacaataaaggtaatatacttgaatcatcctgaaaccgtaccctgccccctgcccccaggtccatgaaaaaattttcttccatgaaactggtccgtggtgccaaaaaggttgggaatggctgctttgtggggccttgtagaccaggcccagttccatgatgggagacatgaagtccaggcttaccacctaacacagctcttcctcttccgtcatgaggcctctgggaaattccagcaaggggactgaagcccagccaacttttcacatgcccacttggcccacaagaatctcctatatccttgccagacccaatggtgagagagcttgcactctaccactggccctctctcaaccttgctctcttcaattactttttcctctgcttagatagactcggggtagaacagcaagcccactgcctaaacaggctttcgcctggggagtgacagaaaacaaatcccttttgcaggaacctccatattttacaagtgattcttcttctagctttgttcttgactggatatcagggaggggagagcacctccacctcccactgaaagggatagaattgcctcactgccctaaggaggttttgccaatgacttctaagacacatccttctaaccttttcctttcgtcttttatatactgagatgacattaagttgatatctcttaataagtcctgggggaaggtttaatcccaaatgatgactgttttctttaaaataaaagagtacttatgcctacttgtcctcaatttgaggacctcgttgccaattttgtaacaaaaggaaagtaatcctcaaagtcctgcaagctatactttatgttaaattaagtattcttctctcctgcttaaaaaaacaaaattcaacataagtgaacagcattaccaagaaacattatatttaacaatggggttcctgagtaggcaataactatgtaaggagagattactgtatgttaaattctatgatttggacttttatacattattttgcctaatcttcacaaaatactttgaggtagatgctatcattcttttcatatagtaaatgaagtaaccaaattaagaagggttaaataatgtgcccagatttcagagctagtatcacagccaggaccaaaaaaatctgaccccaaattaatgttttgttgatccagtttcaattaactcatgtaatacttttatataagtacttttcttgttttgcgcccatgaaattagctttttggataaaaccagaaattagtttacagtattcatactttagctatggaaaagagaattgaatcaagcaattgctgcataaacaacaacaactaattttattgagagttaattttttattttactcattcttccctactgctggtatgcaaactgcttaaacaaaacctacttcattctctaaccacaaaaatagaggatgccactaaaatatctaggaattaagatgataagttattgcttcatgatacatctcttctacatctagtggatttcaaaattattttctttacttaaaagtttacaataaagaaacgaaagagttcaggtctatttgatctctaggacttacaaatagaatttagtttcttgaaatggatttatcctagtctaatttcactacagaagcaccacaggattatgttacttagcttcacttcggaagaatgaacaagtaaatttcagcatgtggcatttggtagtattcaatttctaaaaatgttcaattcagtgaataacatctataaaagagctacataacaccaaatgggcaatgtgatttaacacttaactttttattagttattttgaattatatacatgtctattaaatcctgtatttaaatttcccaacctcatttggaccaatggtaaataatgtcaggtggcaagtttatgagacaagccacaaagtgttactaccaaaaaattttatgcttcaaaaaaagtaaaaggaaaaaatcttgtttaacttttcaatgaattcatgtaatatcaagcacagtctatttttagaataaaaaaaaaaactgaaaacccacacacagacacccaacaatatcaaaggacttatttgaaaactatgttaccaccgggagctgtggctcacacctgtaatcccagcactttgggaggccgaggtgtgcggatcacctgaggttggcagcttgagatgagcctgaccaacatggagaaacccctctctagtaaaagtacaaaattagccagacgtggtggtacatgcctgtaatcccagctacttgggaggctgaagcaggagaattgcttgaaccttggaggcagaggttgcggtgagctgagatcacgccactgcactccagcctgggcgacaagagcaaaactcaatctcaaaaaaaaaaaaaaaaaaaaaagagaagaaaaaaagaaaaagaaaactggttggatctagagttacttttttggagtggcaagaagaagcacattagatagtgttttaatgtttgcttctactgtcaaacataattttgaaaactaaagaggaggaaagtctgttgtatttaattgatattttcactctttctgttgttcatttttcctgtttgattgtctgagattcctcttactacttcctgtttagagaaattccattagcttttttttttttgatggtttatctgcttgagacaaattctcttcattttccttcattggacaatgacttgatttcaccttcattcttgaagtatatttttgctggatattgttaacccaattctgtttggtagttctcttttagcacttgaaaaatgtgttggatacttctggccttcatgattcctgatgagaaatctgctgtcatttgaattgttttacccatataagttgtttacctctcactacttctaagatttttttgttgttcttgtctgtagttttaagaagctgaactgtgatgtgtctggtatggatttctttggttttatcctgttcggggattactgaatttcttgaaactataaggtttatttatgtcttttgccaaattttggaaatatcagccaataattctttaaatatttttcagtttcacaccctttttcctctttattgactctttggacactataatttttccccaaaattgatgcttttctattctttttatttatttatttatttatttatttacttgagatggagtctcactctgttgcccaggctggagtgtagtggcacaacctcagctcactgcaatctccgcctcccaggttcaaatgattctcttgcctcagcctcccaagtagctgggactacaggcatatgccaccactcccggctaattttttgtatttttagtagagacagggtttcaccatgttagccaggatggtctcgatctcctgacctcatgatccgcccacctcagcctcccaaagtgctgggattacaggcatgagccaccacgcccagccaaagcgatgcttttctaatgttgccactttatttcttttagtttattttgtttttagagatggggtctcactgttgaacagactggtctcaaaacatcctcctgcctcggcctccataacaggtgcaatcacaggcatgagctacacactcagtggttgccattttaaaacccacacacttttaaatgctctggtctcctaggaaacttttttagtatttttaccattagggtgcacttctttggtagatggttttaggtcagtcttgtgatccttatttccctcttctctcttctatacagactttccagatagctggcttttcacaaagactttgtggctgtagcttgagaaatagctttgctagaaagtattatttctctttgtacttacaggaaatttgaaatgtatcctcttttctgttttgtgattctgctgaaggagtaatatttgcatagttcatttttacttttattttttgagactgagtctctctctgtcacccaagctggagtgcagtggcgcaatctcagctcattgcaacctccgcctcctgggttcaagcgattcttctgcctcagcctcccaagtagctggaactacaggcagccaccaccacacccagctaatttttgtatttttagtggagatggagtttcaccattttggccaggctggtctcgaactcctgacctcaagtgatccgcccactttggcctcccaaagtgctgggattacaggcgtgagccaccatgcctggccaggtttgcgtagtttactgttttatatgattctgtgtagtttttgtaggatgtgtggacagagttagatttaggaagcttccatgacttcacctatgtggacttctcccagtataattttttattttaaattgtagtaattatgctgttaattttttaaaaaatgcatgcatatgataaaaaataaaaagaataaaaaagtttcaaaaaatagtaagtacccaaaatagtaaaacatatgtttgcctcttgcctatcccaaattcctaatccctttcgcaaaaggaaaacaatgttaaaaattttgtgtataaccttattacatagatataggtgtgtacttatatatatatatattcatatacacatagaaatgtgtgtcacaatatggttttatatgcatactacacaaatgggaacatacactattcagaacttcagtttttttaatacgtattataattaacttttcaaatctgcatatatccattttttctaatttttagtgactctttagtatgatattttatggaatcctaataaatttatgtaaatatgtctgatcttatttttgaagaatgcagtttatttcttgtgggttttttgtaataaaatttaatatggttgggcttaaagtattagttgaatgaattctagtaaattaatatagtggaatattacatagctgttaaaaattatactgagttatgtattaacagagaaagatttttgtgttaccttttatagcaggttacaaaaagtatgcatgatataatgccatttttgaaaaatatattaatgtacgctctcccactttcacatgtataaacatatgcaaaaattataagcatcaaaatataaataatggtttattgtatgcaatgagtttagagtttatggttaatttcattaagatttgtacaatgaaatagattcaggtaacaagaaggtagatactatcatagaaagcatctgtaagactgaaaaggcattggaatgcctgctagaaattaggtaaagtgttgcatccttgaagagggcatgtttctcaggagtgtgtattttttaggtcaagacactgaggaagcagggagctctatgtccactctggagaggtcgctggctgcacgccgagccccccgggccaagctcatgattcccatggatgcccagtccaacaatcctggtgagtcaatattggtgccacaatgaagaaatgaaatgctttctgtatgtatcttttctataaaaaatcaaattatcaaaagtaattataattttccctgaactttctggacaaatggaaatgaggaatgactaaaaccgtatcattaataatttgaagtctaagtcttcattcgttactgtatttttttgtatacaatcagatggtctgttggcaaacagatggatatatatttaagaaattgtttgtaaaatatatgaattcacataaaagagctgatatatattttaatattattgatcttattctaataatcatctccatagtttatttttatttatttatttatttattttatttatttatttattttatttatttatttattttgagacagaatcttgctgtgttgcccaggttggagtgcagtggcacaatcttggctcactgcaacttccacctcccaggttcaagcgattctcatgcctcagtcttccaagaagctgggactacaggcatgcaccaccatgcccagctaatttttctattattagtagagacagggttttaccatgttggccaggctggtctctagctcctgacctcatgtgatccgtcttcttcagcctcccaaagtgctgggaatataggcataagctactgcacccatcctccatagctttttaaataaactttttaatgagtctaattctcacacttaaataatctagctcctttaaagcagatgttgacagacacccacttactacacaccccttgttgaagttttctgtcatcctcccacattcactgaagatattattatctgagaatcacttcctttcccattacttctatgctcagtcttggtaattacagtattcatgcagataatccatctgataccctagatggttagttcctctatgttgcctgcaaagatattgattccttcccacctcaattcataaattccatgtcacaccaaatcaaaccagtacaaaatctcagttcctattaccttattagttccctgctcactttattgcccccttgccatcaattcttcaatcccaccaggacctccaatccattaactctgccatttcttcccatccctcatccccttcgtgtcctcatttatctgcaagcttaacttaggttttatagtcacttattatcttcagtctcatctcccttggtcttccttccccatcttactcgcctgaaaaaaacctggtaaaataagcagctccccaattcttaccccattccctcatagctaaatgtatctggagaaaaacatatagcctgcttactgaatatttatgaccaaaagtccaaggtgagctctcactatttggaaatgacactgtatttctctagtggttcatagttacactttataagatgaatgtcttatatgtattcttacttttcagatttcagtatctcccatctttccctattcttagctaataatcttatatcaggaagaaaagaaaagcattcagaaagtggtatccttgtccttccatcaaatctaattgatctgttagtgctgctctctgagtgtcttgttgaaatcccctctcacccatttagggactcttctgtaattactccttccctttcctgcatcatcagttttttttccttatttatcactgcagtaagcatacaaatattaatattctgtcataactcctgttttataacactcaatgccacttccccctccaattgaaaccatatttactgaaaaaaatttctaaattatctgcactttctcctctatctaagctttcttattagttttaataagatttttacagtcactctccactgaatccatgattgccaaggttgtcaataatctccacattgtcaaatccaatggtcaagtctcatactctcagaaacagttgacataggttctcacttatttccctgaaacactttctctttggcttgcaatgtactagatgcccctggttttcttcctacccttctggctgctcctcctcagtatccttcatttatttctcttcttcctcctgatctctaagagtcagagaatgccccagggctcagtcttcaggtatcctctcttttctccctacacctgcttcttagataatgtcatctagtatcaatggccttaaataaatattattaaaatgctgatgaatcctggaggacattatcctgaggcaggatctctagggcaagggcaaaatgccaccagtctttgctaaaacatagcaagagtctcctttgcttcatttcccaataatttcctcatcaccatctgaggacacctcagcctggacttcattgtccatatcactacaagcattttggtcaaaactgttcatcaagtctctaggcaattccaaactttcccacatcttcctgtcttcttctgagccctccaaattgttccagcttctgaccattacccagttccaaagtcacatccacattttcagattatctttatagcagtgccacactctttgtggtaccaatttactgtattagtccgttttcacactgctataaagatactacctcagactgggtaattcaaaaaacaaaggaggtttaaatgactgacagttctgcatggctgaggaggcctcatgaaactcagaatcatggcggaaggtgaaggaaaagcaagtaccttcttcacaagccagcaggaaagagagagagagagaaaaaacgaagggggaagagccccatataaaaccaccagatctcatgagaactcactcaccatcacgaggatcatggggggaactgccccaatgagccaatcacctcccactttgtccttctcttgacatgtggggattacaattcgagatgagatttgggtggggacacagagccaaattatataaatcaacttactctgttcagaaactctagtttcatgcctcttcattctgatttccttataccctaaattcagtcttttaccaaattattgttttcaaaacatttcccaaatttgaccactcttttccaccttcactgttttgcccttatccaagctaccatcatctcttacagattactagactacagcaataagcttgtaactagtctcttctttagctttttgaaaaacaaaaaaactattcgtattttttgtgggtacatagtaggtatatatatttatggggtacatgagatgttttgatacaagcatgcaatatgtaataatcacatcgtggagaatatggtatccatccacgcaagtgtttatccttcttgttaaaaacaatccaattatactcttagttatttttaaatgtacaattaagttattattgactacagtcaccctgttgtgctatcaaatagtaggtcttattcattctattttttgtacccattaatcttcattagcctttgcctttacagtcaattctctacacagctgtctctcaatatataaattagataatgttgttcctctgtgacttccatcacatgtagaaacaaaatccaccaattttactatgttctacaaggtcccatgtgatttagtctctgggtttatccctcactttatctcctattgctcctttctgtaattcattacaatcatgtaaccttcccctgtgttccttggataataggcatatctcagttcagggactctgcacttgctgtagtctttggaatctctttttgtagatatttacatgtcttatcccccatttctttcaggtctctattcaactaccacctttataagcaggtcttccctgaccattgcctaacacagcatctctggtcactctctacttctctattatgcttcatttttcttttttaatgcattacactattctatttgtggttttgtgtttgttatttatttgcttcctgtattttaatataatctttataggggcaaggattatgcctattttggtcattttgagtcgccaatacccagaacagcacctggcacatggtaggcatgcactcaataccatttagtcaaatgaaagaattaatagttgtttatttttacttaccatatgccacatcctccctatgctccattacatcttctctcaattttactataataagtgcaaaaacttacatagcatttataatgaatgccagctgttcaagtcatgtagtaagcactattgttatgcgtctcattgttaggttctctcatttactagagagagaagaaaggattggagagtttaagtaactagctagcagtcacacagctagtacgtgctatagccagaatttggactcaaaaggtctgatttcagagttcagtgttcttaatcattatgctcctagctgtcataccctgtgaagctattgtcctttatcttttatacctttcactactgagaaagatactgtgcacttagttgccttttttcccctctagttgcactcctcttgtattaataactaagttctatctgtgccaatcatttattgctttcttctcaaacattattgtactttagaatctgtggagccttcctgtcccatctaattagaaatatcttcctcatctaataaattcccatatgccattgctttttctttcacagtatctttgaatccctggctatcctcccattctcaactcttttatgtcttctttgtgacttcacatctaaactgccaagacagcttcctagctaagtcttcccggctctagcatcttccagactcttaggcatcctgcttgccagatttcttcctaaaacaagttaaacatggcatcccaccccatacatttctccagtggctcccatttgtctgccaagaaaaacaaaacaaaccaaacaaatttttaaaaacgtttttagcatatcatattggaatctagatttctgttactctatccttatatgtacccagactcatgctaaggtagactcattgctgatccacaaatatgcactgtccttcatttgttttttccctttacatatttctttccttttgaaatgactcagtggatagctcaacctaagaagttttatgtatcctccaaagaccagagtagatattgatgctcttacaaatgcttttctgattactccatctagaaataatgactcccttttatatgtttgaataacatgttcttgtagcacgatatagcatttattacacacaatactgccttatatgcttaggctttcaagtacaaatcttccctcctccaacagcttgtgaattacttcatgataaggatgtaatgtatctaattcatcttcatattcacacattttattgtttaatacctagcacaaaattggtgcttgctaaatatctgtcgaatgaaaaaacaaataaatgtattattaaaatgccttccttatgtttgtaacacatcaatgtttggagagctctttttttgtcagttataaatagaatgtcatctaacaaaattgtctgatgtattaagagcagttaaacttgttttcattaaacagaaaaggaaataagaggcttagaaagagaaagaaaatctaacaagtatgaaaatgtttaatattattcacttggtaaataccttgctaattattattttcatttaatcctcacaatattatcatgtggtaagattatcctgattttacacatgggaaacagcgactcagacagcttaagcaacttcctctaggctacctgggcaacttcagaacctctacggtatactgcttttccaaagataaatatggcttttatctcctaaattattcatatccttttatttttcaaaaagattttctgaaggtgctatctccattgtctaaacatggaagctgaggctctgagagtctgaacttgaaacccctgcttgatccatctactctactatattgcttcatactgttatcttgagctctgagtttttgtaggcctaaaataacaaatcttctcttagtgacttattctacatgaatggaacccataaaattaccagaaattaatttttgttatttttgtaattatcagataacaacacatacatggttttaaaccatcacatagttttccaaaatttataagaatattctgattcagcaattccattcctagatatattctactcttggatatgtacccaatggaaatatataaaatattagtcaacaggtgcatataagaatgtgggttatttgtaatatcacatcttcattacaatagatgaatatagtatattcatatagtggagtacaatgcagcaataaaaataaactaaaattatacaaaacaatatggataatctcatgggtgtaaatttgcaataaagaaacctgatgcatctatataattcaatttatgtaaaattagaaaatcagtaaaataatccatggggtttaatatggtttggctgtgtccccacccaaatctcatcttgaattcccatgtcttgtgggagggtcccaatgggaggtaattgaatcaggggcaggtctttcctgtgctattcttgtgatagttaataagtctcacaagatttgatggttttaaaaatgggagtctccctgcacaagctctcttctcttctctgctgccatgtgagacgtgcctttcaccttctgccatgattgtaaggtctccccagccacatggaactgtaagtccaataaacgtcttttgtaaattgctcaatcacaggtatgtctttatcagcagcgtgaaaatggactaatatagtaatttgttctgggagtggggcattgctgttaagatactcaaaaatgtggaagtgactttggagctcagtaagaggcagaggttggaatagtttggtggaggactcagaagaaaacaggaaaatgtgggaaagtttggaacttcctagagacttgttgaatggctttggccaaaatgctgataatgatacagacaatgaaatacagtctgaggtggtctcagatggagatgaggaacttcttgggaactggagcaaaggtgactttggttatgttttagcaaagagactgggggcattttgcccctgccctagagatttgtggaactgaacttgagagagatgatttagagtatctgacagaagaaatttctaagcaataaagcattcaagatgtgacttggatgctgttaaaggcattcagttttacaagggaagcagagaataaaaattcagaaaatttgccccctgacaatacaatagaaaagaaaatcccattttctgagaagaaattgaagctggctgcagaaatttgcataatcaatgaggagctgactgttaatccacaatataataggggaaatgtttccagggcatgtcagaagtcttcacagcagcccctcacatcatggccctggaggccttggaggaaaaagtggttccatggaccaggcccagggtctgtgagctgcgtgcagcctatggacttggtgccctgtgtcccagctgctccagctgtggctgaaaggagccaaaatagagctcaggtcttggcttcagagggtgtaaccctcaagtcttggcagcttccttgtggtgttgagccttccagtgcacagaagtcaagaactggggtttgggaacctctgcctggatttcagaggatatatggaaatgcctggatgtccaggcagaagtttgctgcaggggtggggctctcatgtagaacctctgctagggcagtgcagaagggagatatggggtcagagcccccacacagagtccctactgggtcaccatctagtggagctgtgagaagaaggccaccatcctccagactctgtaatggtagatccactgacagcttgcactgtgcacctggaagagctgcagacactcaatgccagctcatgaaagcagctagaagggaggatgtaccctgcagagccacagggacggagatgcccaagaccatgggaacccacctcttgcatcagtgtgacctgaatgtgagacatggaatcagaggagatcattttggagctttaagatttgactgccctactgaatttcagacttgcatggcgcctgtagcccctttgttttggttaatttatcccatttggaacggctgtatttaccaaatgcctgtaaccccattttatataggaagtaactaacttgcttttgattttacaggctgataggtggaaaggacttgccttgtctcagatgagatgtcgggctgtggacttttgagttaatgctgaaatgagttaagactttgggggaccattggaaaggcatgattagtttttaaatgtgagaacattagaattgagaggggccaggggcagaattatatggtttggctgtgtccccacccaaatctcatcttgaattcccatgtgttgtggcagggacctggtgagaggtaattgaatttcggagccaggtttttcccatgctgttctcatgatagtgaataagtctgacaagatctgatgattttaaaaatgagagtctccttgcacaagccctcttctcttttctgctgccatgtgagatgtgccttttcccttctgccatgattgtgaggccttcccagccatgtggaaatgtaagtccagtaaacctcttatttatttattttttttgtaaattgtgcagtcttgggtatgtctttatcaggatcatgaaaacagactaatacagggttagaattcaggaggacaattacttttgatggaagtcgattagtggaccagaaggtactatagggcacattctcataatgtgttatttcttgttctggattacagatgccaggcatttcactttggaaaaacattgagcactgtatttagcatattctcaattttccctgtgtatattataattcaatgagaaaaaagacaatagaatatgtatatttttaaataacttggtcacatcacattcattgttatctacaagctgtttgttggtgaaactgtattcaacaaaagaaaattattttaacatataaacacagttaattttaaaatattttttattttttgagtcagactctcactctgttgcccagctgcagtgcagtggtatgatccctgttcactgtaacctccacctcacgggctcaagcaatcttcctgcctcagccccctgagtatatggaactacagacataagccaacatgcccagctagtttttgtattttttgaagagacgaggtttcaccacgttgcccaggctggtctcaaactcctgggctcaagtgatcctcctgcctctgcctcccaaagtgttgggagtacaggtatgagccactgtgcctggcccaaataaattcttaaactttttgataaaatagccctttgcatctgagatgattgataaggccataggtaactatgtttaaaaattttgtatctgtatcttggcagagttatgattttattcaggagagtagataaatttataatggccccatttgcaattatttacacttactggggtatcaagccttgtataaactaaagccatagcattgttcagatttctagtcacatatataaagatcgttgctatttcattgaggaatcattattcctataagattgttattttctttcttccttgacatttcttattatgtgctataaaatgttaacagataaaacataagttatctgaagttgtattttggctcttaaaactcacagagaaaatgtatttaatttcatgggaaggcagaatcttcttatttgtctaatattatactttttggttgaaaatattatatggcatatgctactccttatccccaagcattcttcacagtaaaattagctgaggctcatgaaaaacatgccagctgacagcacaggcaggagatgaaccccaatcttttgattccccagcctagttacccttaccataaaatggtggcaaaggttgactatttgtataatggccaaaaattattttaaatgctgtttcttactataatgaaattaattacaaaaaagtcagaacagagactggaagataggagatttattggcttaagtgctttctggaataacaccagtgagggtgaaggatacagaataacaccagtgagggtgaaggatacagaattggggcaagggtgggattgaactggtgatgctgtttaatggagacctcagctgacctgaggctgtcctttagggttgtcctaaatgaagcaagtggggctggccttctctatcctgactcaagtaatctttcatgcaggctatttccaagaagtggggtgtggccttgggtgagcgacttaatttggatgagagcattccttgaagaaagatttagatctacattacatttctagatggtattgcacaatcggatgtaactatttggccattttcaacccattttcttcttttgtaagatgccgaaaaggaagaggggaataggaactaggaaggatatagattgaagcagattagctgtaagatcatttaaagtatgagaggtttttgggcagtatcttgaattttatatatttgtcacttacctttctctgtaaatatttgagggaaaaaaaggaaatcattctttaaaggaaaaagaagtctcaaaaaggtagcctgaaacatctagcaaaaacactgaagcaaaggaagttatacactttgccatggtaatggctactggtttctgggctttctagaacattcactatgagagccaatgctctccttccctttcccaccatctgcattagtcacttggctgtagaacacaaacagtgacttggagaagctgttgagaagtgaaataaagctacatgagaaagggcagatttttaaaactggagttctattgactctaggtgctgtcctaccaggaggcctgcttctacacaaatggacattgagagggactcgtctgtgagacgatcatccctttgactcatgcatataaggtgcgagaaaccagcatcctaagattggtcccagctcaatagtcttctgagactgggcatttattccatcacccttcagcccttgtggatgcccacaaccaaccaagaattctttcctaggagtaaggagtgcatagagccgttctagtatgataaatatcaacagcacacccattttcaactattcagaactgtaggaacggtggtgagaaaaaagttcaaagcacacttaaatttgcattagaaatgatctcattacctaatacatgattttaaatactaatctgatcaattcattatcaatatcagtttttattctttgagtcttcgatgacatacttcattccacctcttactctgaattactgaaaggaacagtattttttattcaaactctataggcacacaattcattatgcattatgcaatgttttgtgcgatgccatggctctgtataaaaatggaattaaaaagttgttaatgaatgggaactggagacctagatgtcgtttcttggtagctctataagcaaataaattttcaaacaaaattaatctattgttaattctattggactaagaaaatcagcaagtcagtagagttatgcagacacagtcagagcttaaaaaggttcctgtagagagtacagaattgtatcttttgggaggattttacaagataagaagtagtttgtttttcaaagatatagaagtaatgaagaagggatctgacaaagggttggtgaaagtaaatattttagatgatggagtataaaaagtataccaacttagcttctagaaagagtttctattgcaatgtaaaaatacagatatccttcaagacttagattacctaattatttcttaattcctaatatcttagagatttcttcaacaaaatggaccatttcttaaacctcacaacatttcctatctcacacaaggttttggagatctgggggtaacttatgaatgactaaggcaaatggattcacaatttgttgtggaaatctttctggtctgcttagaaaagaatactgtgataccttaagctcatttcaaaggaattccatggaaccagatcagagtctatatctttcctatggcctcatcttctgtctaatatcatggagccaaaatgtacacctggatgttcacaactatttcatatatctgggcttcatagacacatctcatttgagaagatctcagctgaaaaggtccagatagaggagtaaaggtccagatagaaggagtatagtaggagattgcaggggtcttaaagtttccttctcacagttcaccctatttgatcttaacacatagctcctgctgtggcaagcactaagccagccagtccacattctgtctcatcttggaaagcgtgtataaaccacattaaaattgggccagatagacttcaataaatgccttccttcagcttataaatgacaaaacaagaacttgaactagaaattatctttctcatgtcaaaaatctttcagggtcatacttccctcaggttcaaatttgaatttaaaaactattatttattttcctctatcttaatgcatagcactctttttttcaaatgtaagacaggatgttttaaacaatattttcaattaaaaaagatattcaatgcagttttggatggatctgttgcagccttgcaaattaattacaatgcccaacatttatggggtgctgacttctgaccctgtactctgttgcacttctctgtggatgatctcttaaatcctcacaaccacatcataaaatcggtactccattgtgcagatgaggaaactgaaaaacagagcgtgaataatttgctcttcaacgtgtagctattatcatgtaacaaattactcccaaaatgtagcaacataaaataattattgtttattttctcaatagtatctgagaatcaggtatctaagagcagtttagctaggtggttcagggtcagagcttcaagttgtttcatgaggtttctttcagtgtcttgagctgagggtctagtttctcgctacatgggcgtatgcacaggtctgccagcctgtccttaagacataacacctggattccccaagacatgacacctggctttccccagcatgagtgatctaaaatagagaagagaggagagagagagaaaaacagagtgagcatgtacaatctttttaaaccttatcttagaagagacataccatcatttctgccacattctactgctcaccagaccaatcctggtaaaatgtgcaagggaacccaacaggcatgtgaactccatgaagtgggatcagtgggaggcatctttgacgctggctatgatgcttattcactagcaaggagtagaactaggtaacgaatccaggcagttttacttcagcacttaggactctttaccattatattaagaataactgcaaagcacatatttatgaatcttagggcttttccaaaagcgaccctctatggagtttgtggatacttgtgaatgtcattctgtggcacttgcttatcaaagaacacctgaaaatgtgaaggagatatgaatatcaaggacaatagaggctaaatttccaaatgtcccagataatatacaggtcattgtggaaaagagaagataaaaagaggcagaatgaaaaatcatttcagttaagctctttcatttcgacataccattatctttgtctccttcgtctcctcaacaaatctctcaattctgtcaagtaccatgttgagaaatatctagggagggttttattatttcttaaacattgtagcttaaaaaaatctttacttttgatttcctataggtagtatttagtgctaacattttagaatattatggaagttttcaaataccaatgtgccttgttcagggagctaagtaatttggtgagggaatttctacttgaaaaattttgtgcatcaatgtcagagataaattcaattgtcagaaagctgtgtcagaacagatttcttgtcatattttgccgcagagcagagatttattgaaaatgcttgatgatatcgctctctgagctgttttacataaacatagcagtggagtgaatgctttgagttgaagcatttgtgtgtttgtgtgtatgtgtgtgtttgtgtgtgtgtgtatttccgactttcaaaactgacgtcaaggggaaaaataccaaaagatatcctaatacctaatgttttatccaacttactttaagaatgattattttttgttataagtaaatgtagacttctgtgccttttcagaaatgaatcatagaataaaatacttcaagatcgaagctttgggatactggctattctatctgatgtcacaaaataatgaacacttttgagatgcagaaacatacaacagatttattatttttgaaagaaggtttattatttgtaaaccctttgtaatcaggtcagcagcaaaaatacaaaactattagaaagtaaaatttctttcttcagtaatgaaagacttggaactgcagtgtaagttcagtctctagagtgctctcagcactctaactaaaagattatatggcttgcaaaattgttttatgtttctctctccaaatttgtttggctccaaatcagaagatacgtatgaaactctttttctaaacgtactgtgaaacatttgttaataatattattgcttgtattataatatactcattttgataataaaatatagtatgcacagtttgtggaatgagtattttctatatttaaaggagactaacattgtcacatttatgagtaaaaagtatcaatactgggaatgttttgcaatctagcaatccactttaatgactgcagtgatccatttgatcagtaagacaggtgaaataattcagttgactgcctcagagtctgggaatttgagttgtttaaaaatagactttatgctctggtatggcttatatttacaaatgtgttcaactacattattattatcattattattatattaactatataccccaggagagtaaatcatatatcaagtcactctaaaagtctccagtgtgttaaaatgacagatttctaaataatactcctagaaaatccttcatattaaactcacttgaaaaatatgaagtatctctagcactgtcctagaaaagacacaaagacaacaaaattataacttatttctttaaggaatttataacattttggctggtatctggtttgaatctctgattctttttaaaagtttccttgtcattttttaaatttccctttttctggagtctgtttacgtgtttatatatccataatgtgcttttcataaaatatctttattgaggcattgtgctttgtactaattactctcaaatgttcattcatgtcttctctaaaataatttagaaaaactatgtatcccctcatatatttaaaatttgacacttaaaatattttgttacacattaaatacctgtgaaagatggaatttttctgatgtaacatgcttttaaaccaatctaaaagcacaaaaataccatagtagtttgatatcaacatcatccccttaaaaaatatgtgaggaagtgccttgttaacagatagaagttaacaccactcatttttctccttgaactggaatctacaatttattttccccacagattaacatacaaacatgatctatttttatgtttgtgggtctttttttgattatatatctatcttatttttttgcagcataaaatttatataaaccaaaattttattttatgtttgtatttccagtgactatgagtctttgttaattttctttcctatggatcttgttaacattacaattagtgtttctccacaatggcatatagcgtaaaattttattggagtgttatcacttaatgacatgaatggggctttttgtacattaattgcatacatccatgtatgaatgttgcttattgcattaattctattccagtgtgcttgttgttgatctaaacactgtgaaacctttgcctatgtttgcatagatagatagatagatagatagatagatagatagatagatagatagatagatatagtgtgtgtgtatatatatatgaatgagtactataacaatgagatctttatagcaatcactgaacaatttgaacttctcccaaattacatgccaaaatcacattgtgacttcttattctgttatttttgataatttttcaactaacaactacctgagattttccttcaattatgctctaaatgaaaatgttagaaaccacctgacttgcagaagtatttgttactcattcaagttatttactttcttgttttctaggaggttcacaataaaaagctgtaccaaaatttatcagcaattttaaaataaacttgaaaattgctttcaccgagaggcactttttgtaacaatatataaagacaagattaggttgccttttcttttggtgattatttcctttgctgtgcagaagctttttagtctggtgcagtttcatttatttatttttgattttgaagccaagcttttggtgtgaaacctaaaaagatcataaacaagaccaaaatcaaggagcttttcacctatgctctctcctaggaattaacttctgggtcttacatgtaggtattttatccattttgtgttaatttttctgtatggtgtgagataagggtccaatttcattattttcaatgtgaaaatcattcccccagcaccatttatggaagagactatacctttttaacataatttctaatcaggaagtgcagtgcctccaactttgtttttctttctcagtattgctttggttattcaatatttgttatggtttcatagaaattttaagatttttttctatctctgtgaagaatgccattagaattttgatggggattgtgttaaatctgcatattgctttgggtagtatgaacctttcaacaatcccatttatatgtgaaatatatgtgtgaaataatacatatataagctcaaatacacagagatagagaatgaaacagtggttcccacaggtgggagggggagaggaaatggggagatgtaggccaaagaatgcaaaatagcagacatgtgagatgaacaagtctagagacctaacctacagcatgagaactaaagttaatacaattgtattgtattagggatttttgttaaataagtacattttagctactatgttactttgtcacaaaaagtaactgtgagccgatagatatgttaatctacttcactatggtaaccaacctactatctacatgtatctatatgtgtctcaaaatatgtcataaacctctaatatacacaataacatgtatttttaaaaaaattctattaatgtcatcactcctctacactccaaagcaagaatttgtgatagaacaaaaacccaataaaacccaacaattttttactgaaaaataaagacaagattaggaaaattgaaatatcacttagatcttcactaaagcaatttttgttgaaatgatttatctttaaatgatttatatttttattcaatttataggaaatactaatcatttaatctgattagcagagtcactcttcattttcaaaccagtccatcaaaatgctttatctgaaacagtctgacttcatttttcagtttaagtaaacatgttcaaatgcattttaagaaacgttataaatatactgaaaaataaattctggtatataatttcaatagctagtttactagaagcagcccttttaaaatcttttatcttttatatatttaatctgaattttcagttagaatttaaaagaaatctatatgttgcttctcattgagttacaatatgcagtgtaatttgtatctacaattataatgttataaaatgaggaatatgacaaaagaaaagattttcatttggtaaatgtgcatgcatgtatgtgtatgttgaactccagttattggcattaccatctaaataaataaaaataaattattaatttcatagacaggaatatactgctaaaactgatcattcaggtagctgacttaaattttgctttggcataataaaagatagggaatgctaaacattttataagaaaatataagataaagattgactacaattggaatatttaatatatattataattgaatagctattgaataatgaaattgaacaatactatctaaacctagaagatattttgtatgttttttatctgtgggtttcagccactgtaactaaaaaaagttgatattcctgaaaaacattcagttacacttaatatgtcactcacctgcactgatttgggtatttgaagatattttctatttaaagataaatcctaagtatgactattgagaaaacactttgcttctctctctctcgactgtccctcaagagcaatacattcttttacagaattaatggaaaattcccaacattttttcaacccactctacacaatatatttgatttgtgaacaacctaacctttctaatgccatagttcatccttaaaagaaagactaagaccaagacaaacaaacaacatgaccgacataaaatgttaaggtggatttatggtaacttgattaactgtttctttgtttggagccctggaatgttttaaactgcagggtaatatttcgtagtatgatgcttgagggatgagctgtcttttctaaagtaaaaagtgggattggtggagagaggtaagtaagggaacctagttgatactatgaagagtgtgtatagatttgaggatctgaaaattccaccgttttcttttttgcttgttgagtgaatacataaggttcaaaaaacccattaacctttttcttttgcagctgtcgtgagcgccatcccggtgccaacgctagaaagtgcccagtacccaggaatcctcccgtctcccacctgtggatatccccacccgcagttcactctccggcctgtgccattcccaacactctcagtggaccgaggtttcggagcaggaagaagtcagtgtaatgcattttcctctctttttaataagcacaaatgaataatagcaaaggtgtcttgtaaaatatgttgcattctgaccttatcccttagaaaagttgatttccctatgactgtggtactagaatgttcctttccaacacagtgctttggatcctagctcatgtgcatttgtactgattccctaggcacctttccacagcacactccactgacaatacaaggggaagtggtggggaaacaaatgtcaagtggttccatcaaacaatgatgtgatgggtacttgaaattaatatgtcctattaaataggaaattaataatcaagtgatatcttccaacatatttggtatctgttggttatgtctcactgattgctgatgaaccaataacttgggtgaatgctttagatttctttaatcaggtaagtgatactttttcagctttaaaaattaattatcagaaaaaaaggatttccagggtattatttcatttctttgaaggaaggtaggaatgaaaagagactctcaagctattatatacaccctggtgatttctgctgtgccatttgactctttttttttttttttttttgagcacagtgttttaaaatctattttatggttttcatctcttagaacaggtgactcagcagctcatgtgagataggatgttttgtaatagatatgatagtaacaacaataaaatatatttttgaggtaaggtatatttttctaaccaaacagggacagctctaagaaatcataaatcgtctagatacagcaaggttagaattaaaaggcatcaaagatctgccaagggagaattagatttattttctcttttctcactgcacataatatctacagaatagagttgtgtgcaaaaactcgaggaaaaatagttgcccaaactgcattgaagggaattaaataggaaagatgtagaaagtctaataaccaaaattttcaaatcccaagacaactggaaatggaattccaatcaaagaattgagagcccacaagtgccttcttcacttctaaaatgaagctctctgcaacaaaaaaaaagacaagttttaatgttagtttagtattcggtctattggtttgttgtctcctacactcttttgatttcttgtatattctctgactttaaagggaaacatgaaaagaatgtgtagactttcagaggctgaggtgggcagatcacttgaggtcaggatttggagacaagcctggccaatatggtgaaaccctgtctcttctaaattagttgggtgtggtggcgcatgcctatagtcccagctatttgggaggctgaggcatgagaatcttttaagcctgagaggtggagattgcattgagctgagagtgtgacactgcaatccagcctgggtgatggagctagactctatttatttcaaattaaaaaaaaagaatgtgtagaatgacctttatcgggtttctccatcatgactggtacaagccaaaattcaggacttttaaaattagtaattcactatttttattcgtgttgtgttactcatttcttgtccctttttttaaaggcatagttttcttttgaaaatttattcattgagatccaacatcaatttactctttccgttttcctctttcctcttaaattggtgcagcatgtgaaactctctcttattgaatcatggggaaaatgattccaaaagttaaagctcaacgaaaatgaataaagggaattgactagtataaaatttgtttttatctgtggttaaaagtctcatgtgtgacttgtgattttgagagtgagtaggttgtgtgtatgtgggataggaggcttgtgagaaatctctgtaccttctgctcaattttcttgtgaacctcaaatgcctctaaaaataaaatctattagaaattaattgattgggccaggcgaggtggctcatgcctgtattcccagcattttgggaggctgaggcaggcagatcacgaggtcaagacatcgagaccatcctggccaacatggtgaaaccgcatctctactaaaaatacaaaaaaaattgctgggcatggtggcatgcgcctatagtcccagctactcaggaggctgaggcagaaaaaaaaaaaagaaattaattgattaaaatatttattctctagaagatgtttttattttttaaagtaaggattattaaataaaagtagttatacgacaaaatgcttagtgattttttaactttatctaaaatgaaaaggcattggatgttctactcctgcccaagattttacagatttttaaaataaatacatcttcagtcattcatcaagaactttttgagcaaagctatgcacaatgcaaagcaactaagatctaatatgtgttccaagtgactgtttaaaataaataacactcaccctcctttctaggaaactaaatattctctaaatcactgtcagaaacaattaactaacttcccatttcccgtcattccctattggtttctaaatgccttagagaacactaaacaaacattcctgttctctctcaagcagaaaacatttcatgaatctgggtggatatatcttattagtcgccttgggaaacagagaaaggcacacgtattaaaagaaaaagttgactttgccaaggtggaaactctttttcctccaaagttatctgaaagacctttgagttttataagaaatgaaatgaatcactaaagtcctattccaaaggtctgctgccttctgaaggcacaaataaagctgaatttctctccaaccataaggaaagaaaagatatggtacatacatttgcattacatgtattcgctgacctatcagtaaataatatttatatttatatagttgtgatggacaaatatttcttcttcttaataagtaactgcagtactgctcttagcctcaataagcaaatgagttatccctagggaacagtttagctgcattgtatttgaaaacttcaaccaatagatagtcttggggcctcatttctacaaatcagtacaaaattggtgcccccactttcttgtctttgaaacaagtaggtggtagaggagcagtttaagtgatttccactcttccttttagttctgacattgtcttaactagtgggaaggctggtcagctttattcatgctatttttctgcctctgttctccctcaaatgggaaatcaactaataaatgaaacttgacctagataaaatgaggagtgcaatggagttcatagagtaatctctagggtattttaaaaaaatacaggctgtaagaaactggggttatgtaaaaatattgtgttacgtcgttcttctgaggttaatgagtgaattgggtttctagaagtgttcatgactcagtctttgcttagagttattggcttgctatatttctatcaatcacatattgtagtttttatatagaagaaaattcctcatttccatttttataatattttcccagttattctgtagcaattatttatatgtattgacattaattattataaagtaccttgagatttgactctgctgtgtaatggtatgctatttgtataatgaattctgactatttcatcatgtaacaacaagtgccttgctagcatgtatttgattctcactcgatactctgaattgcagagcaggggcacgtcatggacaaaagcaggtttctttgctttcagagatcttggcagagctaaatgtcatgccactaagccaatttgttttgtttcacataggtgtcctaaagccagtgcctgaactggacaaaagtgctcatctgaaatgagagtatttcactggcggaccagttgctattgtatttgttaaagggtttttgctgccttaagtgtcaggcagttccaaaaagcatttattttgctccacttaaaatataagaattatgaattatagatggaaatcctatacctgttcattgtattcattttgaacacaacagaaattgtcccttagggattggtgatatattccgtcttgaggaagggccctctcactcctgtctagtacattaggcactttcctattctccctatgtggtactaaggatggattttgctaaagaggggacctacctatgtaaagccatttttacttctgtcaaagtcaagagccatatcatgatgtttgtttgcagccaggatcacaggagccagctgaaaacttggggatagaagactgggcatgcagacaatttttgtttttggagatgctgatgaggagcaatggcgttaaagagtaggattaggaaaaaagaaaattcagtggcgtaatcagaattcatgtgaaatatgaaagttttcaaaataagagaccaaatttcaaaagactaacaaatgcatgtacattctattaaacttacaatcacaataatgtagatttctttattatactttaatttctggggtacatgtgcagaatgtacaggtttgttacatagatatacacgtgccatggtggtttgctgcacccaccaacccatcatctacattaggtatttttcctaatgctatccctcccctaccctccaatccccgagaggccttggtgtacatgtgtcctcattgttcatctcccacttatgagtgagaacatgtggtgtttggttttctgttcttgtgttagtttgctgagaatgatggtttcctccctacaaaggatataaactcatccttttttatggctgcattgtattccatggtgtatatgtgccacattttctttatccagtccatcgttgatgggcatttggattgcttccaagtctttgctattgtgaagagtgccacaataaatatacacatgcatgtttctttatagtagaatgatttataatcctttgggcatgattctgggccaaatggtatttctagttctagattcttgaggaattgccacactgtcttccacaatggttgagctaatttacactccaaccaacagtgtaaaagccttcctatgtctccacatcctctccagcatctgttgtttcctgactttttaatgatagctattctaactggcctgagatggtatctcattgcggttttgatttgcatttctctaatgaccagtgatgatgagcattttttcatatgtttgttggctgcataaatgtcttcttttgagaagtgtctgttcatatcctttgcccactttttgatgggatttttttttattgtaaatttgtttaagtgctttgtagcttctaaataaatattagtcttttgtcagatggatagattgcaaaaattttctcccattctgtaggttgcctgttcactctgatgatagcttttttgttgtgcagaagatctttaattagatcccttttgtcagttttggcttttgttgtcattgcttttggtgttttagtcatgaagtcttttcccgtgcttatgtcctgaatggtattgcctaggttttcttctagggtttttatggttttaggtcttatgtttaagtctttaatccatcttgagttaatttttgtataaggtgtaaagaagggatccagtttcagccttctgcatatggctagccagttttcccaacaccatttattaaatagggaatcctttccccattgcctgtttttgtcaggtttgtcaaagatcagatggttgtagatgtgtggtattatttctgaggcatccgttctgttctgttggtctgtatatctgttttggtaccagtaccatgctgttttggttactgtagccttgtagaatattttgaagtcaggtagcatgatgcctccagctttgttcttttttgcttaggattctcttggctatgattctcttggctatatgagctcttttctcgttccatatgaaatttaaagtagttttttccaattctgtgaagaaagtcaatggtagcctgatggggtagcgttgaatctataaattattttgggcaatgtggtcattttcatggtattgattcttcctatctatgagcatggaatatttttccatttgtttgtgtcctctcttatttccttgagcagtggtttgtagttctctttgaagatgtccttcacattccttgtaagttgtattcctaggtattattttgttctctttgtagcaattgtgaatgggagttcactcatgatttggctctctgtttgtctgttattgatgtataggaatgcttgtgatttttgcacactgattttgtatcctgagcctttgctgaagttgcttatcagcttaaggagatttagggctgagatgatggggttttctaaatatacaatcatgtcttctgcaaacagagacaatttgacttcctctcttcctaattgaatactctttatttcttcctcctgcctgattgccctggccagaacttccaacactatgttgaataggagtagtgagagagagggcatccttgtcttgtgccagttttcaaagggaatgcttccagtttttgcccattcagtatgatattggctgtgggtttgttgtaaatagctcttattattttgagatacgttccatgtatgtgtccaggaatttatccatttctctagactttctagtttatttgcacagaggtgtttatagtattctctgatggtagtttgatttttgtgggatcagtggtgatatcccctttatcattgttgattgtgcctatttgattcttctctcttttcttctttagtagtctggctagcagtctattttgttgatcttttcaaaaaaccagctccttgattcattgattttttgaagggtttttcctgtctctatctccttcagttctgctctgatcttagttatttcttgtcttctgctagctttttcctgtctctatctccttcagttctgctctgatcttagttatttcttgtcttctgctagcttttgaatttgtttgctcttgcttctctagttcttttaattgtgatgttatggtgttgatttcagatcttttctgctttctgttgtgtgcatttagtactataactttccctgtacacactgctttaaatgtgtcccagagattctggtatgttgtgtctttgttctcattggtttcaaagaacatctttatttctgccttaattttgttatttacccagtagtcattcaggagcaggttgttcagtttccatgtagttgtgtggttttgagtgagtttcataatcttgagttctaatttgattgcactgtggtctgagagactgtttattatttccgttcctttccatttgctgaagagtgttttacctccaattatatggtcaattttagaataactgtgatgtagtgctacaaagaatgtatattctgttgatgtgggctggagggttgtgtgggtgtctgtttggtccagagctgagttcaagtaatggatatccttgttaattttctatctcattgatctaatgttgacagtgggctgttaaagtcacccactattattgtgtgggagtctaaatctctttgtaggtctataagaacttgctttatgaatctgggtgctcctgcattgggtgcatatacatttaggatacttagctcttcttgttgcattgatccctttaaccattatgtaatggccttctttgtctcttttgatctttgttggcttaaagtctgttttatcagagactaggattgcaacctctgctttttcttgctttccatttgcttggtaaatcttcctctatcccttcattttgagcctatgtgtgcctgcacgtgagatgggtctcctgaatacagcacactgatgggtcttgattctttatccaatttgccactctaattggagaatttagcctgtttgcacttaaggttaatattgttatgtgtgtatttaatcctgtcattatgatgctagctggttattttgcctgttaattaatgcagtttcttcatcatgtcaatggtctttacaatttggtatgtttttgcagtggctagtaccggttgttcctttccatgtttagtgcctccttcaggagctcttgtaaggcaggcctggtggtgacaaaaatctctcagcatttgtttgtctgtaaaggattttatttctctttcacttacaaagcttagtttggctggatatgaaattctgggttgaaaattctttaagaggccaggcgtggtgactcatgcctgtaatcccagcactttgggaggccaaggctggtggagcacctgaggtcaggagttcaagaccagcctgaccaagatggtgaaaccccatttctactaaaaatacaaaaactagctgagcatggtggtgggcacctgtaatcccagctactcaggaggctgaggcagagaattgcttgaacctgggaggcagaggttgcagtgagccaagatcgcacactgcattccagcctgggtaacagagcaagactccatctcaaaaaaaaaaaaaaaaagaaagaaagaaaattctttaagaatgttgaatattggcccccactctttctggcttatagagtttctgccgagagatccgctgatagtctgatgggcttccctttgtgggtaacccgacctttctctctggctgcccttaacattttttccttcatttcaaccttggtgaatctgacaatttgacgattatgtgccttggggtagctgttctcgaggagtatctttatggtgttctctgtatttcctgaatttgaatgttggcctgtcttgagaagttctcctggataatatcctgaagagtgtcttccaacttggttccattctccccgtcactttcaggtacaccaatcagacgtagatttggtcttttcatatagtcccatatgttttggaggctttgttcatttcttttcactctttttgctctaatcctctcactttatttcattaagttgatttcaatctctgatatcctttcttcccaagctggctctctagattcctcgtctctgggcagggcatctctgaaaaaaaagcagcagccccagtcagggacttataggtaaaaaccccatctccctgggacagagcacctgggggaaggggcagctatgggcacagcttcagcagacctaaacgtccctgcctgacagttctgaagagagaagtggatttctcagcacagtgtttgagctctgataagggacatactgcctcctcaagtgggtctccatccagcccatgtatcctgactgggagacacctcccagttggagctgacagacacctcatataggcaagctctggctggcgggtgcctctctgggacgaagcttccagaggaaggtacaggcagcaaactttgctgtcctgcagcctccactggtgatacccaggcaaacatggtctggagtggacatccaacaaactccagcagacctgccacagaggggcctgactgtttgttagaaggaaaactaacaaacagaaaggaatagtatcaacatcaacaaaaaggatgtccacgaagagactccatccgaaggtcaccaacatcaaagaaagaccaaaggtagataaatccacgaagattaggagaaaccactgcaaaatgtctgaaaattccaaaaaccagaatgcctcttctccaaaggatcacaactcctcaccagcatgggaacaaaactggacagagaatgagtctgatgaattgacagaagtaggcttcagaaggtgggtaataagaaactcctccaagctaaaggagcatgttctaacccaatgcaaggaagctctaacccaatgcacggaagttaagaaccttgagaaaaggttagatgaattgctatctagaataaccagtttagagaagaacataaattacctgatggagctgaaaaacacagcacaagaacctcgtgaagcatacacaagtatcaatagctgaattgatcaagtggttgaaagtataatgtagattttatttcaaaaatgcagaaaaagtagaaaaggaaaaattgaaagaagggagtaaaaaaggaaataaaacatcataaacatattgtccctttaatggctaaaccagtgtttaaaatgtaatgtgcattaattgcaatccatattcaatagagagaattatttaaggcagatttttgaggaaaattgtgaaatttctttccctggatgaatatttttaatgtggcatttatagaccctttaatgaaaagctagcccattggagataaaggaggaacctagagaaatagccacaggaacatcatttgtgagacgcacaattcacagaggaacacagaagccaaagcattttcacttccccagaatttcttctgtgaaattacaaactctttctgatgaataattttctccaatccaacgattatcttgagaatcctttgtgaaagagcctgccttttcctcctaagcaatgcctgcaatctaacatttcacaagcatcctctgagacctgtggttggaaggaattgctatcaaggaggcccacattaaggtaaactttcttatgggaacaaagagtgaggagaggacttgatgtcatctctttcaggccagtgccacaaagatgcccaaagttgggtcttggctaaaaattgaccatcggtcatagtctcctttagattaaatgagtcaaaagtcaaacctgagtaattttcattgtctctagaaccacactcacaaaaatctcattacatgacactgtttgaatacaagcacacaagtgtttctctcccctttacagtcttaaaagaaatttagtgccttgtataacacctacctaaagcctcgcatctgaaagccaacatcaccaaggatttgccttaatggtttacttgcagccctacactttatccttaatactgtgcattcatttgctctttttcttcttctttggtaagaaagatttcctagcctggaaataaggcacttctcttcaaactccttgggattctctcatttgctgccttgattcatttcccttgttcaaagaaatcttttatcaagtctctgcctgtattttggctctgattgctatatggctacatcctgtgctcagccaaccttgtatctatctttctaccttcatctctgaatgggataagcctggaggctgctcaatgacccagaagacctctaaccccttctgaatatagaagaatgagtatagataccctctgaagacacatttcacttctgcataactttaattctatgtcttgatcttttgtatcttaaatctctattcccttcagaattatcagattttctatttcctctgccctttgatgacctccttgagcctccgggagacttgtctcaaaattatctcactaattatcttgaaatatttcctggttaaaaattctctttcaaaagcaagatattatcttatatcactgcattttgttttgatttatctgacaaaactttattaagaaataagtcatcagaaaaaatattttattaatacttaaacctactatgcagctcgttttgcttgcagtttaacctggacctgttaactttgaatatgaatgaatagttcaagttcaatcactgtgtcattaacaaggaaaacttccttgaaaatattttattctgtcttaactgtgttctctggaaaaaaaaaaaaaaaggtgtatttccatatacaaagcttttcaaatgcccataggcactcacagtaaccgtgcagaacctcttcaactaccgtaatctgcctgaaaattacaaggtttactatcaaagaggaaaaattgcaattccgcattcaggcaacttgttctggcagagtcatctctcatataactttttagctagatgtgcctccattttgttatggaagataatgatagtggttattatttgtatcattttattagcaatgcctctgagcatcctgtaactctgatttgtttgacagttgacatggcatgtttaaatcacagaaaaattggctggtagaaaataatgcagctgtaacagggtttggtacattgaatttcactgacattgctacttatgaaaggagaaataactcttttttctcgcttcatcacttatgattagagggcccagacagttcaagcaatatagtcagtgctcaatatattttactattctttctcaaagataaattcctgtcctgctggatctatttctattgtttaaaggggaagtgctgtcatgttccgtaagtatatgaaggtagacgaatgacaatgttcataacttggagaagagactgaccacatcctatcacatctctctgaatggatgcagggactgttccagtgacttaaggaaaacagactttgtccaggaataatgaatgacttttcttgtctccactgcagcagtgagtgaaggaccaactacccaacaaccacctatgctgcccccatctcagcctgagcattctagcagcgaggaggcaccaagcagaaccatccccacagcttgtgttcgaccaactcacccactccgcagctttgctaatcctttgctacctccaccaatgagtgcaatagaaccgaaagtcccttacacaccacttttgtctcagccaggtaaagtactcggttgttcacctttaaaattcttattattattggtgcctctatttaagtgcatgagggtgcttgagaaggcctagatgtcatatatcttttcaatgctgattacatgcccagtgtgctcatttttgttactgatgcttgtagtgtaacccttaatgacccacctcccaagcaactgattggttgtaggtgcttttcatccctttggaaagttgtccatgaatcctggaagccagtccaccatttttaatatgtgctataggtgtgcttgctagagaatactggaaacattcctgattccctaacttcattctgccacatgagttctaagcgttaaagctagactgcaagactagatgtaaaggtataaaaatctgcaaaaccactttttagagaaatcataattctaatttgtgcctttcaatagtcatttctcaggagttcttatttatttcagagtactaggccacaaagaaatgtcagaaccagtgctgagtacaactcaattaattttaaaaatgaagaaactaactaacatttagattgatagaaagtaaaatatctatggtcctttctaagaaaataagatggcagggatgggaaatgagtcccagattcccaatgcagtattgattttattacttcagctagtatccaaattgagctccattttgtttttgttaggggttgaggagggggagagagaggcagagacagaagaaggaggagaggaggaaaagaagaaacaggtagaatgaatgtcaatagataagtagagataaataaataatagtacttaaaattatttggaatattagaataattcttaaaatcctcagtatatcaggcataagatagtaaatttcagtaatctgagatggcctccttgatgagcataggcagctgaactgggctaatctacattatgctcatacatttgactaacttttctgttactcagacctacaataatttattttgttgcattagtacacaagccacataatgactgtaaaagctagaaaaatgattgtctatgaagtataaatattaattattttatattaagaatgtatctagttgctgggatgacattagttgatttgtacacatcacctctgatgttctcaacattcacatgatgtgcaatatggatactcagctacacagcccctgggaggtggagtggagcatgaaagcatgtaggattccattggttgggacgcacgttccactatggagtcttccttgacacataggctcagcacaggtcatgatttcattctacaagagatggcccttctcaccccagcaaagcccacatagggacttaaaaaggtctgtattgcccaagcccctctctccaccctcccatgcatacacactccacacatactacattatggggaggatctgctactttatatggccccaaaactatgaagtctttgataattgaggcagagacaacttgaagcaagagcattcatttactgaaattctggtgccaagagtatgcttccttgtgatttctggctgcatctgtttccccactgcaagcacaacccaaggaaacagaccttgaaggaaactagtattcaagatagttgacagcttaattgcaactgctaacaataacgagcctttaatgaatctttaatgcacctgcctataggacaggcatgattctgaaggcttattacatctcatttgatcctctaaacaactttgtaaggtagctattagtcttaaccccattttaggcacaaggaaactgagacacagagaatttaagtagcttaagtctacatagcaagtaagtaatgcatcttttccctgctctcctgggttctcaaattttagaaactcatttgtgcctcttagtttatgtctaacttgtttaataagaaaaagactaataaaacgactaaatcattaaattaaatcattagaagaaaaaatcaagaaacatcttaaaataattctgaattgaagaatatattttctcatcagatttcttcactcacattttaatgaggaaaggtaagaaccttaactattctatagtaaagaggaccaatttggtagcaacaaaaagtaaagtgcggttgcagcagtttatgctgttaatgttctctcggcttgcaagtaaaaactttaagaataaaacagctgaaaatgacattctggaggctactatggctactttaaatgaaaaattttactgcaccagtgatgtttagtttgggacacaagatttggaagtcaacctatgctctgaagtgctacaataacaaaaggatacaattttttttaaagaagatttgatgatagatggagcagagaattggcatttttttactagttattttcttctaattacattaatgccaaagctgcctaaaacaaaatctgatacaatgcagtataagtggattatgtccttcatagaagggaagtagaatcagttgtgctgtttctatactaatttcatcaaataataagcatgtctgaagagccaaagaaccattctctgatctaatggcaacaaggcaaaatctcgttttcttttattttcatggtacccttaagatccttcttttgtttttatttgaactatttctctcaagccatctcttctttcctattttcagatatctctggctagagtttttgtttgattttatgttttttatagctcctctttaaatgccactcctctcccccactcaactggaggcatgccccgccatccctttggaattattaaattctttttcctttagtgtttctctcttattgtcttcctatgattcctgttcatttcataatgtcttacctcatgattttcaaataagttcttcctgcattgctcctgacacatggtaaatagcatgctttttaaaagggctaatgtttacttattctgatagaaaaagaaaattagcagactgacaaatgtattagctgtgacattaactacatgcttcttagacttaaagatgaaatacttagagctttcaacaagttttgattctaagaaaatcattactttcctcaaaccgattgatgaagtaaagtcattctcttgtcagcttttaaaaaaaatacctcaaataattttactgtggatttcacaagaaaggactgcataattagtgatgaatttatctttacttaccgcaagtaattactttagaatatggtaatgtgaggcattgctctaatttttaaaaatgagaaacttctactttgaaagctttgagattaggatcaaggaagaagctctttccccactcaaattcctgtgtgtgaatttgcttttttttttaaatttattttattttaggttctggggtacatgtgcaggacatgcaggtttgttacatagttaaacgtgtgccatggtggtttgctgcacctatcaacccatcacctaggtattaagccctgcatgcattagctatttttcctgatgctcttcctcccttcaccctacccaccgacaggccccagtgtgtgcagtgtgtgttgttcccctccctgtggattttcatgggcaacaccatcagtctgtgccttagtttgcctcccaataaggcacacagagctatgcttgcagcagttttacatgggtctagggcaaaacatattatgcagtaatagtctccatggggttgcagagcattttgcaatatttttatagtaagcagtaattagaaagccattctgttgtcataacgactgaaattctgcttacctgaaaacagattcatttcctcaattttttttccttccacctgctgagttaaaaatgtaacttacaagactctagggtatttatggtgtttcttacaatttcatcatcaccttataatagagtgcttccattttttaatgctttatctatagacgtgaataaccgtgagatctttacacatttcatggaggctgcaatcactacactttgcaaatcacaaatgtagacatgtaagtgatttggcttagtccactttcaggttaaatagaaaatgtttgatagagtattgggcttattgcattatagatctgacataaattttacaaagggctaagatagggtgtgtgggtttttttcttctttactagttaaaattccttttagtgatcagctgcactttaaatgaacctgggttaggagaccatttgtcttctagagatgtaattctaaagggaaagaaaatgtgatctcttaaatagtgacctttatatcataatactcttttataacattagccccctggacctcttgcaactttgtaaaactccataagcactatattttccttcatttacacattgcattttacacacatatatttataaaagcaaaactccagagcattctgatcttttccatcttcaagggatcaatatgtcagtggacatgacaagtccaaaactcacttcattgtactgcgaaattgagtttgattttccccgtgcaaattgtggcatgtgctttaatttgtctgaggactgaagacaaggagggggtggaggtggctgacagtggacagaaaaggcgtttgatttatattttatggatggttgggaaatcatgtattcctgctgtaacctgatctttttggcaggccttatttcagtaaatctgctatcacacaaaactgccaataaattactataatgccttaatacaattgctttccctgagccactcgtaggctgccattgcgggtattcatcaagaataccacacgagtgttccattctgctaaaatcagccacaggcagaggtcatgggagatcagacatcctttagaaggtgacacaagacggtcattttaaaggccagtcagatagaataaatcattggcacagctaaataggagagatgtgttgatttgctgttattgaagccaatacttccaatcaatgctatagtggaaaattacactacatctaagtttcatctcatgtgaaagctatcggtgtggctttttggtagacatctccttgaaattttcctgtcctcactcctaacagaattaggatgattcgatttggtctggtcatcctaaattaccattggtaaaatgtaattaaggcaaatttaagtatcaataatgtttgtgactctggaacctacctacttggtggcttaataaattagtatttcctctgaggttttagaaaataaatattaataggaaaagagctctgttaattgcccagaggagagagaaataatttctagaagagtcattatgcgtaagccaagtaattgatgccctatttataagtgacaaagcagaggcctaaaaacgttaggtagcttgcccaaggtcaacaattgaggtgacagccaaatgtaaagaatttggagaaatgtttttttgtttgtttgtttgtttttttaactaactttgaagatagatagatacaggattttacctagcttttttgtgatgttaacagttattcttagagtgactttttccccccctaaaaggggtcttctaggatcctaataattaaatattctttaggaggaactacatcaggtaagttaagtcatttagctgagtgtttgagtaaacattttattcctttatgttggcattacatggagaggagatgttatagcaaaagtagcaactagctggagcactctggaatagctgccatctgcctttaactcacctgtccagtctgtctgtcgagtatccctctacggtaaggcaggaagccaggggctgacatctgacatctgttgctttcaccatcactgatggccaaggctttagaaacaaattaaaaaaaataaagatgagcataaagaagtatataagagtttaaggcatatgggactattgcttacaatgggagttggagagtgtgagcataggtcaatgagagcaaaaactgaacagctagtatttttcagaattgcaaaaacttcttttggggagggagtgaatgactgcagtagaaaagtttgagtcccttttatgaaaggtttgcccaattacaagaaaatatcgcatcaagaattgttagaccatatatgaaactgaagttaactatatcaacctaatacaatgaaactctgaggttaaagtattcagtggccatccagataatcgtaagagaaagtgaaaaataataaataatctattttcagaactttgtaacctaatagaagacataattcgaaacatgtaagctacaaagaatgtacttggattatactgcagagtgggtggccgcatgagtgacagaaggaatggtgaaggaaaggtgggcagtaggttgttttcaaggcagtaaatattccttttacatttcttatacacttgatgggtcacatggttaactactgctgtatagattttgttgttgttttgaaatattttgaaaataaagcatctttttaaaaatcaacttacataaaagtagtaaggcttatgctttatactttgtcacctttttatagtttacagaggacatttccaaataaatgtatatctacctgagaagtaactttgaccagcattaccaatacagaggtcaatatttagagaggttgaatacctttcaacttttccagggtcatgtgtcattattcttaggaccttcatcgccacccttacatatggtggacactcgaatgttggttgaattggtcagaatataataaaataattaaggtgagagccagaatttgactgcagttcttcaatttcaagtctaataatgagtttagacaaaccagagcgacttgtaagtttgtaaggattagatatcaggtactagaaaaagataaaggcagatacgatgaaataacttacaaattcatgaacattttataacatgtttaataatctgaactataaatagcatcttatgctaaagccaaataaattgcatagagtggaaaagacacttgaaaccacagccctcggaaattcagtggtttatttttatgaaaataaacagacatgcagtggcctccataaagaagaatagaattctctgcgttcatagaaaggaggcggccaggtgtggtggctcacacccgtaatcctagcactttgggaggctgaggcaggcagattgcctgagctcaggagttcaagaccagcctgggcaacacagtgaaaccccatctctactaaaatacaaaaaattagccgggcatggtgtcatgtgcctgtaatcccagatactcaggaggctgagacaggagaatcacttgaacctggaaggcagaggttgcagtgagccaagatcatgccactgcactccagtctgggtgacagagcaagagactccatctcaaaaaaaaaaaaaaaaggaggaggagtgtggatcagtggaagtcagtcagagtcctaaggactagtctctccatcatgccaactacagaactgattttgctcttctgaatctcacttttctcatctgtgaaatcagatggtctttcctctttaaggaggaaggaaacatgaaattctacaacctcagttactacagaaataagggtagatattctccctttctcctttttgttttgtgaaagactatgagtaagagaaaggttttaatttgaatattttgagactcatggtatacattttaagtattctaagtagttgacagatctttaaagttcttcaatgagcatcaagttacagttgctttctttggcagcaaggggaaatgttgaaataaagtgctcacataaacctctgtgctaatggactattgaaaatgtgttatgaaaaatctaacatactgaaagcaaacaaaaagtctctgtcatattaaacagtttaaccatcagcaacccatttctaaagacatgacctgtagtacctaaaagactgtgtgaaaaacagtcttcgatttgaatgtttataactcttatcttactagcagggacttataaacgaattcaggtgtcatgttaaacatcttgtgtgtgttccagcattgactttcatcttaggcttgcaggaggactgatgttcttatctccaggatctccttatttaccggaatatcaaggctcttagaggagaatgcctttatcttctgtggtaaaagggattctacaagcttttttggtggaaaacaatgataagtaagccctattcatgaaaccgtatgcctctcattttgaaatgaataattgcacgtacagacttataagaataatggcacttatagtgactgctatttttaatgtctttttcaaagtgctcttctaaaacattcttctttgacatttctgattcttttacccagcaagttttatgtatttttctacttctgaggtcacctgagtaagaattttctaacagataccactttttttttttttttttttgagatggagtctcgctctgtcacccaggctggagtgcagtggtgcaatctctgctcactgcaagctctgcctccggggttcacgccattctcctgcctcagcctcccgagagctgggactacaggtgcctgccaccatgcccagctaatttttttgtatttttagtagagacggggtttcaccgtgttagccaggatggtctcgatctcctgaccttgtgatctgcccgcctcggcctcccaaagtgctgggattataggcatgagccaccgcgcccggccgagaccacattttttttttagacagtctcttactctgtcacccaagctagagtgcactggctcaatcacagctcactgaagctttgtcctccctggcagtggttatcctctcgcctcagcttcccgagtaactgggactacaggtgagcgacacctcacatgactaatttttgtattttttgcagagatgaggttttgttatgttgtccaggctagtctcaaactcctgggctcaagtgatttacccacctcactctcccaaagtgttaggattacaggcatgagccaccgcgcctggctaagactgcatttttttaaaccacgataacctagtatgctcttgagtcaaaaattaacttttagttttagtgttgcacttaaaagaatatagttatttgtttattttctttttggctacgctctgagtggtacctcatttaatagaaacaggctgcttggtgcacacatgcctgagctgacacattagaatacttgataaatctggagaacacattgcctgataagttgagcccagtgaagttttcatcaccttatgagagacggtgagcagaggaggtcagagcaactgctcagagctgtctgaatgtcgttcccttagtctagagaaaagagtggcctctttcatttggacagggcttgctctcaaatcataaatgcatttgacagccaggaagccattttcactgtctcacttaaatggtcacactgcaaatgatcccaccacattacaatagcataggtccccagtaaggccttatatccaacaggtgtacagattaggtggtcactacctggcttcttctctctcataaatactgcatctcccgacttgctcctcacaatggaccaatttaatgtgattaaagcttctggagtttcctagatcccagctctaacttccagtttagctattccctgcaccaactctctgcaaagagaatcaatagcaaagcaaagagggataagaagtgaggagtaggaagtaagctattgaaagtgagaaaaagaggttatttctcattgagcacatgtaaaacactactgatgtctttgtcttctcactgaaaaattatacattttgtttttattaagcatgttacagtatgggtaatgtccaaacatgatttgagatataaatattaacttctaagctcagcatggacatggctatcaaaagcagtgtttctcaagttttgtgtgcctgggaatcacctgcagacattatgaaaaggcagatttagatttagcagatctagagtagagcctgaggttctgaattgctaaaaagattctaggctttgctgaggctgaccctctgcagattagattatgaggtagtttggattctgaacagattggatgctcttaacctggggttcatggaagaacttgtgggtttggtaactcacttgaaattaaatggatatttctctgtgggtgtgcctgtacatttttctagcaagtgagttcatagcattcattagtgtctcagatgatttattatctataacaggttaagaaccacttgacctgctgttttgtcatcaccctcaatgtagctcacctgtggaacataaaccaatgtctgtttttcttttgttttgtttttcaagatcagttccaaaaccttgtactgaaacaacttttctgaatctgaggccaaaagctgagtacttgtgctctactcaaatgaaactctgcaaaatttattcattttcatagaaacacctgaggctttgtacatttttcaacatgtgatgagggaattagttaaattagtatttataaatttgtccttcttctgcaacaatctcttatttttattgcctaaatgaacatcagtagatcagagccaccgctgtccatggtatattttctccaaaagatgagctcctgtggggaaatgggatgtgttgtccttcgaaaggggtcatcctaacctgtccttagcacccctcaaatggtacactgaaaagcacttcctgcagagacttaatgactgcacacacatttccccaaacatgactcatcatttaataaaaatttcccattcagccagtgtcaccccaggttgaacagcatatgcaatctgtaaaataaattttaatattttttctggtggtagggagggtaagtgaacccatgaatagtgataatgttaaatcacagagaatgggagctaattaaaataaatgtttatttgagcagtcaagtagttcaattgtattctataatttcccagaagatattatcataaatcatttattgggtataaaaatgccgtaagtcaaaagagtatgtgtttgaggaggctggagagtgctaaagaggagttgagagaaaggagtgcaaaaacaagaaagatatttgaagacagttttcatcctttgcattattcaaactaaagaagctctaaagccaagtactatgtttgtttgttattctttcccaagacttcagaaattttcacttccatgatactgtgatgtttatatttatattggctccccatttaaactggaacaagtctagctgggatcaacatagagaagacagcaggaatatgctgatttactcctattccttcttctacctctttcatcaccccctgccaccatcccacactataactgctgtctcttctccttctctctcactctcacatactcctctcctctaagattgtctggcctgttctgtttcactcagctttctatcaaagcctaccttgtagaattttttatttttgtctaagaaagaacatataatttaagccttacttatcagctgagtggctttgaacaagtcctttatcttctttgaattttgattttcctatccccaaggcatgagcaataaggtatgctttaaaagttctattttaaagaacagataagaaaatgtaggaaaaggtgttttactgcagtttatgtacctgtaggtgggacaaaggttacctgttttaccctttctctctctaggttttagtttataaaaataatagagacaaggtactgataaccagatgggaatcaaggattgcagagaatcacagccttttggaaaatggtaggagtaggtggaagacctcttcctccctccctgactacaagaatattcgacctgctagctgtaaactgaaacagacagtagagaggtggctgggacttctggagtcaggccttgccttgtttgcttaacaaatgcaattcttgtgaagtttaaggatagagggtcgagaagccaagatggccgaataggaacagctccggtctacagctcccagcgtgagagacgcagaagacgggtgatttctgcatttccatctgaggtaccgggttcatctcactagggagtgccagacagtgggcgcaggtcagtgggtgcgcacaccgtgcgcgagccaaagcagggcgaggcattgcgtcacttgggaagcgcaaggggtcagggagttccctttccgagtcaaagaaaggggtgacggacggcacctggaaaatcgggtcactcccacccgaatactgggcttttccaatgggcttaaaaaacggcgcatcatgagagtatatcctgcacctggctcggagggtcctacgcccacggagtctcgctgattgctagcacagcacggcagtctgagatcaaactgcaaggcggcagcgaggctgggggaggggcgcccgccattgcccaggcttgcttaggtaaacaaagcaaccaggaagctcgaactgggtggagcccaccacagctcaaggaagcctgcctgcctctgtaggctccacctctgggggcagggcacagacaaaaagacagcagtaacctctgcagacttaaatgtccctgtctgacagctttgaagagagcagtggttctcccagcacgcagctggagatctgagaacgtgcagactgcctcctcaagtggatccctgaccccgaccccccagcagcctaactgggaggcaccccccagcaggagcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgcctctcctcctccaaaagaacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctggagaactatgtgaagaatgcagaagcctcaggagccgatgcaatcaactggaagaaagggtatcagcaatggaagatgaaatgaatgaaatgaagcaagaagggaagtttagagaaaaaagaataaaaagaaattagcaaagcctccaagaaatatgggactatgtgaaaagaccaaatctacgtctgattggtgtacctgaaagtgatggggagaatggaaccaagttgggaaacactctgcaggatattatccaggagaacttccccaatctatcaaggcaggccaacattcagattcaggaaatacagagaatgccacaaagatactcctcgagaagagcaactccaagacacataattgtcagattcaccaaagttgaaatgaaggaaaaaatgttaagggaagccagagagaaaggtcgggttaccctcaaagggaagcccatcggactaacagctgatctctcagcagaaatcctacaagccaaaagagagtgggggccaatattcaacattcttaaagaaaagaattttcaacccagaatttcatatccagccaaactaagtttcataagtgaaggagaaataaaatactttacagacaagcaaatgctgagagatttttgtcaccaccaggcctgccctaaaagaactcctgaaggaagcgctaaacatggaaaggaacaaccggtaccagccgctgcaaaattatgccaaaatgtaaagaccatcaaagactaggaagaaactgcatcaactaacgagcaaaatcaccagctaacatcataatgacaggatcaaattcacacataacaatattaactttaaatgtgaatggactaaatgctccaattaaaagacacagaatggcaaattggataaagagtcaagaaccatcagtgtgctgtattcaggaaacccatctcacatgcagagacacacataggctcaaaataaaaggatggaggaagatctaccaagcaaatggaaaacaaaaaaaggcaggggttgcaatcctagttctgataaaacagactttaaaccaacaaagatcaaaagagacaaagaagaccattacataatgctaaagggatcaattcaacaagaagagctaactatcctaaatatatatgcacccaatacaggagcaccaagattcataaagcaagtcctgagtgacctacaaagcgacttagactcccacacattaataatgggagactttaacaccccactgtcaacattagacagatcaacaagacagaaagtcaacaaggatacccaggaattgaactcagctctgcaccaagcagacctaatacacatctacagaactctccaccccaaatcaacagaatatacatttttttcagcaccacacctattccaaaattgaccacatacttggaagtaaagctctcctcagcaaatgtaaaagaacagagattataacagtgcagaccacagtgcaatcaaactagaactcaggattaagaatctcactcaaaaccgctcaactacatggaaactgaacaacctgctcctgaatgactattgggtacataacgaaatgaaggcagaaataaagatgttctttgaaaccaacgagaacaaagacacaacataccagaatctctgggacgcattcaaagcagtgtgtagagggaaatttatagcactaaatgcccacaagagagagcaggaaagatccaaaattgacaccctaacatcaccattaaaagaactagaaaagcaagagcaaacacattcaaaagctagcagaaggcaagaaataaatcagagcagaactgaaggaaacagagacacaaaaaaaacccttcaaaaaattaatgaatacaggagctggttttttgaaaggatcaacaaaattgatagaccactagcatgactaataaagaaaaaaagagagaagaatcaaatagacacaataaaaaatgataagggggatatcaccactgatcccacagaaatacaaactaccatcagagaatactacaaacacctctacacaaataaactagaaaatctagaagaaatggataaattcctcaacacatacactctcccaagactaaaccaggaagaaattgaatctctgaatagaccaataacaggatctgaaattgtggcaataatcaatagcttaccaaccaaaaagagtccaggaccagatggattcacagccgaattctaccagaggtacaaggaggaactagtaccattccttctgaaactattccaatcaatagaaaaagagggaatcctccctaactcattttatgaggccagcatcattctgataccaaagccaggcagagacacaacaaaaaaagagaattttagaccaatatccttgatgaacattgatgcaaaaatcctcaataaaatactggcaacacgaatccagcagcacatcaaaaagcttatccaccatgatcaagtgggcttcatccctgggatgcaaggctggttcaatatacgcaaatcaataaatgtaatccagcatataaacagagccaatgacaaaaaccacatgattatctcaatagatgcagaaaaagcctttgacaaaattcaacaaccttcatgctaaaaactctcaataaattaggtattgatgggacgtatttccaaataataagagctatctatgagaaacccacagccaatatcatactgaatgggcaaaaactggaagcattccctttgaaaactggtacaagacagggatgccctctctcaccactcgtattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacccaggaatccaacttacaagggatgtgaaggacctcttcaaggagaactacaaatcactgctcaaggaaataaaagaggatacaaacaaatggaagaacattccatgctcatgggtaggaagaatcaatatcgtcaaaatggccatactgcccaaggtaatttacagattcaatgccatcctcatcaagctaccaatgcctttcttcacagaattggaaaaatctactttaaagttcatatggaaccaaaaaagagcccgcatcaccgagtcaatcctaagccaaaagaacaaagctggaggcatcacactacctgacttcaaactatactacaaggctacagtaaccaaaacaggatggtactggtaccaaaacagagatatagatcaatggaacagaacagagccctcagaaataatgccgcatatctacaactatgtgatctttgacaaacctgagaaaaacaagcaatggggaaaggattccctatttaataaatggtgatgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtcgaaaacaccaaaagcaatggcaacaaaagacaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaatgcaaacaaatttacaagaaaataaacaaccccatcaaaaagtgggcaaagcacatgaacagacacttctcaaaagaacacatttatgcagccaaaaaacacatgaaaaaatgcttatcatcactggccatcagagaaatgcaaatcaaaaccacaatgagataccatctcacaccagttagaatggcaatcattaaaaagtcaggaaacaacaggtgctggagaggatgtggagaaataggaacactttgacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacatatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacccatggacacaggaaggggaacatcacactctggggactgttgtggggtggggggaggcgggaggaatagcattgggagatatacctaatgctagatgacgagttagtgggtgcagcgcaccagcatggcacatgtatacatatgtaactaacctgcacaatgtgcacatgtaccctaaaacttaaaatataataataataataataataataataataataaaggatatagggtcttcaatgtcaatgcccaatgtcaagcccaagcaggtttaaaaacttgagtagtaaccattagtaccttaaccctctcgtctcatttttcacagacaggtggcccaatgaaagccacgttacttgtgactcagagtagccctttcttacaatgggaggaggagaaaggagcagagaggggagcagggcacctcatcagcacgtccccagtggtcaaataggctgtttcccttatttttgaggagaaataagaaggttgggagaagaacacaatgtttctctccccagaagtggcatttagagatgtttatcacccttaaagtacaattcacatggtagactaaaatgccttaagattgttgcaaaatttatagtttgaaattcgatcacttatgagggatgcctgaggctattgtgtctgagtaaatgcggctactctctttttgttcaatatttgttgaagatgaaagggtagagtattacacaaagtttcccatacatatcttttatttctcccatgccctcaaaagttccttgcctatcagaagtgtaaatgattatgtgacacttctatatctgcccccagataacccgagcacaggctagttacttaataataagtatatataagaataatattctggttcacagggaaactagactgagagagtccatttcattttgtctggcatcacagaatggatcagagacaaagcagagataagaacccaggcttcttcaaagccaccctttttaactttgttcttaagggtaaaggaatggaaaatgaagtaggaaataggaaaaagtggggaagatgtgagttaatagtgaaatcaaaaccatgctgtgcattggcctctgatcggaccctggtgagcatttttagagcattccggctgcagcctaatgtttctcaccccaaaaaattattttacatgggaaaaccttctgcagagagatgctagcaggagtctgcacctggcagtcctatgttatgtacctaatgagtaaatgaaatgtttaataactgtactgtgaaaatgaagcttaaaacagtaaattcctgctgaggctgctcttctgcacctgaggcacactgctagcccatctcagaactccagcccatttttattttttcctcttagtgggtcctgctgaggagataacactaaaaccaaagcgatgctcacttaattagttgtatatcagtgtaagaacatttacttagcacatcaacagccagcgttccaccaaagggtcgcctgaaacttctccaacatgcaccctggataggggaaattctgcagtggcttcagattgagcattcgtaaatttaaatttgtcaattagccatggatcatttaacctcagaaacgtaataccacttatttttagagtatctgtttgaaatacaaaagcagtaaaaccttaattgttggtatagcttttcactaataattttaagaaaaaaatgacagaacatttattttttacaaagcactagtttaaaaataaattattgcaatttgagttaagctttaactggctggagattcctttagattcaatggatcaactaattcttcctaagtcttaaggagaggcaagaaatccaaatgtaaagttaagtacaggtagaatagctatattatccttgtgtaattttcatagctaataacttaaaaattaaatttcttacatttatagacatacagaccccaaaatccaaagaaattagactatcgagccaaggtcacaaaactaggtcctaggctaaaatgcttcctcagtatctggaatatttatttgagcactcattaaatacttggaatttgttgtatagatcacacacagtttaccatcattgaaaataataatatagatcagcttagacttcagagtgggaaacgtttcatctttcaaggcctatttgcaaaatgaaaggtgatttttccaacttctcagagccccagtactgatcctcttctcactagctcccacccagccttgagcacctccctctcccaaaatgaagtgttttttttttttttcttaaccacattttgaaaatcacttttcatatttgggagagatcccagaggatgctgactccaaaattgagattatattcacagctaggagccatggaagagattcttttcatttttatttttcctttgacatatgtttctgatagagctcatagaagttctatgaaaagcgttcatgtttaggccaattgtcagtgttaagtgttgttctccaaagtgaataaataaatatgaagctttccctgtagctacaatctagatctaccaacatagaaaaagtcatcaaaaattctatcatttcttaacattaaagaacagcattttgatatcccaaagtaataagttttcagtttgtttttgtgttttttcctaattgccataatttctattagttcttgggtaggatggtggctctcttctagtgagtcaaaacactgccaggcacaccaaaggctctcatgcctcaaggcagtccattatcaagaaggagtcaccaagaatgggtgaggccagggatgcataaacaaagtgggctttaaacctggcttctgaaagcagtgtagaaaaaaaccagttagtctcccaggaagtgtggcaatgccccatttcaatgtcaaagtctttgaaatctaggaaagcttcatgtggaggaacagatcggggttaggacaaatagtcacccgacagtagcagtgagtccatcagcagatgagaggccgcaatatggtgtccagtatcctgtttggattggaccatgctccaggcctcactcactaatccacatgcctgacgactacattgccttctcatttgaacatagtccataccagcagactgattattttacataaaaatgttcatttggtttaaatggtgtagaagatggattgagaatttagacacacgggaaggtgactgatcaggtctcaggcacaaggcaaaagattaaaggcatgtctcatagccccatgaaagaacagagatgcagaccagaaaatcaagaaagaagccatttatgcttggtgagctacaagcacttaaggaaaaagcactgcttggtgagcttgtagggacccagatttcaccagtgcacaagcttgaaatattgaacactgaatctacacacaaaaaaatacaaacatcatgtagggatggagttatgcacaaccaggaacatggtgtctgccttccgacaaaggatgttttcatggaaatcttggttttcaaacatttattctccttaactaaagggcaattttgagaccacggttgcctaattagttgttaataaatctctcctgggaaatttccctcatactctttcctttaattgccctttcaaggaaaggaaagaaaaatattaagtccatagagtgtcccagtcaaatcctgctgacaatgaactctgggaggctgtttaaattctttgtctctactagaattttattgaaattaattctaccttcctctccagggacctcagtattctcttcaacaaaataaaaggaaggtcattcgatgagctccaagagccctcgtggttccggcattctaaatttctgtgattctatgaatattacttgagaaaaggcagtcatctgaggtttaaacactctgtgcggtctttgagccgagacaatgtcttcgattccttttgtgaggctcaccatgtcttgtacatttgttcaacactcactacattttgaatgcataactgttgcctgggcactagagaaaatcaattattataatgaactttctaatgagtttgagggatggtagtctttaggcatgtccatgccctattgtaataataggagtgtggttgatgcagtatgatacacatagtgcaatacacctaagtgtttggaattctgggaagaaaatacaccataagaatgtatttccatcgtgataaccgtaggctatgcctaggaattcatttctctgcatgtaaaactgacaaaaaaattgtgatgaagtacatgttatggaattatatacagcagtctggtatattctaaaagaatctttacttttacgtttctcagaacaggcactggccctacttgaatttcctacatagtaagctatgcctatgcctttcactttttattgtagatacctatgttagagtgaattgattttcagaatgtgttaaacatgcattgcatgtgtttggttacatattaaattgtaaattttcagaagtagctgagtttcttaaacatgtttttaaaatgaaaaatttaaaataaaataaataggttttatgatcaagggagtctaggtcaaaaataagtaaaagatgtgtgaaaaaatatatagagacaaatgttcatttttaaaatgcagctgctgtgttaaacataggaatggataagagctagcttctggaaggtgctaagaggaacagcttttgtgactattataaattcaggtttaatcagaacattgcaagcattcttgaagggcatacaaacaaaattcaggcaacacaattcaaaatatgtggttggtagataccttctcaaggtttatgcctctttttaaagcttttaaactttgtgaattcctttttaaactttatgccttcacttaaataataacctaaaatatcaacatgaatttcacatgctgggttatctgtacctgccaaggtttttagtggctgccttcctatttgggtttacaattaagatggcaccaggaacaccgtggttatagtcagaagtttggaaaaaaaaaaaaatggtgtgtgagtagaggtaaaccattcacatccagtgaagaccacctgacattacagtccctgtatgaatgaggtcttggctattgttgagttagaaaatcttcacagaattagaaaaaactactttgaatttcatgtggaaccaaaaaagggcccctatagccaagacagtcctaagcaaaaagaacaaagctgaaagcatcatgctacctgactgcaaactatactacaaggctacaggaaccaaatcagcatggtactggtaccaaaacagagatataaaccaatggaacagaacagaggtctcagaaacatcaccacacgcctacaaccatctgatctttgacaaacctggcaaaaagcaccggggaaaggattccctatttaataaatggtgttgggaaaactggctagccatatgcagaaaactgaaacctgacccctccttacaccttatacaaaaattaactcaagatggattaaagacttaaatgtaagacctaaaaccatacaaaccctggaagaaaacctaggcaataccattcaggacataggcatgggcaaagacttcatgattaaaccaccaaaagcaatggcaatgaaagccaaaattgacaaatgggatcaaattaaactaaagagcttcttcatagcaaaagaaactatcatcagagtgaacaggcaacctacagaatgggagaaattttttgcagtctatccatctgacaaagggctaatatccagaatctacaaagaacttaaacaaatttacatgaagaaaatacacaaccccttcaaaaagtgggcaaaagatatgaacaggcacttctcaagagaagacatttatgcagccaacaaacatgaaaaaaggctcatcatcactggtcattagagaaatgcaaatcaaaatcaccacgagataccatctcacaccagttagaatggcaatcattaaaaagtcaggaaacaacagatgctagagaggatgtggagaaataggaacacttttacactgttggtgggagtgtaaattagttcagccattgtggaagacaatatggtgattcttcaaggatctagaattagaaatgccatttgacccagcaatcctattactggattcaaaggattataaatcattctactataaagacacaagcacacgtatgtttactgtagcactattcacaatagcaaagacttggaaccaacccaaatgcccatcagtgacagactggataaagaaaatgtggcacatatataccatggaatacaatgcagccataaaaaaggatgagttcatgtcctttgcagggacatggatgagactggaaaccatcattctcagcaaactaacacaagaacagaaaaccaaacaccgcatgttctcacacataagtgggagttgaacaatgagaacacatggacacagggaggagaacatcacacactgggcctgtcggagggcagggggctgggggagggatagcattaggacaactaatgtagatgacaggttgatgggtgcagcaaaccaccatggcacatgtatacctatgtaacaaacctgtacattctgcacatgtactccagaacttaaagtataagaaaaaaagaagggggaggcaggagaaaagtattaaatttatattaataaaaaaagaaatagtaaaattatgattatcagaggctgtgaggtgagaggattgaggagatgttggtcaaatggtacaaaatttcagttaggaggaataagttcaagagatccattgtatattgtggcgattagagttaataactatatattgtatacttaaaaattgctgagaattgattgaaagtgttctcaacacaaaacataagtatgtgaagtaatacatatgttaaatagcttgatttagccattctataatgtatatacatgtatcaaaacattgttttacaccataaatatatactgtttttccttgttgattaaaaataaataagttgttgaatacatgaaaaaaaaaagaaggaaaatgttcataatgaaaactgggcgtgaatgacaaacccaaaatgattgtaatatagcaacagtatcaaattcatatggcaattttgttttagcccaacaatctcatttatcatattaaattaatgattataatccaaattgtactattttcacagggctttctgtttaactttaaatgtgtttttgttttatagcataggataagcactataaggtatgatgcttatagcaagttttatgtttgtatatattttaaaaatattggaatacagtattttaagtcaatgctggagttgattaaagtcttacttttccctttaaattccaagtcagttatgagaaacaatgataaaaaatgagcttttatccccagatttatagtccttgaactagatttcatgttcatttatgttgcttcctcaaaaaacccatgtaaattggatgggctaggtcaacaagctagtgatcatccttcatttgctccatggagttagacagatgttggtgcaaaattcttacaccgcctgcccattcctaaatgtgcgaacttaggcaagttacttattttgtctttattttggcacccccatgtgtgaactgagaataagaatacttagcaggattgttttgaaaaatagtaatatataatattataataagatgattaatattaaaaatagccctcatttggataactatttttggcaccaactcccaggcaacttttcacagcgtgaatagttagccctctttgaacaagttactaagtaccagccactttaaatacataatctcatttaatcctaacaaattactagtatcattcctattttgcagatgaaaaacaggccaagacaggttcagttgacaagaaattgcacagatctaaatgcagactggacttactgtgaatcccaaattttccctcaccatgttattttgtccaaaatgaaactaaaatgcttggcatagatctagacttttgtaggcactcagtaaatattatttccactctgaagaaaacgattcatgtttcatttcgcttctcatcagaggtaccacgaacagaatatcacccttttatgataaatcactcaaattgcagacttttgatccctaaagttcaagagtgaaaaggtataaatatgaagaaatttcatgttaggtcacgggatgggaaaagatgcttatgtcaggatttaccatttctagtgaccagcacctagcagattgctggtttattagatttatttattattttcattgtttccttcagatgactcctatttatctgattgtagagtaacctctgagctttattagctagaattttattttccacagtgtagtccaaacaactttttcttggcaaaatataggaccccattagaaccattaggactaaaatgtcagctctcgtgatagaagagaactgaggccactgtcttttcatggctttctctaataccttttctgctgaagtcttggttacaatgctaagaatgacataaccccttagttatgtgaggtgtactagctgattcaataagcctttatgaaagttttattttcagctataaggtcaaggttgtattagcgctacaagctaagcagaatttataaggcaaatttcagtttcctccaaaaaggcagcccttatgtataggaaacagaaatatcatctatttgatactcagcagtgcctcttatgattttcatgagcagcagaatgtcttttattgacaaaagccatacaaaaaaaaccagaattacatcttttttgttccaaaatagaattaaaaatgatagtctatcaaattagccatgatggattttattttattctaacgtcttatgctcatttgtagaccagagcaaccatctcttctaactctgcaaatcttccttggttctgctatgcaacttagggctcatttaggtggtttagcacagggctttctggccctaagccgagactggcaccaaataagcttgcctgacactttatagggtgtgatgaacagtccagagctcccaggcaactttccacagcatgatttggaatctacttgcaattacatatggctagtggagctgcatctggagaagcctaatcagaatttgtcttccatttagtagaaataaaacgagcccactcattgtgtcagaattcatctttacactacagaatgagcaataacctaaaatcaatgccaatctcctggatatggtgtatatacttgagaaagtgttctgcagaatgttttctacattactttcatcactgtgttttctatttcagggcccactcttcctaagacccatgtgaaaacagcctcccttgggttggctggaaaagcaagatcccctttgcttcctgtgtctgtgccaacagcccctgaagtgtctgaggagagccacaaaccaacagaggattcagccaatgtaagggcatctttaaaattcatgcttcatcaagggacagattgactggcgctgtgtaatagcatctaaaccaatgagtactgtccattcaccccaggccaccccaggccattgttgttcttattgttgtttgttcctttgttttcctgcacttaaatatgaagaggaaataaaagctatgaaaaaaaattatgtcagagacttagttatgtaaaaaagttgattcttaaggacagtcttagaaatatgaccagatagctacagaacgtgtggttttacacccatatatgtacataatatatacatatacacatgatatacacatggatacgtgtgtgtgtgtgtgtgtgtgtgtgtgtgtgtgtgtgtgtgtgtgtttcttttcaataggaagaaataccttggcattcttggaaataaataagactatataactcttcttcttccttttttttttttattttaagagacagggtcttgctgtgttgcccaggctagagggtagtggctattcacaggcacaatcatagtgcactacagccctgaacttcttagctcaagcagttctcctgcctcaatttcccaagtagctaagactataggtgcacattactacaccaacttatacagttattctctaaaattaaaaaaatatagtgacaaaaagctatattatgagggctttttgaagttattatatatgttacttctgaaatcataaaataccagaaatatagatttgtgaaggaaaaaatataaaataaaaaaattgaaggagtttaagtaatacaaaaaggaaatgacgtaattaaaaaataagaagggaaagtttatttaaagacagaaaaagttttactaaggaaataagctaaaaagggttccagttagaaaactcagaaggaacatcaatagagaaggggaaaaaatcagaattttaagaaaaaaaaaacatttatcccgaaaatgcactgtaaaggagattcaaaaagacattgcctaaaggcagctatttatagtacactttagttgtttctgaatataattcaagagaaaacatttaaaagaagcctaaggaattaacatatcagatatcttgaaaaatcagggcactagaagagaaaaaagatgaaaagagcagattaaaattctattttgttattacatttggatcttttttaagcataaattatgaaatgaaaataatctgccacccttccaactagcttgttttcttcatgcataaatgaagtcttctgcaaaatttgcaaataatgtattgaaaaataaatttataacaatatcaaggaataagtaggtaacatttaatcagtcctctgtaagcaatgcaactaccaggtcttttataaaaattatactttcttttgatatctggttgttgttaaaaacaaagaatcatttcatttgaatgaagaacaatacatttttcttgacttaattttttttcaatactacaaacaataaaatattttaacgacatagagatcagggaagctgagtatgtgagtgtgtctgtaaatgttttggcagatgagtgttatctacttaacatgcttttcaaagattcaaatttataagactctaatgcacttttgtgcgttagaatatagctgtttatgtcaatatctgtttaggatcaaggtttgtggccacatctcaaataaaatcaaacttctaagtttacatgaagtatctcatctcataaagaatcatgtcaggtaggcctatttttacattaaaggttgactctaaagaatggcagccaaattaaaatattaaactttattaatattaaaagcagtaagaaacacatattaaaggaaataaagaggacaaatagtgtagaccaacatttgcctatgaaaacataatgtgtaattttaaattgactagaagctacattaaaagatgtaaaaataaataggtgaagttaataccttttatctaacccaatatttccaaaatattatcatctcaacatgcaataaatatttaaaattgtcaataatgtattttactttttttgtactgttccaaaactggtacgtattttttcatgtaaaacacatttcaggtgagactaggcacattttaagaatataatagttacatgtggctagtggttgccgtattatacaatgaaatctagacagtttgagaacgacaaccagacaatgaaaacaacattttggaaatgagttgcctagtaatcccctcacttcaacttctctctctctctctctctctctctctctctctctcacacacacacacacacacacacacacacacacacacacacacacattgtatgtatataaacaggcttttagccaaattggaaacttttcagtcctctattaagccctgaagattgggtagtgtatgcccgaatcattcactgacatgctgagatttctataggaagctcatacattaataccatacattttgagctgttttttcaatggctggagtagctttgtgcctacctcccacccatgcaaattctatcaatgctctcttgagatcaagggtacttatttggcaagattagatatacatctctgatcatagtgctaaggaatgtgtcttggcctatgcagagctagaaatcatggctcaggcctcattggttcaatcatttaatcaatggaatgcgctagccaagaataataagtagaacatctgtataagtcaactaatatgttcaagaaaggaaaaaaagaaaactaacatctactgaacacttaccactaggcagccctgacttgttgaatcctcctaactcctcaaaagacaaacttgttattctcatttcacaaataagaagactaactcaaataaaatgtgcaagtatataaaaggactgggattcaaatcagtttcacatcttatttccccatctggctaactatcaaaactacctgggaatttttcttttaattaggatgtctaggttcttcccataccttctgaaacagaattcctaagcctagcgacctggtatttgtggtaactagtaattctattacttactgacatgataatagtgacttatagtgagtgagtttacagagtgaattagtgacagttcactaggcattctggagttcaacctcttcttttatccaccattcaaattgtcccaaaaaggattgactgtggtttggggcatgaattttgtttccacacacaaactaaagtcataatctccagacgtttcattggccaaggcaaagcccgctgagttctcacatacaaaaaaaaatgtatctatgtcatgatacagagaaaaaatattctgttcatatcttggttaacctagtaagaggaacaggagctaatgtattgaatatctaccatatgccagaccctatcatgggtactaaacatgttacaggaggctcagaatagcctatgaaatagatgtcattatcattttatagatgaagaaaattacgtatcagagaggtgcactcacttgtctaagaccacacagctaataattgggagaacttgatttgaaacccaatctttttgactctgaaacatcttccttgtcacaggtggagatggagtgggtgaaacaatatgcaatctcttattatccccttttattaccagcatcttcattcagtgagtatattccaaggacagccctggctgtggtctcctaggtcagacttgggaatacgtagcaccccaactagctgtggccccggccttcataaaagaaatggatcaatatttgttactaactcttggctctcattctctttataggtgtatgaacaggatgatctgagtgaacaaatggcaagtttggaaggactcatgaagcagcttaatgccatcacaggctcagccttttaacatgtatttctgaatggatgaggtgaattttccgggaactttgcagcataccaattacccataaacagcacacctgtgtccaagaactctaaccagtgtacaggtcacccatcaggaccactcagttaaggaagatcctgaagcagttcagaaggaataagcattccttctttcacaggcatcaggaattgtcaaatgatgattatgagttccctaaacaaaagcaaagatgcattttcactgcaatgtcaaagtttaagctgctagaatagtcatgggcctttgtcactgcagtgaccacactgtcataactaatacctatgttttcctttgtcaaggcctgttgtttaatgtgtaggtctagtcttacaaaatgcaagtgcattatttaagcctgtaccatgccatggcaaaccagtgcaagctcactattttgttttcaacttaaacatacaaagcacccatgggaatctctcatgccatagcaccaaaggattggatgttttccttacagcacaaaaagtaaatagtaaacaaacaaaaggcagagaatgcttatgtttgtaactcagtcattcatcttgcacaagtggtggatattagtgagtggctaaaaattcacctattttggcaagtatttgtaaatccacccttggttaatatgtatgtctggagtccaggaatataaaaatctgcaactagtggcattctgccagcagcagtacatttctggaaagaggatataatatgcaatcttctcagacacatggtaattatatgcttaagcttgtaataggacagttttcaatttgggtggcttttgtgccataccacactgtgatacaatttcaaagcttcactaaggccatcttccttaggagtttggccagaagaatgcccccaccccttcaccccatccctccctgagttctccttggcaactagcgttgggtgaaatggccagctccacatgtcatatggtgcactggccaatgtcgcctgtcttctaatcccgtagaaatggcagactccctgagagcaggaagagaaggaaaataaaaggtagcttctaacagtaccttctcttaaagaatgccaactctgcctacagggtcagtgttggcaagcattggccaccagacccttttgttaagggaaacttttacactacacctgtgtcagagtcagggggaagcagaggggcaggtgccacctgacacttccgacatgtaaatccagcagatacttttcaaagcagcatcttaaactgtggactacagttttaaacttctattgccatgtttatctacagcttggaactagctaaaattaagaacattttgtatgcagcattttagtttctgaattttcagctgcatttggagttaatccctgtttatgcagctgaatcgccaaaagggagctagtttgcatatttatcagttaggtgacttgaaaacccaatgagagagtttcagctgaattattcctttcagctctgcctttgatttcaagcttgagtaggtcataattttaaaagagcatggaagggataggatctttacaacctaatagctccttttattaggtgggtaattatatatgaatccctgaataaaatattttgagcaaaatggcactgtaacagaagtaataattcagtttatttttttacagttttatgtcgggaaggaaatctgatgtcaaagagagggctgttcaaatggttcattagaaagtccggtccatttgcgaatttgttccttcaacaagagtgctcattcaagttactcagattttctggaagtcttttctgaagagctatgtgatgttgttctatgggacagactactcttatttaacatctgggcacttaggtagacaaccttctactgacctggaataaagtgtttcctaacataatattgaattattcagaaataatccattacttcaaaaaagaaaatattcattgggctagcccaaccttctctaggccctaagaattattacctcccctttctaattctagcaaacatggaacattctccttaggcacttgacacccacgagggtaatcctgagtgctcagtttggaataggttgcaaatctcagattttagggattgagtcacaccttcaatctatagaatgaagttgaccaattaaaaaaaaaaaaaaaacctatcattttcacaaatttctagatccttctagtcaaaaataattatttaggaaataaaatttttaaaaatccatttaaatacatgttatttgtcttcagtggaagttatatttctgctgcatgcttttgaaactttcttcattaaatagaatggtttgtcttagtaactggcaatgccagtattagcaccatgcatttaatctataatacaatcaatttaaacatcctcaaaaaactctagtatcatttacctggtagtattaatatacaatgatgtcaccacaacttttgtataactctgttccctttaccctcaaatgattcatatatgtatataattgcctgcccaagttttcaggtaacttattaatttcccagtctcctgatctcttgacaagaagaaacctgtgaatactgcaaactagcctctgacttcctcctactgagtctagttcatggtatccaggactctttatgctcataactctctctgattcccattgggtgatacctgacagccaaccagccgctctgccaccagaactcatttctccctgaaaaagaagaaaatcatatttggcagagcattctctggtctgccctgtaatgtgcttaaatgtcaggcaacatcctcttttttttaaaaaaaatggtatttttctttaaatttcaccctaataagaaagctattttctctcctctgcagaaatttctgcatttgtgaaacttataaaaatttagatagttcaaatgtataaagaatatttggatgatgctctagccaaaagttaaatatttcgtagtgaatcatagccaataagaaaccagtcatacttgcctctttgaataacagagatataagcttctagaatatttaaataatgaagttttacatttgggtattataaaatgcatactcaattgaatgagctgaaaaaaataccaagccagtgatataagtggagatttattaaggattcctgttgagtatattcttagtttcctcaaaatagggattattcaaaattaggtgtatgttcaatctcctgctttggttccagctacacaaggagagccatcctgtgctagtgtgatgtttcagacaacattctgaaactaaaatgtttggcacttattggcttttccaataaagaatctcttaagtacaggtatttctggaagctgttggtgtctgtgcttgaagatgattgctgatacttatccaccctttgggtacttctgttgactttgtttaaataatcatcttatggttgtccccaaatgtaatatggtatctcagatatagcagctggactgtaattacaacaaaaggttacctctaaagataacatcttaccattttagataaaattgtgtcccagaattcttatggtttcggaatgtacatttctagtcaatgaaagaaagaaaaatggaaaaattgtctagtttcaggcatgtttaaagaaaacaaagtcatctgaactttaaaatagatgcagagcagggttactttccctttcactcagttcccttcatgcaaccacaggcagtcctgcaggccagaggttactatcctaacctgctcataaccatatactatacagagcccacaactttctggagatgcagaagcagccatacactcaagtctctgtttttgtaaatcacattcaaagcaacattttactcataatttgcatttctctggtgactttcagaaatcactttagtattgtacagaaaagctttttatttgagtctagtgtttaaaattaaattggatacttgggaaaatcatagataggtgttttgtatgatattccattccaatgcaaaatatatgtacccatgcctcaatgtatcttgctatctaaatacctgttgccaaaaagtattgatttgggaaaaaaaatgccaatttcctggtcagtgaggttatgtaaaagacaaaataccacacccatatcagcaaatgaatattactactcatctggactcttcgttgccactattgcataacgttcacgtggcagacttccagttgcactctctgaaggacttttttctcttactctcaatagagagcctttgtacattgtcatcctatgattgttgttggtagaagagcaagagcaaaactctgcaagatttaataaacacaggggcatgggccaagggatctcactgtgtgctgaacatgtattttcagatgcaagaaaggaatgatggagaggaggagaaatgctgttttttattattgtagggtaaatctgacaattctgaactttgtgaattgtcagcttgtttgggggaagggtgggcgggtatggggtgtactttttataagtaatatttaatttattatttagagtggcttctttttggataatttatgataaaaagggagatctggttgggatctagatacggctgttaaagctgcagtgttccatacctcagagggaccactttggaaatgaattgtccattgctgagtatgaagagatgtccagtccaggcaaagccttcactgaagttccatcatcgccacttctccctttttagggtcattcaaagaagataacaccaaacctaaataattctgaaagcattttgcagatcagtgctactcattcaaagggctttgcaactcaaacagattgttagtgtgctagtgataagtttatttggtagaaatgggtatactacagctttaactagccttagtgagaaaagaaattttttgttgttacaaaacaccttttttaacaaaaaggtattttgagcctacaaaaagtttctttaaactgtcagattctagcattgttaaccaaattagactagtgattgcaatatttaagtgtaaatcttgttctacaagaaaggaaacttgcttacagtttaaaacaatgactgtttctacacatgatcttgtatactactacacaaggaaaagggggttttgtaaacactgtagaacagtctcatattcatttttttatagaaatgttattccaatggtgcattttttgtttaataaataaagttttgatacaaagttcttttttcatgttatttatagtaaatgctgtgccacacacacaaccacaaccttgcttgtctgtatccttaagattcattctcttagtccattggtgttgctgtaaaggaatacctgagctgagtaacttaataaagagaagaggtttaattagctcatggttctgcgagctgtacaataagtgtggtgccagcatctgttcctggtgaggcctcaggcggctttcacttatggtggaaaggaaagggaaatccacatgtgcagagatcgcataacaagagaggaagcaagagagagaagcagggccgggcgcggtggctcatgcctgtaatcccagcactttgggaggccgaggcgggcggatcacgaggtcaggagatcgagaccatcccggctaaaaacggtgaaaccccgtatctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagagagagaagcaggaggtgccagactcttttaagcaaccagttcccttgggaactaatagaataagaactcactcattaccatgtggactgcaccatgccattcatgaggaatctacctccatgacccaaacctctcccattaggccccaccttcaacactggggatcaaatttcaccatgagatctggagaggtcagatatcaaaaccatagcataaatattaccttttattaaaagctgtggtaggagctatcagttctctgcctcatactcaagtaagttattatttttaaaggaagtggacccttatgccattttcatgcacatttccagtgtgctttcactccagtcaataaccatgtctctttattcccaagactgctagaacttgtctttgcctacatgcgtgggagagctggaaatgtctgattagacctttcaaatagcaccccctttgccccgatgaaaacaattttgagttgtaacccaatttatctccagagtacccctgtagagctgagccacagtgactgtggggctactgcttcacaatagtgcactgtaatagtgtacccttgcttggattgcctcccttccctttttatcttgcccccttcccctaatggtttctcctgggagcacttcacagtaaatcactttcatgcaaatctttatggcaaggtctgtttctagggaattcactcaaggcaagatccttctagctgtgatccaatttcaacacacaaacaacaaatgaataaaatactcttttcatcatccagatatttcattctcatagtgtcagcagcagaatatggggtcacataggtgttgaacattatatagctacaattattgaaagattaagtttggcatgtgtattagggccctctagagagacagaaccaatagtgtgtgtgtatacacacacacatatatactattggtgtatatatattttggtttgcacgatatatatatatatatatatatacacacacacacacacacacacacatatatatacatatatatatatatatatctgagacctaatgttaaatattaacctacacgatcacaaggtctcacaataggctgtctgcaagcttgaggagtaaggagagccagtccgagcctcaaaactgaagaacctggagtccaatgttcgaggacaggaagtgtccagcactggagaaagatataggctgggagcctaggccagtctctccttttcacgttggtttttcttcctgctttatattcactggaagctgattagattgtgcccaccagattaagggtggatctgcctttctcagcccactgactcagatgttaatctcttttggcaacatccatacatacacacccaggattaatactttgtatccatcaatccaatcaagttgacactcagtattaaccatcacagcatgtaatctattctttaagagaaagtcacatattgataaaagttttattaactcttttgggaaagcagaaaacttctcagtaagttattattttaaagcaatgcattgcagatgacaagacaggtggaaactttaaagttcatctagcctttcccattttcttcaattcattatcatcccatatagaagggaaaaatgtatttaaagatcttaaaagatgtggatagattccaacccctgttcagtttcggtggaaatgtaaacttatggtagtcactgtggaaaacagtatgacagttccttaaaaaattaaacagattaccatagaagccaataattccacttttgctcatatacccaaaagaattgaaagcagagactcaaacagatattcaaccacctatgttcataagagcattatttgcaatagccaaaagatggaagcaacccaattgtccacagacaaattggtggataaacaaaatgtggcataatcatacaatggaatattctttagccttataaggaaatactatcaaatgcaagagcatggataaaccttggagacattatgcttagtaaaataagacagtcacaaaaagacaaatactgtatgattccacttacatgaggaatctagaaaagtcaaattcacagaggtggaaaagagaatggtggtaatcagggaccaggggttgggagcaagagtaatcattcaatgcatacatcatttcagttttggaagatgagtgaagttctagagatggatggtgggaatcataacataaaaatatgaatgtacatcatttgtacacttaaaaatggttaaaattgtaaattttacattatgtatattttaccacaatttttaaaaatctccatataagaatattccagcaccgtctctataaatactgatatttcctctaaggcttctgaactataaatatgcaacagcaaacacattaaagtagattgatatgcaagaaacagaagcagaacgtatacctcagtctactttatgtcagatatatattacactatcatattcaatttatgtaatcaacctacaaaggaatgttgtgctgcacaaaaggctatcagagatcattatctgcatgggaaactggttatttgaaaaaaaaaaaaatttggataaatttccatagtctggcctagggagaagaaggttaagggagaaacttaactactctcttcactgcaaatattttatgggaaggattttagagaggttgaagaataagattctctcttacctcaaatactctatgatgttataatgaatatagataggaagatgtattaatatgcatgtaggtgaacttaatagttttctatgaaataatctcctggctttgtaaaataattgttctctaaacctactataactcattaccttagcctattatgtttatttcagtttgaaatattttaatctattcatttactttcaaatgaaggacggtctcttcagatcaatgagtgccaagcccctgtgcaactggattgccctcagcccattataccaccgctatgttctgtgacttctgattcacagccagatagccagttacacagagaccccagaaagtttccagtatctcactggctttcatccagtataactctgctgaacccatagaaggtccttcctttcctctccctggtattctgattcgcaaatgaattattttagaagaagcaaatctcaagaattcagaaatgccagatcgcttcctttatctttgcctgcctacaaggttgtgaagatgagaaatgtactcaagatgattagttcccttcttacttcttctgcttagttctgttctgacagtttatagtaaccaaataaatggagagacagagtagaggaagaaataaataattactgaatgcctgatgtttttgaggcagccagactccctgcctagattttggggttcatataaactttgtgaactaaaaaaccattttgcataagatcactggaaatatggcaaggatggttcatccatcatgcttttctcaaagtttcattggcctgatagtgaaacaaatcaataaaacatttctgagttgtgtgggagggcttgcttttcaggcctgtatattaatttcttcttctttcttctttttcttttcttcttcctcttcttcctcttcttcctcttcctcctcctcctcctcttcctcctcctcctcctcctcctcctccttttctaatacatttttttctgagtccactgatattttaataagaaattgggatatgctgtgttaggggcaactttacaggcatcaacataattattgaatcctggacttttttaaaaaaaaaaagacttaagttttattctactttctatttacggaagtctaaattatatcttaccttttatttctctaactctaagcttaatctatttcttatttaccaatttcttattttcatgttgttatatcatttttccttttttgtaactaattgctctcatcctccttaacttctgaaattcataatttgatgcaataaatagttaggcaattattcctgagataattggaatgttctcattagcagttcaaaagattgcttgaaataaataacagaagtaatttttcccagagtcctttcagatttaattaacattcttctttataaattaataacagtcctttaacttccccgtctttgctaatatctattctgactcttcatataagtttgacaaaatatctgttagtagaacaacttttcaccatcttaacgtttcttaagaattttatttttgtgctattctttgaacctgtggtggatttcctgagctactttttttctttttattcaagctaaaactgttctttgatgtggaactctcctaacaatggtagcatttcaattttgtagatgtgactcatttgtcatgaattattcctatttcttccctaaa

SEQ ID NO: 1242 - DNA, 62265 bp, Homo sapiens
ctcctatcctttaaaagtcacattctgatttctgtagacatattgatcaaactcagcagcagtagcatgcatttccccaggctgtggaagcttgctgtgtgactgacttctctgggccttgtttgtgcagttgtgtccgtgatggcagcagatactcttgggaaacgttggggaaaaaaggaatagcaaaaacaatagaaggtttccttaggctggggtcttgatgcagctcttaatccttacatttttggtagcttcttaaattaatattgaaaacaacagtaatgtattaaacccaggtactgtgctaaatgcttctatatgcatttttggttgaggttgtcagaatctttactgaacaagtggagaaaaagtctcagattaaccaattttcctagggtcacatagctagtaagtgcatagtcaggacttgtaccctgatggtgtgtctgactccagagcaactctcctgccctcaaagctctagttctccatacacaaaagtctagtgtttgcatgtttaagttcatacatcaggtggagacagattctgtgtttgtctttgctcatttctacctgctttgcctcagagagctcctcaacgctgacccagttccatgaatattcattacaaggtggcagggaactaacaagtattgaaggctcctaaattccaagcaccacaccaggttttttacaacaaacattgttaaataagttaatgttttgtaacttttttaaacagcctctggcacctagcaggtgctacaaaagtatggaatgaacaaagactaagactctttaacagcaacttataagggatctaatgacagattgctattattgatatcctggttctgtcacttaacagttgtgtgacttcagcaagtcatataatgtctatgagcttttttattttttaaatgaggataacacttgtacctacatcagtgagcagttttgaggattaaatgagacaagtgcttagaacaactcttggcatgtagtaagtgctcagtgtatgtttgctattgtcgatagtcttcaccaaatccctgtgagatagtaatttaaatatttcatagttttatagatatgcctcatatctcttaattggtaaaggtaggatttgaatctagacctctgagactcatcagtgctttttccattaaaccatcttcagcaggcagctttccataaaccttcctgcccttgccccatggcacacacacatacttggaaaaatatctcctctaactaggcatttataaccattcattcaaccttatggataaaaacatacctttgtttcttatttattgcagcactcatggttcactctctggtctaggactgatgggaataaaagaggaagaagaaagcgctggcccaggcctgtgttcgtgagtcggcctgccatgtttccatgtgccatttcttaccccttgtaggcaatggcaaagaatgtggtcaggctgtagcctccccaaccagcagacagctttatggaaacttggtatagcagctaaaagagtttagtttgtttatatggcatgtataagttttcaataaatgcctaaagttcaagcatagtatggggatgtccacagattgtttctttgtgtcattgagtttatgtgcataggtgcggtacaaggtgctcattccatgtagcacccctattacgtggtatatactgctaaggaaaccaagaggagtgattactcagaaaaccagccgattatgcaatttgtcaaagttgtaatgtctgtgaagcaaatttctttaaactgttttcttattgacaactcttaaaaaattgaaggacaatgatagctgaactgagaaatctggcaagtccaccaggcagtggagtggaagattcttttagtttttttaaccagccctggaaaccccttccattccacgtttaggaatcctccttcccttcagaacatgactgcagtgccacccttcaccagtaggtgcctccatcacaccatctctccctctaggaactggaaacttgaaattcagtaaaagccgttttaatcaactctcaaactgataacaatctgtgttggaaaggacatggggcataggcacccaattccaaaactactagaaatattaactgccctccagaaaagatgaatctggcatacagtatgtatcatacccaaaaacctcgtaaattgctctgtacactgagaccctgcaattctacagcattatcctaggatactaggatagctacacaaaaacatgtaatgaaggagctatcagagggttattacaatggagttctaggtagccagttctaatgtgtgtgtgagagagagtaaataaaatcttcggtgaaagagatcttcaagaagaggcagtagacctctggatccagaatgcttgactttgaatcccagctttttaaattattgtgtgaacttgaataaattgcttaacatttctgtgcttgggataataatggtatgtatccgagaggattacagattagtgagattatacattcacagtactgtatattatttgttgtatgaagtctggagggatacagaatagcatgtagtttgagtacacttttgtaggagaaaatatacaaagctatacataggcttctaacaaaacctgcaaggctatatgccaaaacgttaatagtatttatctatggctagtgccattgacaaatcaggttttaacaaatgcttttctgttgtagactcgattttttttaacattcaacatatattgcttttataattggaaaataattcttaccacctgctgtcaggagaagaaaagaagagaaagataattctacttaaaattaactcttagggttgggcagttggagcagtgtttaatcttataaatgtagcttcataagatctggtcctatatgaaagtttaaatgtagcttctgtaagatctggccctatgtggaaccagaactgaagagcttgacttgggatcagacaccgcaacttgattcaagtcccttcatcaggaggaaagttccctaggtgaattgccaacttccgctgcaaggccctgagaacaacttgaaactgacagtgttgttgggttccttcctgcccagctgagctccaaagctgtgagagcttagctgctgtttacctcttgaggctcaagtcctgagagataaattaagtgtctgcctcggatatgaagaggcctgggttggagcttcacctcccacacacacctgagtattttggggcaagtcacttaacctcatttgaggctatttccacagctgtataaaataaggaaataactattttgattattgagacatttgtggaaaataacacagtaatgcactatgtgtgaattaatttccctctctgggcctgtttcctcacctttaaaataggggaaattagtacttcataaggttatgaggattaaactaggaaaagtcaagattgagtgctgaataaatgacatactattttactagggatcatctccctgtaccaagagcactccacttgctctcaagaatagccaaggccatctttttcttaggaaaaagggtaggggtggaggtttccccagggatccaactccagaactctgcagagatgggcctgcactacaaggcctctgagacttcagtctgcacactctgttctttagcctgatgctccaccttttggaagccaaagctgccaacttggcctcttgcaaaacacacattccattcataagtgcgtttgtgcatttttcctcccacacccttctaggcagccagcgcagagctgccaaggcagctgctggagaagcagcttcttatgggggaaaagcaactccaagggcttttacagaactcatggtttaggctttgaacacattactcccattttctggtctccttgaccatagggggggttgttcatttctttttgcccccctttttgtaaataacctcttccctattaaaaggaaacctattaatgaaaatttgaaaaatacagaaaaatttaaatcacaactgatcccaccatcaacagtcaatgactgccaatattttataatcgatcaactttttccatgatgatagaaattctattattcaaaagcagagttttaatagctgtgtaatattctagcattgatgtatgccataatttctaaaacagtcccttttgttgaccttggaagttgttcccaaatgatgctgccagtgatatccttgcacatacatccttgggagatatttcttttaggaaaagtgcctaagtgaaattattgggttaaagagtacgaacacatgcttttaactccagaaaggattttactgtttactagcatagatttctttcaaatttttgccatttaaaatttttcattgtatatttaatgtctgcttatttgaataccctttagattggcatcctgctttttttcccagaagctttttggtaaattatttttcctaagtgagttgttcatatcctttgccatttttctattgggaagccagatccttttccatactgaatttttaagagcgccttatggattcactatatatagtgtccatttacaaactattacaaaattttagtttgctttttaaggtatatcattttatgtttagtcttttgtgatttcctctatttgcttttatgcttagaaagccctgactgatctctggatccaatgacaagtttatatatttctaatgatttaatgtctatacttcatagccttatttttcttggaatttatcttggcatgtaataactttctcccaaatatttagataattttacccaattatctagctttacttacccaataaaggaggatgctcctttatcatttaagtccatgtgtatactagggccagtattcatgttttcttctgtcttgtcatgtagtagtaccacactattgtgtagctctatgatgtactagcagttttagcagcatcaccccagataaacacagggcccatggagagtctccatcagcatggattacagaacactgtagagttaagatgcttcgctgctgactgcactggtgctgctacattccaccaggactttttcagcacccctgagtcaagagacgggacaagggtcagaacactgaacagaagaatgttaaactcaggtaggagccttatgtttttaagacagggcatcctcacaagtcaacgtaaaggaaaggaaatggagaggttaggcaagctccctaatcttatcaggcagactaaccctttttgacctacgtcaaaactcagagctagaaggatgacttccagagccaatccagccatgtgcttcagcaactgatttgaaaggagggaagaagccagtgttgcaactcttccgtactcctcagatcctcagcactaccttcagtgcacctttcttgctagaaagcattccacgtgcagttaagctcatctggtaactaagtgaagttgtttgtccatcatctaattgaaaattagattttagctgtatataatctatacagcctgtgacagcactttgaatagcccaggctctatacaagcccccaaatcagtatccttccactttattccccaaacctatttgtaaggctctggctgggctccataactcagaagtgccaaagcacagaagaaacaagcccaaaagagccaactggggaatgttttagaggcatactttttaagtgaggaaaacatcatcccttaagatttccttcctgcccccacctggtcctgtccttagtaatgaggaagagaaaaagagttgcagttcattgaggaaatctcagaaacctctccctaatcagagaatgtagacatgacttccagagcctttgcaacagaaaagaaaaagtacacctactcccaccaccatacttacttatttttacaagataccaacatgaggctgggaatctttggggaggccatcagggtctccatgaaagaaatgtgtaagatggccagtcaagagctttcctgaatgtaaacaataactagacagaaaatacaatggaaggaagctaagggtcgtaagtggtctaatcatcatacatctagagtgttaagaggcagatgggaatcccagggatcacgttagtctgagcttcttcccccatccccaatttggcacagagggaaattaagcccctaagaggggctgtgacttgtgaaaggtcatgtatgaccatgccaaccccctctcttattctctggtttccctgcattactcacctagcattcctttggagaaccttaaaagagcttgtaatgtttgagcacttatgtgtcattgggactttatcaagacttttaaatcctagcactctgatggaaccaagagtcttttaattttgcagatgagtaaaaggaaacttagaggttcactaacttgccgaaggtcacatagcagtggcatttgacagttaaagccagatacagcttgtttcctttgccttaatgcactgccatactgttaaatctaggggtcatgcatttaacatactgctcaacttcactttttattcctcatgagaattcacatcagttgcaaaggtaagactatttaggcagtggccctgtgaagacttatttgctctttgcctctaagcactgagacccccaaaagccaccctactaagcttggtatgtgggaggtcaacacccatgtttggagtctgaggatcctgtacttatctggattgtttttcaaagaataaaaattgttactcaatatcatgttggtagaagctcccagtgggtaaattttgccccagaataaagtcactgtttttttttttttgtagaaatatcaatattcaagtaaacaaatttattaaatccaacagcaggtaaccttccaaataaaaaacattaaaggaaaaaatgtagacatcaaagacaaaaatgtgtgtaacaagtcaataaaaatactcaaggggccatttggagagtgcaacagtgcagaaaatacaaacaaaagtattaacttttgtcaagtttgtacaacctcaacaaacagacacactggtcacaaaccaagagggatccacaaaggtggagggtcacatgagcagtggactcatcacctcagcggcttaaggcagggtatatctgtgggaccaattcatccaagccccatgtgcctattgcttcacattccccctttaaaacctagtcatattcattagtgcaacaggtaagagcaattaagcacagacggagctggggaccagggtcagagggaagacacttctcccagagcaaatgtatgcatgtcagggggatgaaaaaccccagcagctgctgaatggcttcctttggcaatatccaagatttgtgttgaaaggagcagggaggttggatgggtggcggaagtaggtatttatgagataggctgggtttccaagaagagaagaatagggaggacatgatgcccagcacctgaatcagaagcagaacccaatggttatgcaaagctatttgaactattttggcttctgcaaccagtgctcaagaatctatttcatctttcgaaaagggggaaaacccctgccgatcctcaccaacatgcagtcccagtccagtttaaactggatatgcaattacagcttaccaggggaataaactctgagggggatggatggttcggaaccttctttatatgatcagaaaacacactgtggaataagaggaggatcaatgtcgcatttcctcaatgagtcccaattaacacaattcaacaaccttaatagtcctttcagtcgtttaaacaagatactgctggagtcctccaagaagacctgtcatttaccaagatgttcaagtcccccaaggaagacctttgtcagttaccaagatgctcaagtcatagctaaccaaacatgagagacaagaaaaacagcagagcagtcaagtaaaatgcaacaaaaacctagcagcagctttcttctacgccttaaccttataattgcataactgagtctacaccttttgggctttgctgcactgaagacctcatttggaatctggcaaaccaaacattcttaaatacataggttggtgtaaaagtaattgtggtttttgccatacttaatggcaatacattaagtatggcaaaaacttacttttgcaccaacctaacagatctgttttggtttgtaaacttttagacaagttcttatcccagtaactccccaccactgtttaatacaatttggcacagtatatagtacatgaggccatcgagtgtaactactatgggactccattttggcaccagcccctagagaccagtactgcttcaaagactaatactgtgtggcttaatcctttctccctttccaaaaagactagtttgtgctttccttggggaagtttaatattgaaaacactgccttgtacattttcaattgttattttcctgggcccaggggtttggttaaaatttagatcttcacccagctctagattcatcttcccttatcagaagggcagacatggtttcctggacccaactcacacaggtgggcagcacttcagctgctgagacaaccagctgaagcatagcaaagccccttacaggaggtggggttaagaacgatacattgagatttggcaaagatgggggaaagagcaattcaatgaagcagcacgtcatctcataccatctttccaataaactgctaaagaaacatcacaaaagctgacaaagccagttgtcaaaactgagttatttcttatttcccaacacacttgtttgttgttgccctcagatgttgccgatttccaaagtggcgtccacatcctgcccctctccacatcaccctgatgttctgttgctaagcaaggagtgtactggcttatctgaggggcatgcattcagcctcttacacagacttactgctcactcattaagtggcaaacctatttctaggttgaaaggaacaagacttttcacttcccagaagtataacttcaaaccctacacacacctcaccttggatccctttgcagaaaaactgcatttcttgtggtcatgaaagagtcaagcattggcccagagctactgcagaagcttgaaatctttgctgagcatcaagtactcaaacttgaaaggaacttgtaagtccctccctgactgctcccttttctggcttctcatttgcaaatggatcaatataaccaaaaaataactaaatggcttttttggtgggggatgaggaggctaaatagttaatttaaaaaacaacaaaatacatccactctagtacatctaatgcacggaatgtcttcttaaagggtggggaaggaacctagtttctccagagtactcagggtcctgggctgcctgcctcttttgtgcagctttctctgatacactctgatctgggatggaaagggccttatctggccaagagcagcctggcttttccctcagtcaaccactacccaatccagaaccggggaaaatgagttgcaaactggcttaatgaaaaagcagtctttttaaaacctcagtctgggtacccagctacaactgatcccacagaacctgctgggacccctggagacttattcaagagtcttatttagctagaacagaagccaggcatctggcccaagacccccttcagctttctagcagtactataccgtgggtgatcttaaagtttcccatttgcccctctgaaggaggaactgtcaggtttaggatttaaaaaaaaaaacaaattccaagtatgttccctatggtcaatatcagttttagaaaaataccaactgccaaaactctttaataatccttaagatgggagcccagagctgtaaggctgctcacaatggaactcaaaacatgcaattcctgcccaggctgagaaacatacctgggacgcagcggggtattaggttaagggagaaacctccaaatgtttaacagacaaagtctcattacctcaagagtataaatatttttatacgtttttatttaaaagattccctttttaatctgttccaaagtgttggaagctgaactatacaagttcctgccacccatccttccagtacagttttctgaggacatactttttaaatggaaaaataacaggaggaccctctaactgaaaccaggtaggcccagagtgagctcctcaggcccctgtggcagcctggccaaagctggcctttatggagccagcgcgtggagaagtctggggaaccggggccctccctcttgtgaggaaagggctgagcaaactcatgttctctttagtgaaatggtccaaattcagatccaaaagcctccattatggcattccctggcactcttcttatactttatacattgaaggcagctccctcttttatggccagtataagcaggcaaagaaacaaaggaatatagatacatatatgtgtatatatatatattttatataggtaaaatatatacatattttatatatgtatatatacatatttgggggtagggaaaggagaggagggtcatgtaaacctaaacagtcatcacattaccccaaatgagcctgactttaacaaaaagataataaataactcctgggggttaagtgacaacatgggtgcagcaagaagggaaagggcacaaatttaactattaaatacactttgatatttgtttggcagagttcaggccaaccccaggcttctgcccttgccagacaagtaagctgatgatattcaaagaaaaaaataaaaatattaaaaaaaaaaaaattcaagcagagctccataccacagttttccttcaagtcagttggccggcaggcagtttcccgaccaccaggaacagaaactttggctccaaggcaaatgaaacaaacaaacaaaaaaaagtatttccacttacaacatgaaaatacagaaacttcatcaaagaaagaaaactatcaaagaagtctacttccagcaaaactgaggtagcactgctttctccgcattcaatgcttaagtggttctcagtacaatgtgttcttaaaaaatgctcacttgactgacaggtgcagcatgttgatggaaaaactcaacatgaaatgcaataggtcaaagaaggaatgagcaagaagtgagggaaatcagggttctggataaattagcttaaaagggggttgtcaccagactacaaatgctcttggctggccttggctctccaagagctctaaatcgcctgggaattaatgcaatgtggttaacagttaacactgctattcaaatctgtgtaaatctttaaaaataattattacaacctaaattcatctatgtaaacagcactacacacagtacagacctgccctgaaaaacaatatgcgaaactgagatctggcactgtatcattttgtaatgttaattcaacctaacagtcccatccccccgccctgctctatgccctcccctaccaaaaaaaaaaaaaaaaaaacaaaaaaaaacaaaaaaaaaacctaaatttgtgcaagaaatggcaggcttattctatctgaaggcttcaaaaaaagatacacaacatgtaaccaggttcaaatattctgggagatccccccaaaaaggaaataaccaaaataaccaaaaaaatgaagaaagtgcctaaaacatgatacagcattttagagccctttcagatacaaggcagagaaaggtgtaaagtagaaaatatccggatcttcagtaatttccaaaatggtccaattcctcagttggctgcagggcagctggcagatccttgctgctgctcctgggacagagccactaagtctgctcctcgggacacaagccctcaggccctgagctgagtgcacctctcccttccccttctcttttccttcgctccatttcccactccacaaaggtgtcaaagagacttggccaggcctcatcttcactgtagttgctgaggtcagggccaatcacctgagtgaagttaaggaacatgttccaagtgtcccgggagatgcccttgatccccgaggggttctctgttaggaagtttagccattggtccaataccggaggattgttctgggtaaagactagtttccacagggcaatggctatttcccgatgcagtgaccgctgcccttcttcagagtccaggccaaactgaaatgtaaaccggtagagatccttgaatttatcctcttgtttggcttctgttaagaggctagggaaccgtgcacagattccgtcaatgctgtctgcacttattgctttgcagccatcaaaaaactccttcctgcaacagaaaggaaaaggacaattaatcattataaactatactatttacaggcaatatacatagtgattaagagcaaggctttcaggccagatggtctgaatttgaattctaactcctccaactaattagtcctatttccttacttgtcaaatggtaaaaataccaccttacttcatagggttttggtgaggactaaacaaattactattctgcttctaacagtgcctggcacacggttggcagctgataatggttcatttattcattcattcatcttcccaaagctaaactcaagtctcctgctccctgccctgtttcccgctctgcaatagcgattaagctgcggattctttctccttccagaggaggaggcttcctgtttcccttctgattctctatgggttgtttgtttggggtatatttttagagattgccaagggagacttctggagccaaggattctgaacctgagtaattctaccaccagagatcaaaattctattattaaaaaacaaaaattatgtatgtatttttaacatctatacaaccctttcagcttacagcatggtctcgcattgatcgtcttctcagggactgtagtatctgctgaagaggtgaggcctctgaggtctggagggtaaccttcctggggtggggggcatgcaaactacaaattgtatggctaggcctcacagtcagttcttattcacaaccccgtgctctacaaaccacattctacagggacatatgaccagaacaatatgcacagctactgcttagtaactgaggccaactgaccttattatacacaggcctggctgagggcgggcaacatgctaagtaccagaaagggcaagtggcttcatggagggagagaggcgtatcccctccccagaggcacttactatattggtactcacagtgcaagtggcttcatggagggagagaggcgtatcccctccccagaggcacttaccatattggtactcacagtgcaagtggcttcatggagggagagaggcgtatcccctccccagaggcacttaccatattggtactcacagtgcaagtggcttcatggagggagagaggtgtatcccctccccagaggcacttactatattggtactcacagtgcctggcacatgctgggcatacaataaatatcaagtgagtgaactgacatgtaaaggagtaaaagaaaagaaaggtccaagacagcagtggggccgagcagcaacttggccacctggctcaccctggcttatttctcatttaaggcaaagatgagcagtgcccagttactcagaagctgccaaataatgctatgataggcctgaaatttgacctatgaattaggcaaaggcgttattctgcaaaaaaaaaaagaaaaagaaaaagaaaaaaaaaaccatagcgtacacattagaaccagacatgaatctctatcaaaatccaagtgcctgggccttccctgctgagattcctattcagtaggtctgctgcagagccagagagatatattttaaacccttagagtccagaggggcttctcagcatcataaccacaacttggctcaaaagattcaagctttagagaacctgatcagaaaaataaaaacttacccaaaaccctatgaagccaacccagtcctatcctagctgggcaccactgcccaatgctgttccctttcctccactgctcacctggtgacataaagtgtttgtgactaacctggtgaatttgcacatggttgcagcctggaacttccaagccaagagcagcactcgaaattctgtggggtcaacacacaggtcattgcaaaagcgctccatgccttcctccaaaattgcatcttcccgctcatccttgtagcgcctgaacagttcttccaatctttgcaaggaagactcctcggcattggacttggactccctcccagcatctcccgaggacgttggcagctggcaggcctcagtggcagcctcggccttcttggtcccgttgacgaggatatctccacctggcttgccacagggtggtacctgctcctcacggtggcctgcacccctcctgctatgtgacttgttgctgggctcacggtctccatttttgctgcccagggtcgatgagggattcttacacttggtgacacactggcccatggtgctggtggcctggcctctagagtggacccctctggattggatgccctcgctgccgctggcccatgtacctcaacatgccatcagccagaggagccagccaacctggaaggaaattagaaagccatcacctctgggtgggggaaatggggtatggaccctaccttctagggtgcacactggttcaccgctctatttccatgagccaacaacgaaccatgggagagaccctgagttcatcatccccttcacaggccagctccgtaacttcaccttggcgacgcagaggctggggcacatatggagaaccaatgagggaaattcctaaaattcttaaggtaacatagatttcaaagaggccgattcatatgtagaatgcatcaaagactgacagaaatattccagaggaaatctgtcttgccaacttgccatcacataagaaaagttatttggacctgggttaagccagaaggcacaaaggaagggttcatcttctaattcctaatgccaacattctcagattttctttttaagtaggatgagtagggagaaggggtggccatattcagaacaatagtctcataatgccctaatgatgaggttgtcaagactacaagcaggggcctaagccaagcagcaaaatgaaatttgcctctgatctctccagattcctttctgggcctatcccacacagtaggtgaaatgcccttgctttgccctactccatccacctatagaaaccatccaccaagcctatactccaaaccaagtttcccaactgaggagcttcttctcccccaggtcctcagcaaggctgtacttagaatgcaagccaagtccacaataaatgtgattgtcctatagggcctataggctgagccttccaaagaagcatgtctccactttaaaagaaggactggggccggttgcagtggctcacatctgtaatcccaacattttgggaggcaaggtgggtgggcagatagcttgagtgcagcagtttgtgactagcctgggagacatagcaagaccctgtctctacgaaaaatagaaaaaaattagttgggtgtggtgatgcacacctgtactcccagctacaagggaggctcaggtgggaggatcaactgagcccaggtcaaggctgcagtgagctgggatagcaccactccactgcaacctgggtgacaaagaccctgtgtaaaaaaattgaaaaaatcactggtacaaaaacaggcacacagaccaatggaacagaatggagagcccaaaaataaggccacacatctacaaccatctgatcttcaacaaagctgacaaaaacaagcaatggggaaaagactccctattcaataaatggtgctgggataaccggctagccatatgcagaagactgaggctggatcccttccttacaccatatacaaaaatcaactcaagatggattaaagacttaaatgtaaaaccccaaactataaaaaccttagaaggcaacctaggcaataccatcctggacatagaaccaggcaaagatttcataacaaagacaccaaaagcaatcaaaacaaaagcaaaaattgacaagtgggatccataataattaaacttaagagcttctgcacagcaaaagaaactatcgagagatagcaaatatgaaactatcaagagattcctacagaatggaagaggaaatatgcaaactatgcatctgacaaaggtctaatatccagcatctataaggaacttaaatttacaagagaaaaacaaataaccccattaaaaagtgggcaaagtacatgaatagacacttctcaaaagaagacatacatgtggccaacaagcatatgaaaaaaagctcaatatcactgatcattagagaaatgcaaatcaaaaccacaatgagataccatctcacaccagtcagaatggctattactaaaaagtcaaaaaaaaaaacaggagatggttaggttgtagagaaaagggaacacttatacacggctggtgggagtgtaaattacttcgaccaccgtggaaagcagtatggtgattcctcaaagagctaaaagcagaactacattcgaactagcaatcccattactgggcatatacccagatgaataaaaaccattctgccacaaagacacacgcatgcgaatgttcactgcagcactattcacaatagcaaagacatggaatcaacctaaatgcccatcagtgacagataagataaagaaaatgtggtccatatacaccacggaacgctatgcagccataaaaaagaacgagatcatgtcttttgtgggaacacacatggagctggaggctatgatcctcagcaaactaacgcagggacagaaaaccaaatactcacttataaagtgcgagctaaatgatgagaacttatgaatacaaagaaggaaacaacagaaactggggtctacttgagggtagagggtggagggtggtaggagggagaggagcagaaaagataattactgggctctggacttaacacctgggtgatgaaataatatgtacaacaaacccccatgacacatgtttacctgtgtaacaaaccttgacatgtacccccaaacctaaaataaaagctaaaaaaaaaaagttaccaaaaataaataaataaaaatgctcaggatattcagaaaaaaagaaaaaactgaaaaaagtgggaaaaaaatagaaaaacaaaagaaggacagatttacccaaatacaatctttaaatggtaggataattgctagatgaaaaagaaaagtttgcactgatacataacaaactcgtcatggtggtttattaattatttatataatttaaaagtggttttttaaacaaattgctagacatttctgagccagaagcgaggtgatttctctaagatgactctggctacttaggactcttattcctaccttcaactggtttgttggaaaatccatgtacaatttagtatttataaaactttgccaactgctataataatggcagccactgaaattacgttgttaatgaagtgtggaccaggagccagaagtgtagcaggaaacagacactaaacagaagtcaacgtcagtcacccgggcctccccaggtctagggagctttcatggacctctatgatccaaactaaaagatctttgaaaaccggcagtgggacagaaggtgttttttatgaaaggctggagctttaaactttgcctaaaatacttggcttcctccaaatagtgcctggataaattgggggtcgtcttcaagaggaattctctctgaggataagctctgagtatacagtaagtttaaaatgaagagcacaatcattcctgtagttattagagattagtcatatcaaggcctgtccccttctccacccgcaaagagagcaatgacaaaaatacatgtccaaacatgccctcaaagacttgtagttttacttaggcttcaaaaatacactgaagctcttataagggcttttggtatggaaaacaaccatcctaagtaagttttttaaaagactttttatgctttaagactacagctagtaagccataagtacaactcattacaatttcaaatggcaaggggttaattcttggaagaccatggtacaagggaagcaactgtgcgagctgaattatctcaaaacaaggactgtaccatgtggagggcctggtttccagatttgtgttcctaaagactagaatgctgaaagaaacaaaaggcccaaacttacacaaaccccacatgctcacagactggcaactctaattcccaggcacgctgactcaccagggtttactgctcagctcctgctgctgagtgaggcatgggcacccagcgagataagaggatttcctggcctccatctgacccacctaccccaggccactcaccccgcccccactggacagatgcttcatcctagcagcttcctccaaatcctggcgccaaggccttcaggtagggacagaacagatggggctcccaaagaggccctaatcccattgagccaaccagccctccatgtaagagtatcttttgactacctgacacagcagaaccagctgaaacctgaaagcttttaacatgaccagcagatgaaaaaaaggagaagaaaattagtttcaacagatgatcaatcagcaaatgccagaaggttggatcgttcttccactctggtctctttctttgaaatgcccccattccattgagtgttgaggcgagtggtggtctaaacccagaagaaaatatctccagatctggtaagtatggtcccccgattactctgattactgcccagtggtctaccttcttctgtgtctacccccttctctgggaaaatacttttgctctcccagagctttccccaggctccatcacagtgcccagccccatggcccaggctggcagcacttcaagtgttttaaagttgaaggtctcccgtagactcactagctgatggctaacagctaataatagcagtcatcaattattgagcacttgatacggtgccaggcactatgctaagcacttttggggacatgaactcacatatactcatcacagcctcatttaaaaacaaggaaactgaggctgaggaaagtaaattacccatgatcacacatctggctcaagataccatgacatttacccctaggctagattgctgagcccacccccagcaaagcatctagagagaacacatgacggaccggccccaagttcaggagtgacaccacagcaaccccagagcagcaaatctcaccatcagccactggagagagaacacatggtctgtgctcggtgctcaagaaggatctcctactcgctgccatgatccaggcaagcaccatgcacccaggctcagccccaccagacgtggaaacgagaattagtccagatgccctaaacgtgtgacgtttttgtccaccagcacagttaaaagctccagctctgaaaaggacgcccaactgcgccactggctaattgtttgaccctaatggaagcctgaatttcctcaatctgcaaaatgatatctgcctgatagagctcttgaaaggattcagtgaggaactgcagattaaaggtacatggcttcagagaaaacacttgatatgacagctgttactgtatcagtagtagtagtagctcagtagtatctggttagcctgttggaagccccaacttaccccatctgaacaatgggctccaggcctcagattccacaggcccagctggccaggacttcctatccctgcactgagtcactggcccagggcttgttccaaaaccgattatcttgccacagcactgatcctactcaaatacaccactacccagtaatgcttggaggatcagactctccacaacacaggatttccttgtgattgatcctgaataaaatcaagctgagtatctgctgtgcccaacggacaatgaattgctggttatgcccagtccctaacctggagcaggctttcagccagttccaaactccttcccctctccacttagtcccaactctgtagatctctgcaaaagaaaggatgtctagctttccactcagttactaatttaatggaactgccttcccagttggtcctcctccccatcactgccacctctgaagtggacagcctcagcacaatctggacatcccagcaccaaattttcaacagcaacagagcattattagtcctgaatatcatttggtatttgttaatacattaagaaagctatatataaatgtagctctgtgaagcaattacccccattttacaggaaactaaacacagacaaactgaggtcaaggagtctatttaggaatggaggaaacagaagcgcagtgatgaagaggatgagctcagacaaaccaagacaaaccattgccattgccatggcaatctcaccaaataatgggaactgtccgcatggaactttaaatcgaggcagttgtacctcaaagcactattgggtagaataaataacgcaggtaaatgctctgctcaatacctgactcacagaaagcatttggttggtgttagcctctataatagttataattattgtcacaactttggtgacagaatcgtctcccttctcctagaacagtgctcttttcaggagccagcccagatctcccatagcgattcaggtctgctcacaataagtgaccattctcctgcattagcaagggacacaaatgggttgaatggagccagagacaaggagggatgtggagaaagaaaaggcagaagaaagaaggaaaaaaaaaacccatgcactggggaaaccaacttctaggctttttttcttttctacttatagctttgagtgtttacctgaaagaccaaagacagcagctctgctcagcttctgctggaccaagatcagcctccagcttctctccctcagtctcagcccagctgctctgcctctccctccctcctctgcacatcagcctccagactctttcctcccctgtgccagcgctggccgctgttcctggggatgggcttggctggctgcctggtcctaggcctggagcggccactgctgagcccaaagggcaatcccagaggctgcagtccctgggttgctctagctccaaagagggatcaggaagttgttcccatctcctaggcagatcatgaaatgacaaccaggcaagtccctgtcttctaggggcttactctcaactgtgtcttacagaacagaaccaccacagaggacaaactcacactgagactctgtacaaatgcagacaggagaaggagagagaagtgtgaactactattacggaaagaaaggtagggagggactggggacgtgaaatcagtatctgtggagcctggggctacatgcttcatattcatcatcaccttcaagcctcccaacaacctcaagaaaatagttgttgcagctttcatagattaggaaacaggtctcttaactactaagcagtaaggctggaaaataaaaccagtctgccagactttccatgggcaagtttcagagagaaggcaggtttaattctggtccttaaatgtctataagcatgaaatggaaaggaggagggagagggttgatatggttggctcatgttattaatgtatattaataacaatattgtaaaaataattacatatatttattggcatgaattatcacatgtaatccacgactctataaggaagacaatataatcttcattttacagagggaggaagtgaatagagcttgagggaggtagcctgaggtcacacagccaatggaggagaaggattcaaatccaggcagtctgactctaaactcgccactttccatcactggtctcactactgttctctgctatgatgtgtgccaggatattcccctacccctaaggaggtcctggtgccccaagaagaaaatgtccaacatcctatcaatgcctaagtatattcctgaggaaccaagtcaataggaacagaatacgcccccaggaagcctttggttctggtgtgaaatcctcctgagcaatgtgcactctcgagcaagccacttaacctctctgagtttctgtgacactgacattaaagtgagaggtctgggttagtctttccaaggtctaatattctgggactacttcaccttttttggcattcagtgaggccaaagttctaaatgtgcaaccctcctaaggacaggcactttgcctccttggtgaacagatctcacactactccttgcccaagactatcagagtcaaagaaaaagcagaagtccaaaagcagagggaaagcagggctactccaatctgaacaacgagggataggaaacaccagttttgcagccttccctctccttaatcatcttagtttgatctctggagggtcagtaacaggtccagacatggaaaacagacccaagtaaactgctgcagctcgctgggtcaggaagcccactcagaggaatgcatgttggctactactaatggacagcctgtcacccaaggaacagacttgtgaaatgaggagctaaaaaacaggaggcaaatgctggcaccaaaagtcagtgtcagcaaagcacttgagatctgctctgaggcttccttgacagaagggaccaatccattccactcctccattctgttcccatctagaatctattcagcagcaagaaaccactgccagatgctggtgctcctacatattaacaatataaaaagcccatcttttcaactttcatctaaatagtttgtagagctagctgggtgcagctttttatttcttcctacatatgtcagatacccaaaggccagagaacataagtacatgaattcctcagacagcttttctacagctgccaggggctgaggcggttgtactggcacagccatcctccggagagtctcaaggaccacaggagccccttgatcccacctgggagcaagactctgaatgacctgagaaaaagacggaatatggctggtgtccatttgtaaactacttcctagaaagtaaatgtgcaaaaataacaaggaagactgagggaacactttaaatgcacagttgctgctgccacttccaacttaagacttcaaagatcacctttggagattaggtcttacccagagctacttgggagggaaagttgatccctctgccaaagcaaacgagacccgtctgcttctattttccagcttttaaaagactttttgtcctaaaatgtacagcagcaacaagcaacagcagttccagttagggttggggaggaacccatgactttttacatcaaccaatctcaaaagtgcaaaagaaaagagggaggaaggaagggagaaagggggtagggaggacagagaaaacttttaaaaaagaaaactggctatgtttctataaaaatcatcttaggtcacatgactaagaccagccagtttagcataaagtcatttctttttgaaagtgttctcaatgtccctcgcattgcaccctttgaattcactactaagaatatatgtccagttgaggcctcaggactgaagccagtgtgggctggctagaacaaatgcctacttgccaaatacagccaagccaacacacgcacatactataaagtttccaaataccaaataatgaaccatttttttggtctctgggcttccaaactgagctacatgtttaatcccacataactcaaaataaccaaaaaagggctatatcatttcactgacccatacttgaaatattttttgctgtcactattgatctgggcatttctaactacccacttatgtgcaagggggagcatcataaatgggcaccaaatttctaggtcattctttgttttcacaccagcttttccagtgactttccctgtttaaaaccagaaagccatcctggatttgtactgaaccttaactctaataaaaacggcatgcctgctgcactcttcatctccgttataagcttgcagcttgttttattccttaggatggagcctcagtagagcccactgaaagtaaaccactgattagcactaataccctccttccagtcagcatatggttatcagccaccctggaggtttacctgattgtagctgattagtcctcaaaacacccaattaccacatcaactgctcatttttcaatcaccttctgagaacttgggagtcagcaactcactgaaaattagtgaactggagataaggttagatttttgcatctaagtaaaaggcaagaaaggaaattatgaaatgagtccaaagacgacgaaggaacacaacatacagatgataaatgactgcatccaaatgtcttaaagggcacctggatgaccacaaatgtagatatgtggtttcgggagccaaaggcctctaagtaggcctcaggttcaccacgtggtaaccaatcaacctcttaatgtttgctaattcttaaaaaaaaaaaaaaaaatctaaatccattaagaccacatttatcagctttttccccacgatggaggttgactgctaatgcatagcagacaggaagaggaagagggacagaaaagatccacacaataaaagaattcctgctttcaaccacatcagtaacctggtcagaaaagtgaggtcactagactctctttcctgctggcaaattcaaaagtattacataattattttgtgaagtttagaaagtacagagaggcataaagaaaaaaaaagccaatcactaatttcaccacctacggttaatattttggagtatatcctttcagtcttgcttcactgcgaatcacatcaaaaaggctaaccaggctaggcgcagtggctcacgcctgcaatcccagcactttgggaggccaaggcaggtggatcacgaggtcaggagttcaagaccagcctggccaacatggtgaaaccccgtctctactaaaaatacaaaaattagctgggcatggtggcacatgcctgtaatcccagctacttgggaacctgaggcaggagaactgcttgaagtgggacctgggaggcagaggtagcagtgaggaagactgtgccactgcactccagcctgggctacagagcgagactctgtctcaaaaaaaaaaaaaaaaacaactaaccaatccaatgatccagtgattctggctccagggattttaaggaagtgtttttaaatgatgggggaatggggagaaaagcagcttaatcctaaagacatctttcacttatatctaaatttcctcaatttattctttcaaaagaagatcaacttcctcctcacactccctccaaggaaaagaagaggacaaagatgatgaccatcttaaggtctaatgagtaacagtccccttatcaaaggtttaacatcaggggtagaagggtctggcccatggattgagtgattcacattcccagggagcaagaggctcattcaaaagagaaatgtggaatgcctggaaatggtcaatgggctggatttagtgtgaagactaacatgggctgtcaagctgcagactgggtcaaaggacagatttgtagcagacgtgtctgccttcccagcatccaggctcttcatcaggtgattacccaattttcaccagcagatccttttccctcgctctcggccatatggctgggtggggttcataaagaactatgggactcagccccaccaaggcctcacatgcccctggctttaatgactggacccaggatatgcccatgacaagccagccagacagaatctcaaccctgaaaatacaggaggctggagatgctaccagaaagagctaccagagaaaataagaatgcctagggggtcactgtgaggattaaatggtccctgtttatcacatggggctcagctcaaatgcatgtagaacccaaaaatgaaatcaccaagtggaaagcagtatgaagagacaaagggaaactgaattttgaaggcattatttacaccctgaatccaactgttcctagagtcaagatcaaagcctgaacttcacaggtgtgagccaacaaactctcctttgcataagttagatatcaggttttctatcacaactgaaagagtccctaccaagacacagctatgtcactcagatctcttctattcagagagcaaagagagagaagatctaattgccagatgttctgattcatggttcagaaccaactgactaggccacaatttctagtcgaatatatcataggacccttagctgaacaacaggaccaatgatcccaagttcatgaaagctgtcaaattccattataactacgtggaccagtaggatgctatttaaaagatggtatgactaactggctacaagaatctttccaattgcaatttttacaccgttagacctccttcaagtagatatgccacagaatacttcaggagctttattctattgtgtacatatttgctgtcatcatcttgttcccaaagaggaaccccgtcccagcattcagacaccatgtgaaaggctgaaagcaaaaatctctcagaagtctttctctgtacaataacatgatcaaccttccagctgaaacaggtatttgatctaaaccatatcccatgaaactgaaagcccaaatctaacctgaacttggctaccctcttggtttcaattcctatcactgagacaatttctctttgattttacatgccgaagagcctattaagaaagtgtttaagtttcaaagactgacaggaaatgctcatgtttgcacatctttatttgaatacgttctctgcaggttgaaacttgaggccccaaggtttaggctttgatttttttttttaagttacttattttcacaaatgctcatgtagcatgaggccccagagtacattaacatgtgcaaagataagcaggtaattaaaaatggagctctatacctgttggaaggcactgtggtactgcaagctttgcaaagtaagacatctgatgattcgttcctgcccacttcccacccacatgacctgccaaaattgctgccacctaatggccaccacaatgctgtctattaaaaccctgccctagcagctatgccctattttaagaaacaacataaaaaatttataaaataaagcagcagcaccataagttctttcagtcatcaataagtctgaagactcaaagacaactatggccccagaataaactgcgtgcgctcatgcacacacacacacacacacacacacacacacacacacacacacacaaatgttgcatccaacaatagggggtccatgaaattacatgcaacttttctgaattgcgttcagtgtcttgactgttctgcaaccaacattcaattctctcactcaaaaaccagttgcacagatattgcagctccttcagctgctccagtatagtcatgtgccttccaggagggaaagtacatgcattggatgcaaaatgactaggtttgtacagcccagctctaccaactctctagctcacacttaaccatattccatctcagtcttctcagttgaaaacgggaactaaaacaaatcactgtgaactaaatgactatatgcagaagaataaaactagatcccctctctcacactatatacaaaaatcaaatcaaagtggattgaagatttaaatataagacatgaaactatgaaactactagaagaaaacactggggaaatgatctaggacactggtctgggcaaagattttttgtgtaagaccttaaaagcacaggcaaccaaagcaaaaagagacaaatggggttatatcaagctaaaaagcttctacacagcaaagtaaacaatcaacaatgtgaagagacaatccacagaatgggaaaaaaaatctgcaaactatccatctgacgagggattaacagccagaatatataaggagctcaaacaacttaatagcaaaataataataataataatctgatttttattttatttatttattttttttgagacagagtctcactctgtcacccacgctggagtgcagtggcatgatctcggctcactgcaaccaatcacctccgaggttcaagtgattctcttgccttagcctctcgagtagctgggattacaggcgcatgccaccaggcccagctcatttttgtattttcagtagagacagtgtttcaccatgttggccaggctggtctcaaactcctgacctcaggtgatccgcctgcctcagcctcccaaagtgctgggattacaggctcgagccactgtgcccgactctaatctgatttttaaatgggcaaaagatctgaatagatgtttctcaaaaggagacatgaaaatagccagcaggtatacgaaaaaatgctcaacatcactaatcatcacagaaatgtaaataaaagccacaacgaaatattatctcaccccagttaaaatggttatgaaaaaaaaaaaaaacagaataatgaatggcaaggatgtggaaaaatgggaaccctcgtatactgttggtggaaatgttaatgagtatagccactatggaaaacagtataaagggccctcaaaaaactgaaaatagaactactgtatgatccagcaattgcactactaggtatatgtgcaaaggaaagaaaatcaatatactggagagatctgcactcccatgtttattgtagcattattcacaatagccaaaatatggaatccacctgagtgcccatccatggatgaatggataaagaaaatgtggtacatatacacaatggaatattattcagccataaaaaagtatgaaaccctgtcataggcaacacggttggaactagaggtcattacgttaagtgaaataaaccaagcacagaaagacaaatagcacatgttctcactcatgtgtgagctaaaaaagtggatctcaggaagagagagacagttatcttctctaggtagttaccagaggcagggaaggggagcgggaggggagatgaaaagaagtgggttagtgggtacaaacagaagtaagacctagcgttggaaaaatcagtagggtgactccagtcaacaataatctaatgtacatttcaaaataggtggaagagaataatttaaatgatcccggcataaagaaaagataaatatttaaggtgatataatatcccaattaccctgatttgatttttacacataatgtgaatgtatcatattatcacatgtctcaaaactacatatattatttatcaattaacaaaaaaatgggactgagttctgcgatgaaaaaaaaaaggtcacggtgaagaataaatggctgcttcatatgagatgggtctcagttcacgtgctgacatgtgttccatgttcaaccaatccaaatgccacttccctctaattcagcacaacgctgttttacttcttcacggcacttacaactctgtgaaattctaatttgctgacttatttattgcctgctccctctaatagcaggcattttacctgccttattcgccactttaccctgtgcacctaggctatgtggcacatggcacattgataagtatctgtagaaggaataatagtcactgatactgagcacatgctctgtacaaggctttattgctttaaatatattaactcgtgattgaataaatgctgaatctgagatgtttagcactttctcacacacaattaatactcaataaatggtagctatttataccaattcaaattataggatgatgtcaacaaacactcaacaggaaagagtaaagggagttgagtcctaagaatgcagaactcaattcagttctcaagagctgattttttctttttagagacaggatctggctctgttgccagcccagagtgcagtggtgcaatcataactcactgttaacttcaaacttctgggcttaaacgatcctcccaccttagcctcccaaagcagctaagactacaggcacatggtgccacacccagctacttttttcatttttatttttgtacagacagggtcttgctatgttgcccaggctggtctcgaactcctgggctcaagcaatccttctgcctcagtctcccaaagcacttggtttatgggtgtgagcactgggcccagccctgattcttaaggtctattttttcttggactccccccattcgaagcacccactaccttcagagaggaaagagaggagaggattatcttattactccaattattctttaccttatgagtttctcagataatgtgatacaaacacagcttctcagccagcagtacacaggtccatctctcctcacttcacaagctaattttcacctcaaatacagcaaaagccagaatatgaagctgacatagggagatgttcaacctgtcatgtctctttttgacctgtacctcaggatcttagaaaaaattcacattaatggaaatcacttctgcctctcttttcagtcagggtgttatgtccaagggtttactgaagccacagccatgcactgcactctaggaagaccaaggggctcaccaactgggaacactccagtgaaaagcctcaggctgctggtctgaactgcatcttccccacctcaacaaataaaggcatcatatttaaggtgtctagagatgcaggagcaacagccagcagcttttttgaatactgcatactacttgctttaaatacgaattcaactgcttaaaacacaaggactcatggccagtgttacacctcttgagatgttataccactgttcacttgatgacagagtgacttttaacttggagggctgaagcacataccttatcaaagagggtaagtgatacagacaataaaggtcctccatctctttacagccaccagagacaatgaactttgtttcacatgactgcgagaaaggccaacaactaaagtcctcaacggggcccccaaagccagaggtacttgctgagaaagcaaagggcagattccacctccgctggctggcagacccacacattctgcttaaccatgtgaaacagccagctcttactctgcccgcccccaggcccagttatgatatttggggtagaaagagaatagcaacaccggtgacttttctaggaggctgttttataaaaacagagcttccaattttaggcctaaaattgaaaagaaaaatagccagaattagaagtctgttttaacacaatatattgaaaattacaagtttaaacactggtagctggagacggggtatcacactaccacatgacttctcagtgagtcataaaaaatagtaccggcttgtttaacagtgatcgtccaccagtgacagaattaagaagtccgcttgtgtcaaatgatggaaaaccaaactgatacccctcttgtgtttgtttcagcagtggcagaactgacacaaatgaattgcagcaacaatctacaagacaaacactgataaaccttttttgaggctggtcaaagaggaaatgtttgaaaccctgaatatgactcatttttcagaagtcagtttaacaggagaaaaaaaaatctctaaactattaataaatcactaactgaaatatttctggattgctaacatccaatcttgattagcatacctttgtgtcaaagcaaaagccaaatgcaggcatttaacaagtcactaccctttcagttaggagaatcgctctggtggaactagatgagaacaacaaaaattaatcttcaggcatagatggatactgtcatgataataagataataaagacctccccaaaggatttctgggtatcataaattatataacaaatccacttctgccaggcagccaagattaactcctattcacccaggttatgactcggtattgccaatgggcttattgaagtggaagtctcattatccaccactgctcagcaaaaggcacagtcatctttctcattgcaaatcaatttgctgacaccaactactcactgtaagagaagtcaacctaataatcttaaaaacaactttgacacttgtttcttccaggccaaaaacatattttaagaaccagaaaagaaaatgttccgtaatttctccctcccagtaagtccttaaaccgaattttttaagtgcctaagatgacattttattataatatactttattatgtctatcgtgcgtccaaggcttaaatgcattacacattatttattcccttgggacaaaaacattcatggctcccaagcaaatagtcaaatataaaaagtacatagaagagaaaggctgttgtcattttagtgacagcatcttagactgcaagctccaagaagacagggaatgtgtatgatgacacaaaaagggtcaacttggcataatgcgaaggctcacacctgcagacccagcactttgggagaccaaggcaggaggactgcttgagcccagtagttcgagaccagcttgggcaacatagggagacccaatttctacaaaatcacaaataaaaaaattagccagccttggtggtacatgtctgtggtcccagctacttgggagactgagataggaggatcccttgggcccagagggctgagactgcagtgagcagtgatcatgcctgggtactccagccagggtgacagagtaagaccctgtctcaaaaaaaaaaaaaaaaaaaaaaaaacagaaaaaagaaaaaagaaaagaaaatggctaactggcatctaagagatactttctaaagaatcaaatggaaaataagcacctactatgtccctagtgcactgcacaaatctacctaaatgcagagtactaccacttttacatagtaacatccacaaatagtttcccaaggtttactacgtaccaggcatcattctcaaaacatttttacacatatcaactaataaaacaatccaactctccaataataataccctaggagatagtaagcagcagagccaaaattcagactcttaaattaaggatgcttttcaaagctatttttttttaagcctgaaggtttaaattgcttctttcaaaacagcatactccgatagagtggttttttgtttgctttggtgtgctaagtctttgagtcactgagaaatgagagtttggactatacaagtagttttcaaactttaactgcaaccttcagtgagaaatatattttatatccttacccaatgcacacatataaagccatgtacaactcaaagaaaagttccatgaatatttaaccttttaaatatttacccaagcctgggcaacacagcgatactctgtctctacaaaaaaatttaaaacaattaagtgggtgtgatgatgtacacctctagtcccagctactcaggaggctgaggggagagaactgcttgagcccaggaatttgaggttacaatgaccgatgagtgtgccactgcactccagcctgggtgacagagcaagatcctgtctcaaaataaataatctactcaatatttacccttacttctatgatgcactgatttgcactatttgttttctttttttcccattttgtttttaattgttgcttataacccaccaatgagatatgacccatagcttggaaatctcaaccaagcttgataaacgttccctccatcacctttattgtgcctgaaacaacgttaggcattttacagtcatgatagcatttactctccacagctactctcggaggttcctatggctatccctattttacggatgaggaaataagctcagaactaaagcagcttatgcaagcccttagcctgtgacagagacagaggaaattcaccaaactgctcccctaatttcaaacatcctttcagttaggtggggaaatgtgtttacttttttattttttgagacagaatctcactctgtcacgcgtgctggagtgcagtggtacaattttggctcactgcaacctccgcctcccaggttcaagcgattctcctacctcagcctcccaagtagccaggattacaggcgcatggtaccacgcccagctaattcttgtatttttagttgagatggggttttgccgtgttggtcaggctggtctcaaactcctgaccttgtgatctgcccgcctcagcctcccaaagtactgggattacaggcatgagccaccgtgcccggcctagtcttatacacactgttaccactgctcagaatccctccccattcctttctctagtctttcatgccttatgctgggattttacttcccacaggactccttcctgactgagagcctctctgcccctgagcaccttcatttataacattgctatttttttttttttttttgagatagagtttcgcttttgtcacccaggctggagtgcaatggtgcaatctcagctcaccaaaacctccacctcccgggttcaagcaattctcctgcctcagcctcccgagtagctgggattacaggcatgtgccaccacactctgctaattttgtatatatatatatattttttagtagagacggggtatctccatgttggtcagactggtctcgaactcctgacctcaggtgatctgcccacctcagcctcccaaagtgctgggattataggcgtgagccaccatgcccggccagcactgctatttttacagcactggttttacaacattttctaattgtcactatcttatgttccaaccagacaataaagtccttaagagcaagatctacaataggcactaaaaattattggaacaagtagctggcaacatataaacacatttcttcttcctgaaacacgatgtgtccaatcctagagtcagtctttcagaaaaattcagaatacatacgcttcactttgaatacaaccatgaaagcattacattttggaggccaacattttttagcttacaaaactggtttttagtttcagaagtaccctatgaatggtccacattctgtctgagaatgccagtcttttgcttatagatttctaacttaaaaataacagtctggttcttcttagggagaaaatatcttgtacaggttgagtatcccttatcccaaatgcttgagaccagaagtgttctggattttgaacttcagattttagaatattaacattgtacttaccagtagagcatccctaatatgaaaatctgaaatctgaaattcttcaatgagcatttcctttgggcctcatgtcagggatcaaaagttctaaattttggagcatttcaggtttcagagtttcagtaacttcagtactttaaaagtgtgtttttgaaagttttgttctggccggatgcggtggctcacgcctgtaatcccagcactttgggaggccgaggcggacggatcacgaggtcaggagatcgagaccatcctggctaacacggtgaaaccccgtctctactaaaaatacaaaacatttagccgggcatggtggcgggcacctgtagtcccagctactagggaggctggggcaggagaatggcatgaacctgagaggcggagcttgcagtgagccgaggtcgagccactgcactccagcctgggtgacagagcgcaactccatctcaaaaaaaaaaatttttgttctgttaaactgctatcataattgaaaattcttttgcttaagctggttgtatcagaagtattaaatactggagatctttagaactttctgttgagtgaatcaattgaagtactgtatgaaaatagcaaatatgcaaatcagaaaggggaggagcttaggccaaactgttcagaaggaaagaaaaacaggtttccttccaaatggggaaaaggcaactggaaagatttttacctgttgcacaactttttattatctctttctgctaggccaatcaacgattgagagctgtgaacttggaaaagcaaatgctctgataaattaagcaactccagctctttgactaggaaagttttaaagtcagagttaaagattaagtcttcaattaaacatttttatttttttacttgaagttgccatgaatattcaagtttctaacatcctaaaagggctttattttaggagtgaaaagattctggataaactaaaaggttattctaccatgagaagaccgcgataagtggtgctggaacatgtaagaatggcttgtaaaggtactgacctctgccactatgttgtacatctttccttctgactctgttatatgttaagtttttaaatgtgtggtctcgaatgctcatacttcttatggagattatacgaccatggagataatcatttgtatgactaggaaagaacagtcttctttcatgtggctttcatctttaaaagcccaactgctcagctacccacaaaagatcttaaccaagacaaactgatccaatggcaatttcccaagaagagaagaaaacaaacagccccactctagctttgcaaaacttggtctgcagaccaagggtgaatgtcacaactcggcccctcccctttcagaatgtatccagactcatcaaccattgcctacacataatgactaacttccataccacaggaaataggctgttctagaaacctgacatctacaagtaaggtggtcttataattgtatatccaaggagttgcttggtttgaactcaaaatctgctcaaaggatgcttgctgcgtgtcatcaattagatcttagtgggaaggcagacttgtaatcctgcaaaacacagccttcagtaaaaggctttttccaccttgccaatgtgcccaatgacacaggtcacgacacctctctgagacaagacagtaagaatgacaaaatcgaaatttacaaagtatgaggaattgaagcacagatcccacctcagttggggaacatttgagagtttctcattatgaagtcatgtagaaaccttgtattaaataaatgaagttcgaggttgcagggaaccatgattaggctactgcactcagcctgggcaacagagtaagaccccatctcaaaataaataaataaaataaattaggagaataatgttgggctatatcactgccaccattttgctttttttttttttttttgagacggagtctggctctgtcaccaggctggagtacaatggcacaatcttggctctctgcaacctctgcctcctgggttcaagcaattctcctgcctcagcctcctgagtagctgggactacgggcacccgccaccatactcggctaatttttgtatttttagtagagacatggtttcaccatgttggccaggatggtctccatctctttacctcgtgattccgcccgcctcagtctcccaaaagtgctgggattacaggtgtgagccattgcacccggcattttgctctattttaacctaatcttcactagtaacacttggcacagggacctatcagacttggatccatctttatagcaattttttaaaactaaaatctgaaacactaaataacttattacaaggagctataccagatccatggccctttacagcgtgttaactcagaacaagatcacttgcaaacacagaccaatccccaactgtagataataaaagatgacagtgtaaagatacacagaaaatgtttagggactacaggtaattaaggctttaaaaaaaaaaaaacataaactacatctgaaagcagctttttcggcttctattgcttaacagagatttccattttattctgggttttactgaaaaagcaagtgcctcccacagtagtctgtatcatttctactactactcgtttcccttctcaagaccccactatgttgaattatgagcaatatgacaaagtgaaatgagattttaaatactgcctgcctcagtgtttaacatcattttagggcacatatcccactgtccctttaaagcagtcaccaggaagaagtaatctacaggtcagctcttgagatgggacagagccttgaatccatgcactggcttgggttcaagaagcaattaggctttttctcccaccccaacagaacaagtcagaccctaactttacttctaacatggggagtcccaacagcaaacaatgaggaactgaggagcaatccaggtagccgggaaactgctaaaggtgaaagagtaaacaatattattcattttttcattgaaaaaaaaaaaaaaggccaccaatactaatggctatggtattttaaattctacataacctacttgtgggtatttttgtcacaaatgcaaaaaaagaaatttgtcaatttgcttgagttagtcaagtctttatttttttgcctgagacttctgaaggcaagtctttaagtcctgaaatcgggacctgctcagcagtggccatcaccacaaagacttcattgaataaggtgtggcgctgcactagagttactgagtcttggaacctacaaacttcagccattcatatcccatctttaccatcccatctactgttcacctaatatttttcttaaaagcttctttaaaaactgcatctactgttaaataaaaatgatagaagaccatggttctggactaagctcctgcactaggctccaagagaccagactaaaaatcaaaatggagtcattcatgcccaaactaagtttgttatctgaccttcccagaaaccaggagaaagagataacatccaacttcccaaactccatgtttaaatcttcaactggcacgataatgaagttccctagttttaaaccttacacacaaacacacacaaaagtctgaagtaatctaatgttaactattcagttatttctctattgttctgtttccctgtcctgccttacaagaaaagcagctttaaaaggactgatacactctttgttctttgcttctgctttcttcagcccttctgtctataaagccaactcctgctttagctcatctaaacacttattctatattatggaatgaaacattgcccaattctagaattgcaatacagccagttgagatctggaaactaaattggttgcaattttgtctttgacatgactttagtatcatcctaagcactattgtccatgaattcataggtgtgatatgatagttatgttttcattcatacacattaaaaaacagaactagtaggctgggcgctgtggctcacacctgtaatcccagcactttgggaggccaaggagggtggatcgcctgaggtaaggagttcaagaccagcctggccaacatggtgcaaccctgttacaaaaattagcagggcgtggtggcgggtgcctgtaatcccagctactcgggaggctgaggcaggagaatcacttgaacccaggaggcagaggttgcagtgagccaagatagcgccactgcactccagcctgggagacagagcaagattccatctcaaaaagtaagtaaatacaataaaaaacagaactagtaaatgaaaagtattcatcatgtgccaccaaaaatcatcttatgcaccatcagcagtaaaaaaacacatgagtattcatttcagcaacacataaattacaagtgtaaccaaagccacactttgagaaacagtgatttagtcctaaatcctttatgtcatagttaaagaaacagactgagaggggatgtgatctgcccaaggaaaagcagcaatggtggcagagtctagactagaactaaggacttaatccaatggtagtcccactacagtagactgtcttggttcttgagctacaggaagaattagagacctggcctcagaggagttcaccaacaagtaaactctaagcagtcaggaagcccttttgcatgtggatctgggcttttctctttatctgagactctgtcaaacattatctagactggctgaaataaatctatttcttttcccaaagtctaatgtggttttgcccaactcactgaacctcaaggcatacagtcaaagataaaaatgtctcctggatcagtttcccaatttttgatccaacagtatcctagcccctgtccccactgctagacttatacaggctccatagggtttcaggaggaagattttccatctctgggttttaggccagctttggaaacatgctggaagtttccattacagagtcactagtgtatttcccagatacccagaggacaggttttattttcaaatgatacataacttgtgtctactgtgtgcctagcaatctttttatacactgtcccataaactgactataagaggaggtaaaatgatatacatgattcttgactccttgggaattagctgccattccaggtgggcatagcaatggatgccatgtagccaataatagctaatgttattaaatgtttgtttttatgcccagcactgtgccatgtccttcgaatgtactatcttattgaatcctcacaaccatttactgtgattaccctcactccatacatgaggaagctgaggcttagagagagaaatggctcatccaaggtcaagtggcaagtcggtgataaagttcagactcaaacccagactgactctagagactatgttctcttaaccaaggcactatgtacatctattttttgtttgttttgagcagggtctcactttgtcaccccgaatggagtgcagtgacacgatcacagctcactacagcctcaactttccgggctagggtgattctcctcagtctcccaagtagctgggaccacaggcgggcaccaccatgcctggctaacttttgtattttctgtagagccagggtttcaccatgttgcccaggctagtcttgaactggtgggcttaagtgatcctccctggctaggcctcttaaaatgctaggactacaggcatgagccaccatgcctggcccactatgtatatctaaatcttttaaaaagtcatattaaaaagtaacatgggccaggtgccgtggctcacacctgtaatccctgcactttgggaggccgaggcaggtggatcacttgaggtcaggagttcgagaccagcctggccaacataatgaaaccccatttcttctaaaaatacaaaaattagccagggccaggcacagtggctcacatctgtaatcccagcactttgggaggccaaggtgggtagatcacttgaggtcaggaattcgagaccagtctggccaatatagtgaaaccccatctctactaaaaacacaaaaattagccgggcgtggtggcacatgcctgtagtcccagctacttgggaggctgaggcagaactgcttgagcccaggaggcggaggttgcagtgagctgagatcgcaccactgcactccagcctaggtgacaaagtgagactccatctcaaaaaaaaaaaaaaaaaattagccaggcgtggtggcacatgcctgtaatcccaactactcgggaagctgaggtaggagaatcgcttgaacctgggagggagaggttgcagtgagctaagatcgtgccactgcactccaggctgggcaacagagtgaagaaaaaaaaaaaaggtaacatgaaatctgtattataaagtaagctggtttcttgcattagggaagtctagacctaatgcacctttgaagttcaagaatactgactattctgggaatgccatttcatactaattgaaggaggaatttgctgcttataatctaaagctaatcaacttgcagtatctggtgtgtcaagaaatgacaattgttaattatcatttaaatcaactttaggtacccttattccgttactacttacaagatacaaaactggagtactaatggagtattagaaaaatgtatttggtctttgtccctggttcctgccagagatcctaaaacccttggaattttctgtcttttattattcatgaagagccctctggaccacatgccagagtttatgctaacaaggtgatttcaccatgggcccttatagtttccagtgaagggctagccaaaccagaaagaccaagcacatgattagacctcaaagccctactttctgagctttggggaggggagggctggctagagacagagttcaatcaccaatggtcaatgatcatgcctaagtaatgaaacctcaatcagaactccgaaacaatgaggctgggagagcttccaggttggtaaaagcatttatgagctaggagtggcacaccagaaggggcatggaagctctgcacccccaactcataccttgccctatgcgtctcttccattcagctgttcctgagttataaataaatcctttgtaacaaaactgtaatcctaaatatcatgctttcctgagttctatgactcatgatagcaaattatcaaacctgggatggggagtcatgggaacctccaaatttatagtctgctgggcagaagttcaggtaacgtacaaatacccaatacctgcagctggcatctgaagtggggcaattttgaggtaatgcgtaagtaatatgtgggatctgagggtgtgggggcccacacctgtaatcccagcactttgagaggccaaggcaagaggatcgcttgaggcagtttgagaccagcctgggcaacaagcaagactccatctctacaaaaaaaaaattttttttaactagccagccatggaggtgtgtgcctctggtcctagctacttgggaggctgaggtggggagatcacttgagccccagagtttgaaatgacagtgagctatgatagcaccactgcactctagcctgggcgacagggcaagaccctgtctctataaacaaaaaatgaaataaacaggtggggtctgtgctaactccacgcagtaacagaactaaactgctggacactcaactgctgcccaagaactgttggaatgatataattaatcacctcattaagaggtccacactaaaactaaccattctgatgctcagaagccacttccctgcttgatctaatcattaaatctacacctgtcaccaattcagagcactgcttgcaggtcggcactagcaggaaatcaggtcctatggacagatcacagcacctggtcaaaatttttttttttttttttaaagaagaaagactaatttggcctgccaaagagaacatggatgttgtagaaatgtgaagtaaaaaatgattttttttttttgagatggagtctcactctatcgcccaggctgaagtgctgtggcgcgatcttggctcactgcaatctctgccaccagggttcaagcaattctcctgcctcagcctcccgaatagctacgattacaggcgcctgccaccatgcccggctaatttttgtatttttagtagagatggggtttcaccatcttggccaggctagtcttgaactcctgacctcgtgatccacccacctcggcctcccaaagtgctgggattaccggcgtgagccaccatacccggccgattttctttaattagttttttcacattacagttcccacaagagaatcattaattacctcagcaattgacatgtaactgttccgtttggatagcaaacattgttaaatgtcaagagccactatccagtgttctctaatgctctaacggatacaaataattacaatcccttctttaccaacttccgatttgtcaaaataaagccctaagagacagggatggaggccgggggaattggccagcagtctgtaaagatgactggtctccaagatgggaagttgtcagagaggaggacatgtagggtagccggccttcgagggggcacagtggtgatgggtggtgggtgtggagtggggagaaatgcccatcagtggtctagcctggaccagggataactcctgattatggctgattagtccatcttggagaacaatttggccaaaccagccactgtgtccctgtgctcatccctcttaggcagaaatatgctttccagttgggagaggacttgtgatcagagccctggccagggccagtacactgcccaactccagaggaccctgtcccctccttgtgaacggcattccctggagttgggcaatcttgtgggcctgctccttccctaccctctgtccccagtaagtgcactgttagtattttgcagcctctcccagctagaccactgatgggcttttctccccagtccacaataccaccaaccaccgtgtcctctcaaaggccagctaccctacacaagctcatctccgacaactgaacctcccatcttagtgctctgggagtctttaggcttttctctttcctaaaaagttaggaaactctcaagcagaatgctcctcaccgtgggcatgagatacaccaactgttttgagtaaatgactgaacaactgactatttcaaagaacaactaaatttctaagagaaaaagaatctgacaacattctcaaaagtagacacacagcattcactctatcactcctcactctctaattccacttactgagaaggaagaaaatgtcacaactggggaaaaacacctcctcagagggcctgagacttccagtgtgcccctagatgctgtctcataggacccacactgctagagtcccggcaccttcactgtaatggtattattcacctccccctcctgtttaaagagcacttactaggcaagtcattaagtagacataaagcaactatttaattgaaagccaatttgctttacagatattttttaaaaataaggaatgcatgtccatggtggttatttccacagagctgttcagaagctgttctgtccatggatccacctggattctcctcttcaaattccagggcaggtcacaggaaatggaagtctggtttagcattttgcactggtgttcgagaacaggcccacttgcttatctgaaaaacttacagtgcactgaccattttggggttggtttgggggggaaaaaaagaaaacttacagggataatgcctcaactcctatttgaatgtaatatggtcactttcagaactattctgaagaaaaaagcccagctttctatcaagtatccacaaccactactaaaactaagaagcctctcatcccactaccattaataacctcgcttcacatatgcttcactatagggagtcttctttgaaagatgaagagtttgtgacaaaatgtttgagtacagaacccaagaacacagagtccaaacaccaaggattcaattaaactttatcgggtgcctacaccaacttgtttgagagatgcagtgcaacagacagaacaagaattagtgcagagaaggcctgattctagccttgctgctgcctagagcttgctctgtaactttaagcatttactcatctttttttttttttttaaatgagacagggtctcactctgtcaccaaggctacagtgcagtggtgcgatctcagctcactgcagcctgaccttctgggctcaagtgatcctgctgcctcagcctcccaagcaggtgacactacaggtgcacaccaccacgcccagctcctttcccttatttcttgtaaaatgaggtctcactgtgttgcccagactggtctcaaactcctgggctcaagagattctcccgtctaagcctcccaaagtactgggattacacgcatgcagtgcattaccatgcctggcctacttatttttcttgatttctgttttcccactgaaaataaccacttttcaacctgttttcagcctcagaacattttattcaactagaatctaatagggtagcccaatataacagaatattacagtaacttttcacagactgaagtagtaacgtgaaacagaaggaaaacagcaaaaccccctcatccctgccacaagcatacttcaacaatggcggagagggctcctcaaagcccagcttgaaataaacaccagatatgctaagattctgcaagggtctgactttttcctgcttctcctaaacttcaggaaggggaattaacagcattcaaagtagtaatgctatgacttgagactcgttcagaatcaaaattaaaggacacatactaatccactttaagcaaacactgcatagagttcaaacccatcatgaatgatagagagctaaaagctgtaacccaactctgccgcttgtgtggaaacaatctgctactaaaataaaggagcaggccaggtgtggtggctcacgcctgtaaccccagcactttgggaggccgaggcaggcagatcacttgaggtgagaagtctgagaccagcctgggcaacacagcgaaaccccatctctattaaaaatacaataaattagtggtgcatggtggtgcaggcctgtagtcccagctactcaggagggctgagacaggaggatcgcttgagcctgggaggtcgaggctgccgtgagccttgatcatgccactgcattccagcctgggccactgagtccagcctgagactctgtctcaaaaaataaatgaatacataataaatcaaaaaggggcaggttttttcaacactttctcttggcccaacaggcagaaagaggggcagtggctccgagatgctaagcagtctcaaaaatgaagagtcccacactatacactgctgctatctgagattcttagtcagtcatcagacctggtatgaatctgcaggcccaagtgacagaattatttctagtcaccaggtcctgcggttgagccctccagcagagcagggcacaaaaggatcagggatgatgcttcccaacactatgcaatccaagcttctgtgtggcaattcaatcccaagcctaacaatatagtacagctcaaaggacactcttgaacaaggtcaagccctcaggaaggtagacgaagtcattgacatgtctgcctttgcatgcaaccaggctggtatccaggctctgggcacaggtgacttattttgccacaagagctaatcaccacctcaagactgatttactaagcttccctgttctgatgtatggtatttaaagaaggtctcatttgcacacatcttaaagaaaatgatttccctatctgccattctcttctttcaacatgtcacaacttcaaagaataagagtttgagccacttccaatcttttctttcattttcagtgcaattggccatctgtatcaataggttctacattggcagattcgaccaaccatgggtcaaaaatatttggaaaaaaaaaacctaataacaatacaacaataaaaaataatatgaattttttaaaatacagcatagcaactatttacataccacttacattgtatttggctgttgtttttgagatggggtcttgctctgtcacctaggctggagtgcagcagctccatcacggctactacagcctcaacttcctgggttcaagcaattctcctgccttagccaccccagtagctgggactacaggcatgcaccaccatgcctggctaagttttttaaatttttttagagacagggcctgactatcttgcgtaggctggacttgaactcctggcctccaagcaatcctcccacataataaaacaaaaagggggcaggtatttgtagtagcctcctaacgtgctgggattacaggaatgagccaccacacccaaactgtattaggcattataagtaatctggaaatgcctcctgagtagctgggactacagatgtgcatcaccgccactccctgcaccttcccatatactaccactttatgtaagtcttgatcatttgtgaatttggtaactaaggggtccaaaaccaatcccccaggataccaaggggatgtaaatatgttacgctctagtttgtaattattcactgattaaacggtcaagttctgtggtaatcccttctcaccacccaaaagaataggattcaccatcatctaggaacacagacgtaagaactagtgaaactagatttgaactgaaagacactaactcaattaaccctggtccattgtgcaaagagctccagaacagtctaaacagacacaaagagataattttaagttatcaagacccgggaaaacaggagttaccacgtcattaccattgtttcaatctaagttaccacttcttcacctcaaaacaactggcaactactgcacaattaaatgtccttacttcagcacatagacagtcccagactacttcaagtacttacacaaccattctgtttttcacttccagtattcactcaataaattacatgagatattcaatattttattataaaataggctcattagatgcatttgccaaacatgccaaacatgcaggttcttggcatgtttaaggtaggctaggctaagctatgatgttcggtaggtgaggtatattaaatgcatttttttactaacaatattttcaacttatgatggggttataaaaggtaaccccactgtaaatcaaagagcatctgtacaccaaaacagtagcaaaatctgattaccttttagtcgtgtaatgcaatgtaaaaccacttacccacaactccaatagcaagtggcatcaactggctttctaggttgcccacctttcagaagagtttgtccaaaagcctgcaaagtgtaagaaataaatccactggtaccctaaattaaaaggccagctcagctccgaaaatccaatccacttaaatttgtggattctttccccaaacacaattagtagccaatgtaggagacaatggcttctccttgtgttcaagtcccctcctacccacccgccccctttcaaaaattagaaaagagccaccagtctccaaactggctgatgaaacttcagcctacaggatattttcatatttgagttacaataaaccattgaaatgaaaatgaagtggagagcttaataacccatcagatagagcattttatgccaagcatcagcatataagttaagtccaaaacctttaacctgggccaaagccaaataattaaattaacaaatctcactaccaattctctattcctttgagatactctagtatgaagagtagaagttgcctgttcctagatgtttactttagtcatttgcttgctaactaaaagacattctgtttgcaatcaaatcagaattagtaattcagtaccaggatctacctcgtccccttcattgcccccagaactgcccagaaagctctgttcaagttttcgataatccttctacaggtgccacgagaatactagaacctaaaacaggtgacaagtcctcaatttctgattcgttttccccaaacactaaaaggttttatttagcatttctaatactgagtttactacaaatagcccaagcaacatttaagtctctcaactgcctggctcaaagagccaattcactcaaagaacacactagtcactgttgtagggttcaagagaagaaaaaagcatattctgtttcagcccagtgtgacatggctcaagagggccaaatcaaggagtcttgattgggcctctcaagtggacggtctggtcaaggtgaggctgaaaagcagcacaccattagagatgaatgccctcagcagaaggcaaaagtaggttacatcccttggttacgtgccagcccaaagatgccgacacagtggaattgagccccacaatggtcatttatctaatgtaatccactgagtgaacttttagtaccaacctacacctcagctgagtgttattagtcatcagaaggatcagacaagagtggaactattgcaacataaactgcctccctacaaaagacaacttgaaacttagatcctgatggtcatcttggtagatggataagggcatattattaacacttgcccagtccttaaattcatacagagctggaaacaaaggaggattcgtatactagaacacattcagagaacttattatgcagttttaaacagcagtatataagacaaaataaagaaagaggtgtgtcctcaattgaacatcctgctgaaaatctgaacacccagcttgaaatttatctgccagaaaagacccaggtgaccactgcctcttcctctcccactcagcagagtgactttattatgatagtccaacagtacctgcaaaaacagtaagtgataagaccctagttaaggcgacagaattaatcaacaagcagcatcattttctacttcctactccttctggcaatttgtttgcctacctattctgagccccatatccacctctctgaccttatctccaactctcccccgtgttcactaagctctggctattactcacccaacccatcctctttccactacctcccacctaccctgaccctttcttcccattccctggaacttgacaagcgcattccagccagtttctgcaccagctgttccctgaacctggaaggatcttccccttttctttggatggctggctccttctttatacttaaagctcaacttaagtgtcacttcctcagaaagatcctctttgactgcatctacagttaagacactttcaatcacatcactcttattttcttcagcgcttgatcaaaatctggtttactgggatatatattatgtctctctctgtccccagctcccactccgatgtaagctccatgaaagggtgaaccttttgcttgtgttcacctgtgtacacccagtgcctgaaacactggctagcacttaggagtcaataaatgtttgttgaattaatgaactgtgaactttttagtcaatggcaaactaggttctaaatcagttaaagtgagaacagtagtcattcttctgttgtatttttgtgaaacatctaaacacgctgttactggtataatcaagcattaaatattctgttttttagggcccgaaagccctgaataggacttcctagcatcagatcttcctagcactatgcatatcaagctcagttacagaaggacaggacttacgggcactttctaatcaaaggactccgaaaatgtaggcactatctcttaaagttcttcagaaaacagtttcagattctacaaaagatttccgaagaatgtatcaacaccaaaaggaaaatcataacacttcactctgatatctgtctgagaggctagaagagtgctccttgattttttttaaaccaacagcatatcaacaaagaggccttctttccattctttgcttcaaataattttttcacatccgttattggtttgtattcgcccttaaaccaaaactaaacagatcacactgtctcatttaggacccccatacacaaagaatcagctacgtaaagatgaaaatcagcacaagctgaacgtgtcactgatgatttgtgtgtcacacataaatggagaaaaacataaaagagctattgtccaattgtagaaacaaaaaagtaatatggggttttctgttctctgaagtgcatcatgaaaagtgggtggagagaaacacagaaatccagaattagcctagcaaatcattttgggaagagctgacaacatgtaaattcctcacacataaagtatttcgagcaagagaccttgattcctgggctatgatgccattcaggattccttgcaaaggctctggaattccagtattcataaaagaaaatgctcattataatcggagcgtaagaggtactcccaacgtgacagcctgtatgaagtattacaaagcttacagttaagatctgggatagaggctgaacaccaaattcaaaagaggtaaccaaggcactaagtgccataaaggaggaaaggggaagaaaaaaaaatccactattgccactcagccacagagaattaaagtggaaaccaggggtgtgcatgggggaggatgaggggtgagaagtgcggggggtgtggtggaggaacaaacaatacatttgtcaccccgtcccacttcctatagaggatacaggcaaagcctccagcctcattacctcggacacagatggttatcgtttatagcaaaggtgcacaaaaaggccttcaggtctgagccccttaattccagggctgttaatgattaaagagaacgatgggggtggggagggaaatgagggcggagggagctgggagattcacccaccacctccccctagggctcctacctcacagcgctcacccaggacagaggaccagagtctgcaccccctccagggcagctccaaccccatatccccaggccctgggttgaggggtgctggcggtggggaggcagggacagtaggtaagttttctgagccctgcggctgacacgccacaggctcccctcacagcctcttctttcagaggtaccactccagacaacgcgctgacttccactcctccctttccacccccctttctcgaaggtacccaacccccgccccttcatctctcaatgcccccccgccttttcctcaactccccccctccccaaaactcacagctgctccagaggttcctccagtcaaaccctttctggaaacgacggcggcccggcgggtccaaaccacctaccatccccgctcgcgtttccaggctccctacccccgccgccgccgcctcttcttccaccactgccaccgcctcctcttcatctgcggcccaccggcggcggccgccccgaagccccgccccctccatcgcctcctgcatcatcacttccggtaaccccgccggccgccagctccaggagggagaatgggagaggggcaaggagggaacgagtggaagattgcgtcacgacgcacataaagacgtacgaagccgtcgccaagtaagggcaaagacctagcaacccggagggagctgggctggaccatttttttttcttgttttacgggaatggagcggggaggataatgaaagcgtaaaggaaaaatagggggaggaggagctcagcttattgttggatgcggcgggagatgggtagagtcagtcagtcgagactcccccagacctggaactggtgctcccacagaggtgggcccggtggtttggtccggcctggcctactggaccagcctgtgctcggtcggccacggctctgctgggctcctggcgccgcctcctcccagcccgccgcgggctgcgcgcttctgtgggtgggggaaggcaggactgacgcagagtgagtgtaggggatggaggcgccgactccaggcgcgggagactggcggggaaggggttggctccccacgggcagggatggtttggaggttgggctgcggcgttgccgggagacgggcctgtgtgaccccagcttcgcgggggcggctcggtgtcatcgccaccggcctcggggacctgcctcacggaagtggctcgcgcgtccaagaggggaggcctggtgtggggacgctcaggtgccggcgtggggccccctcggaggctgtgaatcttttggacccccgaatgtaaatgggagatggtaggggccggtccgggggcgagaggtgtctggctggggaacgttgacccacaccaggtcccgtacaggaacggagactccctaggaccgtgagagccagcttcgtaattctcttgctcttcaaacctgagagtagggtgttgctccgttaccttccattcgtgtgcaggagagagttaagtaaatcaataaagaaggtatcagcaagtgagaaatgccccccaaagaccggatgaggtgacagaagatggggggagggcccctcgaaatcgggtaaggtcgttcaaaggaggccacggttttgcggggatccgagacaatgggttttctgggtggagagaagagccaatgagaaggacttttaggttggaaacagccagaaggccatgtggctgaagcaaacagagccagggccggagtgccctgtgatgtagttggggaagtggcatgactgtagcagcgccttttagcccaaggcaggggtttggctaatgtgtaccttaagggttttaagaagggaagtgacctgacctgatttacatttttaaaaatccgctctgcctgctggatagagaagggtggaagtagttagacctgttaggagactgttgcactgtaagacaaaggagaggtgaagatagtgttgaaagggccggccgggcgcggtggctcacgcctataaacccagtactttgggaggcctaggcgggcggatcacgaggtcaggagatcgagatcatcctggccaacatggtgaaaccccatctctactaaaaatacaaaaatcagctgggcgtagtggcacgcgcctgtaatctctgctactcaggagaatcgcttgaacccgggaggtggaggttgcagtgagccaagatcgcgccacttcactccagcctgggcaacggagtgagactccgtcttaagaaaaaagaaaaggccctcagtcacagtggaaatggagagaattccattcagcatatatttgggaggtagtgcttgcaggacttgctggggaattggatgtgaagtgtgtaggagagggaggaaccaaggttaactccctacgggaaaacagtttagaaaggaatatcgaaagttctcttttgaacatattaagtttgataagtctattaacaagtcaaatgaagttgtcaagaagttagatatacaagtcggggaaaaatcatagttggagataataaataaggaaggcagggaggagctcccagatcacctaagaagagcgtgtaaataaaagaggaagacccctaaatcccttgggttcttaccatttagagagtacccagagaaggagaagccagcaaaggagacgacacagacaagacctcagagatcaaaggaagaggccccttaatatcctggaataatgggacccatccccgtaatcagtgaatctcatccacccgcttgccagcttctacccgcagcaagtagaagctaagtcctggctcaaatctcttccctccctccctctcccagctgtcagtgcttttggacttgtgctcaggtaatttgtgtccgttatagaaaacctgactttttggataaattgtctgtttatatggctgtctcccccaggtactgtttcttatttgtgtcttcctggctcctggtacagagccttgtccatatggtggttgtagctgggcaggaacactgtgttcataaggtatcagccatacaatccaacagcttctcacaaaaaggggcttttgtccctgccactgctgccaagcccaccacaattacgatcagttccacaatatagtgtaaagggtatcagaagatgaataagaaggcctgggtttcaatcctggatctgccactgaccagcagagtggccatggataaagctcttctctctgagctgaagggttggcctagatttgaagttgcatactgacaagacagatattgcctgcaaacatattgttcagcccacacagtgatttaaattcttttttaaatttacttgccaacatttaaaaattggacatcaaaatccagactttgggcttcatttgaaaaatccgacaatctgacaacaccagcctgaagttcctagaggttcctacacagcaactgtcagccagagctgaagagctgtctcccgtctatgtggctcatgctcagggtttgccaaaaaggcctctcctctcctgctacctggctgacccctgtgggcatttgatttgcaattcttggtctagggctgtgctatccctgtgtagccactgaccacatgtgactatttaaataaaaattcagttcctccaacacagtatgtttcaagtgccagtagctacctgtgacaggtgtgtgtcctattggacagagcagatagaacctttccttcacagaaagttatcttggtcagcattggactggaggaactcgagggtactatgtaggctagtcattctccgcatgtgaaactcaagggacttagcctactgaggagctctggtgcctctgcagatgggaaagttgcgcattcagtagttatttgatggtggaggaagctgtcctgaaggcctggacccctgcacagaatgtggttatttatcagagagttggatcaagggtcaggtgctagaaagccccaactgtatctagtgtggcatgcaaagctctttggtcagtttcctaatccagttcctcagaaaactataacaaagcaagaacttaagtcagtgtcttgtgttctcagacttttcgatttgatatgaagggtgaaagatcctggctggggagttatgaatgaatgaatgaatgaatgaatgaatgatctttagcattggccttcaattccagcccccccaccacatctcttccactgccttctactactagtaactggtgactgctttttcaccacctctgactgacccgtaccttttctttgcctgttaaaatatgctaataaggaaacatacttccatttcttttgaattgaggggcccataacttttcatttagaacttctatccctgatgggaaaaatagctgtatatctattggttgttatcttggttacagtagcctgattggagttcccctgtacaaatataatcttgtgtgcgctccggtgctggtatgatatatttagaatgggtgtgcttgcctcctgtgatcttgtttgggatagacattttagaagtctttcagacattttttgttttggccccgtgttctaaaaacttcccatattacagggcctaaactaaattattttcccttaggtaaaataaaaatgccatccaccctctcctccctgccccctattgctgacagaccatattcttatcattttctgtgtaaaaagatgctgtttcataaaatagctgcggtatgattaagtataccacacaagcatatcctgaaatttgcaaaacagtgtgtggcatgtgaggcattacacttccctttttggattctagtaaccaaaaactgaatctgaaacaggaaataagtctgtggttgtgtgtgtgtgtgtgtgtgtgtgtgtgtgtgtgtttaattgataggaggatatgggaccagaaatgtatggagaacaatttcacttaaaggttattggattggggtaagaatatgggtgtacaccaaaaaggagggagtataacagatctaagagaaaagtgccctgagggataaacaaggagtaagagataaaggaagaaaaataggaagggaagcctggtcatgcctttggtgttggcacctgcattatatttccagtaagaagtatgcgctgtggtctgaagataagcggtgcttccaacagggttatttactcataccaaagaacaatagtcctttgctgtacagggattattaatgatcagagggaaacagctttaggaaaatccattactaccacaaagcaataaattcaccaacaggccacacatttctctcctattcagacaaagcttagcatagataaaagagacctcgttgttcttcctctgtttcctcctattcaggtaacatttgcctttgttaactctcagtgctaagtgatgttacatggattatttcatgaataatccttacgactctgaaaggggttctgctattaccccattgtacattctaagaaaccaagtctcaggcagttaataatttgcccaatggggtaaagtcaagattcaaacccagccttgtccgcccagagcccaaaataaatgttcatttattttgtattatatctgctattccttacaaatgggacagacattccctactctgctatacagggcaagaacatctggttgctctgacattagcaagagcatttcaattctgtagaggttttccaaatgatagttttaagtcacagttttctagattgattttaacccatgatcattgagtatagtggaccttattccccaaaaggattttttcaggaaaaaagtatcagaaccccattcttctatgtttggttctaaacttcatggaaatattataaggtatttcagtccagtggacaaaccctaaccagccttaagaaaacttaagagtgagggttacatcatagctgtgtctcttacgctgttctggatgaaactgatgaggattcctccccaagtaacactgagtctccagttctttatcctgacacacactgctcttgaaagcatcctagtaagggttaattagtatttaacccttcaatgctctgggatcatcagttgggaagcttgtccagataccatcgtgtgtatctcaggatgagaacatacgttatcaatgaccattctgtgtgtgtaaatttattcttctaatacatatttgtcatgttccaactatgtgccagcctaggcatgtaatgtacaagacagtcccaaatctccccctgctctccccacctcctactccctgcaacacacacatggtggaaaaagaaaggtaagtcatgcaaaattatgatagagtaggatgaacattatgacaggggtatgccagaggtgccaggagtgcacatagccgggacactgacccagccccagtgtgaaaagggcacccgtccagaagtgatggaagtcaaaaggtggaagcagcaaataggcaaagaaagggtatttcagttgtatgaagtagagaggcttcctatggcaaaaagagggacattgcacatacagaagaccatgatctcatttgggtggagtttatgattccccctccttgctaaaaaatcataaagtacttgggagagaaatttgactatactacggtcatgagttctgatgagggaaaaaattccacctaggggtaggtctttcctgaaataaatggaaaggggtgtttaacttcctggggcttgaaaatcagggtaaattcctcttgcctttgtcccatttcttatttgtactgcaacacattttctttagaaggcaaagcctcatgagagtccagcatttggaatttggacattcctgagaccagagtcatacttctataaatctcagctggggaaagggaattttcatctctgctcttaaattcctaagtgttcatgctgcaatggtctttccaaaggcagaggaactgttccagaggtggggtaaaagggcacagtggatgaggcccctcataccagcagatctttccatagtcctcctgtagaaacaccaagtgtctgggtatgccttgtacagtaagttcttggaacctccccagaccctctcactgcactttggacagtgagtggcagagtgggtgggtgtttggtgtttggtttttgtttttgttttttagactgatcgctgcccattatgagtccccattactgactccaaaatagaaaagcttgtggtcagtcaggaaaatgatcatccagcttttttggctcttgaccctgactcctgtcaactaattaggggcattaggcaagatcttgtttcaccatctgtacaagtgttggaattataagtagttatgatatacagtagtttgatatacagtgtatttaaaaagatataaatcagaccgtgttactccagcttgcataaaatctaccagtgtcttttgcgcttaagaccagaaacaaagtgcctttccaaggcctacccccaacctgtgctggattctgtggacctgtggcccctttcccaaaggctcttgttgcattcatgttcatcttttttattttcattttttgagatagagtctgactctgttgcccaggcttgagtgcagtggcgtgatcatagctcactgcagcctttatcacctgggctcaagggatcctcccacctcagcctctgaaagtgttgggcttataggcatgagccaccatgcctggctaatgtttttatttttcaatggagatgggatctccccgtgttgcccaggctggtctcaaactcttgggttcaagcaatcctcccacctcagcctcccaaagtgctgggattacaggcatgagccaccatgccctgcctcatgttcatctttgaagtcgattcccacgtcacatcctttgctcctgttgttccctctacttgcaccagcttccccttacctgggtccgttattaggttccatcacaccattcaggactcagctcaaatgtcactgaccacccagaaaataacccccacctctggtcatttgtatcttattactcttcagagcacatatgactgtctgaaattcttgttcttgtacatcatctgcctatgccactagaatataagctcaaggagggtagggaccatggctgcttatttatcactgtatccccagaaacggcaggtgtctggcacatggtggaccttcaataaatgttgagtgagtggatggatggatggatccttggaagggaagagtaaggcctaccaggtagtagcactgtagtgagcccctgcactggtggcttttatgttggctccattggagtcagaggggacagggttgccacggggaatggaagagcaaagcggtgcagccatgtgcccagcctgcttagagcatgctggtgtgtaacataattaaaaagggcggttgcaggttaggagcaggggcaggtggcaaatggggaaggctattggaattcacatcaatgtgcaaaaaaattgcttcctttgctctttgtatagaaagggactagaattatttagttccctttgtcacaactagctaagctctttaaagcaatcaacagacattcaacatttattgagattgaacagtgtatttcgtgattaaaagcatgggctctgacttcagaccagctgagtttgaatcctagccctgcctattgttagctgtgtgaccttggacaagttacttagtctctgcatcaggttcctcctttgtaaaatggggataatggtagtatctgcatatatagagtacctagcaaattatctggcacacagtaaatgcaaagcaaatgtaacttttaatatttttcttactgtaatgaacaagatacaatccctgcccttcaggaattcagactcagagaagaaaaaacagagtgaaagaaatgcagaactatctgctggccatgatagaagcaaggaaaaggttgctttggaaaagcttaatagcaagtaggtgtctgtttgatggtgtggggtggctagcagaaaggagacattgtaggcagaggaagactcagccaagacagacagaagtatgacatggcaaggcaccttagagcagtagctcccaaacttcagagtccacatcacagtttttgctgtttacctatattttaaactagcttaaaaagttttctaattcatttctttaaaggaagctgtatatcacataaaatctaaatcactcaaaattatgggtttgatgggcttttctaatatacagtttgtattgtatatctaagatcacctccccaaccaatctttgggacacttggcattaggggacacatctcttaactatgaccagaggccacaacacactggcagcaacatctgtcagccttttcttagtggcacaggcctgcacatcacagaggcttggaaatgatcctcacctccacacatgtatatccctgtgttataacagggcgtgatttttaagaaaagagaccagcttctagtcccatttctttccaggcacacctcatatcttctgtctttcttcattctgggatttgggggttagggagatgaaaaggagtaaagaattggaagaaatgtcggtctcagaataaagattatagaaggttaacttttaaaaatctacatggatagacttcgtgaccagctgagaccgcagttgaattgtggtcctctaaactactgaatattcctgatgtattgctggtaagaaaatcccagcagaccccattgtatcagatcaacccctgatgtagtgaagaaggaaaagggcttccttagtcttgcattaattgtgagagataattgatagttttagagcaataaatgttggtttcaagccattaaatccatattcgggaaaagctgatttttctaaataagttgctttctaggaacaaagacaaaaatataaaaaggaaaagagctttttaaactttttaaaaaatatatggctgattctgtttctagaatcacaaactttctatagcacaggatactctcaattattcagcaaacatttattgaatactgattatatacctttctaggtgctgagaattcagcagtaaagaagatgaatgtgatcattgtcccccataaaaatgagagtttactgggggaagactttaacaaaccattacttaagtgaggagtgctatacaaacaagaatattaggacctgtgagaaggttcaacagagagccccaacccaatgggtgtgagggaagcaggaagattttctgagacatccatattttcactgggaacggcaggatggatagggttggtcaggtaaaagggaggggttcaggggaaagccttctagaaagagaaaactgcatggatatgtgcccctaaggcaagaaagaacatggttccctcaaagacctgaaacaaacccagtaagaaaagaacaaaagaaacatttttcttttcttgccttttctctcaagacttggaaggaaatggtaggctagatttaataggacacaatggtgaatacagctttagacccttctctcagga

SEQ ID NO: 1243 - DNA, 44251 bp, Homo sapiens
catggcccagtggggcggtgtctttgtacaaatccacacacgtcctcccctgtgctccaaattgtgagtgcacatccccaaagacttttttttttttttgagacagagttttgcccttgttgcccaggctggaatgcagtggcacgatctcggctcaaccacaacctccgcctcccaggttcaagcaattctcctgcctcagcctcctgagtagctgggattacaagtatgcaccaccacgtccaggtaattttgtatttttagtagagagggggtttcaccatgttggccaggctggtctcgggctcccgacctcaagtgatccacccgcctcggcctcccaaagtgctgggattacaggcgtgggccactgcgcccggcctccccttcatacttgactatccctgtgtcataaggactcagaatctgagggttttgtcataattatacacagtctagaagaccaagccacacttgggttggcagcatttaagctgctgggtcatcctgcaaggaggcatatttgtgaaactggatgaagaaaaagtaggaaaagctacctactttttaagctcaggaagcattttataagatttccaaggctaacagctgcagcctcctctagctcctctagctgggttgactgtagtccctaaaaagatacgtccatatcctaatccccagaacctgtggatgttattctatgtggaaaaatgatctttttggatataattaaaggtttgtttttggcaggtgcagtggctcatgcctgtaatctcagcactttggaaggccaaggtggggggatcacctgaggtcaggagttccaggccagtctgcccaacatgatgaaaccctgttgctactaaaaatacaaaaattagccgggtgtggtggtgggcgcctgtaacccagctactcgggaggctgaggcaggaaaattcctggaacccgggagttggaggttgcagtaaaccgagattgcgccactgcactccagcctgggctggacagagcgagactccatctcaaaaaaaaaaaaaaaaaaaaaaaggtttgtttgagacaggatctcaatctgtcacccaggctggagtgcagtggcgtgaacatggctcactgcaaccttgaacttctgagctcaatggatcctcctacctcagcctcctgagtagctaaaactacggccacatgccatcacacccagctaatttttatatttttgtagagacagtatgtcactgtgttgcccaggccagtctccaattcctgggctcaagagatctacccatctcagcttcccaaagtgctgggatcacaggcttgaggcactgcacctaacctaattcggaatttttaagtgaggtgatcatccaggattatccaggtaggacttaaatccaatggcaagtgtcctaataagagtaaggcacattggccaggtgtggtggctcacacttgtaatcccagcactttgggaggctgaggcaggcggatcacttgaccccaggagttcgagaccagcctggttaacatgctgaaaccctgtctctactaaaaatacaaaaattagctggttatggtggtgcacacctataatcccagccactcaggaggctgaggcacaagaattgcttgaacccagggagcagaggttgcagtgagccaagatcgtaccactgcactccaacctgggcgacagagcaagactttgtctcaaaaaaaaaaaaaaaaaaaaaaagtgaagcacataccaaaaagagtaaggcaagccagcgtggtggcccatgcctattttgccagttacttgggaggctgaggtgggaggatctcttgagcccaggagttcgagaccagcctgggcaacacagtgagaccccatctctaaaaacaaacaaaagagcgaaggagaaggaggtcagatacagagaaatagatgcacagaggagaagatcctgggaaaatggaggcagagattggaatgacaggctgtaaaccaagggatgctaaagattgctggcagccacaaaagctaggagaaaggcaaggaaagattcgaggcttggtgcagtggctcatgcctgtaatcccagcactttaggaggctgaggctggaggatcacttgaggccaggaagttcaagaccatcctggttaacatctctacaaaaactaaaaaaaaaaaaattagccaggcatggcagtgcatacctgtactctcagctactggggacgctgaagaaggaggatcccttgaatttgaggcttcagtcagctgtgatcatgccactgcactccagcctagatgacagaacaagactccatctcaaaaaaaaaaaaaaaaaaaattttaccccggagcctggggagtgtggccctgccaacactttaattttggatttctggcctccagaactgtgagagaatatatttctgtcatttgaagccactcatttacagtaactggttacagccaccctgggaaacgaatacacctggtctctgctgtggtgctcagtgttaccaaccggtcctcactttcccagttcttagctgtgtccctctgcaaatcttagcacctctctgattttcagtctcctcctttgtaaaacgggaagagtaagtcctactctgccaggttgttgtgaggccatggtgacagagtgctgagcggaatgccaggtgtaccacagacgcaacttacgcatgagttcccatcctcccccttctccaccctggtccaacctcaccttgggcacagagctcccattgcaaggctgaggagcagggttcctataccttttcctgggactcgggttcattggtgatgtccagaatagtgcatgaccctgccttcttgacaaatcctcccagacatctcatcagcatctcaaatccaatgtgtccaaaggtgaactcttgatctttccttctttttctgtctctttcacagtttacctcatctcaataaatggtatttccaggtagctaaacatctggacgtcatttttgctttcttttttcttttctttttttttttttgagacagagtctcactctgttgcctgggctggagtgcagtggcatgatctttgctcattgcaacctccatctcctgggtttaagcgattctcctgcctcagcctccaagtagctgggattacaggcatgcgccaccacacccagctaattttttttttttgagatggagtcttgctctgttgcccaggctggagtgcaatggcgcaatcttggctcactgcaaactccgcgtcctgggttcaagcaattctcctgcctcagcctcctgagtagctgggattacaggcgcatgccaccatgccaaactaaattttgtaattttagtagagacgggatttcatcatgttggtcaggctggccttgaactcctgacctcatgatcttcccgcctcagcctccaaaagtgctgggattacaggcatgagccactgtgcccggccgtgatgatggtgttgtgttttgttttttgtttttttttttgagacggagtcttactctgtcgcccaggctggagtgcagtggtgtgatttcagctcactgcaacctccgcccctgagttcaagcgattctcctgcctcagcctgccgagtagctgggattacaggcacctgccaccgtgcctggctaatttttgtgtttttagtagagacggggtttcaccatcttggccaggctagtcttgaactgctgacctcatgacccacctgcctcggcctccctgggattataggcgtgagccaccatgcccggctgtgatgatgtttttctcttggtttatcatggccacagagtagccttgtctggtgttcatgtattgtgaaattatttacttcagtggaacatcaaggcctagctgatagtaccaggcccactaccacatgccagggcttcatttcctttctcagaactcacacccgttcccaaatgttaccaagctgttccttgcctaagaggctcttttccattccccagccaaacactacttttttcaagtcaaactgcacaaaattccatctctcctgtgaggtcttcccaaagacagtgaaaccacctttgcaatattataactgatacagtgaaagtgatctaacttaaccaactccatcttgtttttaacctccaagctgtccttgttcattcctgggcgtaggctgaactaactttgggagaaatttatttataatttacagtgaaacaaagacaatggctgggcacagtggctcatgcctgtaatcccagcactttgagaggccgaggtgggtggatcacttgaggtcaggagttcgagaccaatctgaccaatatggtgaaaccccgtttctactaaaaatacaaaaatcagctgagcatggtggcgtgtgactgtagtcctagctaccagggaggctgagacaggagaattgcttgaacccagaaggcagagattgcaccgctgcactccagcctaggcaacagagagagactctgtctcgaaaataaatacatacgtacatacatacaatacataaaacaaagacgataacagccctttcccaaagcagaccatcttccttcttgcctagggactaggttgcctctgtaggactaacattagctgcaagattataaataattatggtttaggagtcatgcagctggaggatacaagattctgaccctccctaaactgctcctaagatcagtgcttgagatattttgcagaccctgcacttgatggatcagctggccccacccaggtcgataaactggctcacctgatcttgtggcccccatccaggaactgactcagagcaagaagacaacatcgacggcctatgatttcatccctgaccagtcagcactcctggctcactggcttcccccaaatcaccaagttattcttaaaaactctgctccccgactgggcatggtggctcatgcctgtaatcccagcactttgggaggcagaggcgggtggatcacctgaggtcaggagttcgagaccagcctggccaacatggtgaaaccccgtctctactaaaaatacaaaattagctgggcatggtggcgcatgcctgtaatcccagctactctgggtgctgaggcagaattccctgagcccaggaggtggagaccgcagtgagctgagattgcgccaccacactccagcctaggtggcagagcgagactccgtctcagaacaaaacaaaacaaaaaaccaaaacaccaccaccaacaacaaaaactctgctcccccaatgcttggggaaactgacttgagtaataataaaactccggtatcctgcacagctggctctgcgtgaattactctttctctgttgcaattcccctgtcttgatgagttggctcaggcaaagtgaaccccttgggtcgttacaacagtactactgtctccatagaattagctttcctgagtgcatccaaaaatcttaattggtgaccaggcatggtagttcatgcctgtaatcaaagcaatttgggaagctgaggctagaggatggcttgagcccaggagttcaaggccagtctgggcaacatagtgagaccttgtctctataaaaccaaaaaccaaaaaccttggtgggcatagcatacttagtcttcaaatgtgtacctaccttgaagtattttacttgtttcacatatatttttattcagttcccagtaggttgtaaatcttttagaggcaaagtccatttcttacacttcaatatcccctgcaactgagcaccctgctgaaggacaggttggtcttagttggcatgttggttggtctgaataaggggagggggcgaacagtttgcttctgcaacacagctctgaaaacacagctctaggctagcaggggagaagctcccagcttgcccctttcccaggcaaaaccatttcttttttttaatttttaattttttattttttgagacagagtcttactctgtcgtccaggctggagtgcagtgatgtgatctcagcctttttgtgtttttttttcttttttttgagacggagtctcactctgtcacccaggctggagtgcagtggcgcgatctcggctcactgtaagctctgcctcccaagttcacgccattctcctgcctcagcctcccgagtagctgggactacaggcgcccgccaccacgcctggctaattttttttgtatttttagtagagacagggtttcaccgtgttagccaggatggtctcaatctcctgacctcgtgatctgcccgcctgggcctcccaaagtgctgggattacaggcgtgagccaccacgcctggccgtgatctcagcttactgcaacctctgccttcccggttcaagcgattctcatgcctcagcctcctgagtagctgggatgaccggcacgtgccccatgcctggctaatttttgtatttttaatagagaggggtttcaccatgttggccaggtgggtctcaaactcctggcctcaggtgatctgcccacctcggtctcctattgggattataggcgtgagccaccgcaaccggccttctaatttcccttttggagcattcattccgttgcaagagcttatttaatttttatttatttatttatttatttatttttgagacagagttttgctcttgttgcccaggctggagggctatcacgccatcttggctcaccgcaaccttcgcctcctgggtccaagtgattgtcctgcctcaggctcctgagtagctgggattacaggcatgtgccaccatgccctgctaattttgtattttcactagagatgggttttctccatgttggtcaggcaggtctcgaactcccgacctcaggtgatccggccgcctcggcctcccaaagtgctggaattacaggcgtgagccactgcgcctggccaatttttatttatttatttagaaacagggtaaacctctgtcatccgggctggagtgcagtggcacaattgtagctcactgcagtcccaaactcctgggcttaagcgatcctcctgccttggcctcccaagtagctgggactacaggcgtgtgctaccgcacctagctaagttgtgtattttctaattttttagacaggggtctcagtattgctgaggctgatctccaactcctgggctgaagcgatcctatcctcttgccctctcgaagtgctgagattaccagcatgagccaccacactggaccaagagttgattttggtaacatcttctgtccctatctgtctgaaaaatccttgagagtaggatctaccattaatgcattaaacaaattattattttttgtttgtttattttgagatggagtcttactctgtaacccaggctagagtgcagtggcgctatctcagctcactgaaacctctgcctcccaggttcaagtgattctcctgcctcagcctcctgaatagctgggattacaggtgcgtgccatgatgcccagctaattttttatatttatttatttttatttttatttttttgagttggagtcttgctctgtcgcctaggctggaatgctgtggcatgatcttggctcactgcagcctccctctcctcggttcaagcgattctcctacctcagcctcctgagtagctgggaccacaggcaagtgccaccacgccccagctaatttttgtatttttagtagagacggggtttcaccatgttggtcaggctagtctcgaactcctgacctcaagtgatctgcctgcttcatcctcccaaagcgctgggattacaggcatgagccactgcgcctgatggtatttttagtagagaaagggtttcaccatgttggcccggctggtcttgaactcctggcctcaagtgattcacctgccttaggctcccaaagtgctgggattacaggcttgagccaatgcgatggcctaccattaatgcatttttgtatatctcctcccacccccacaaactgtcaggcacggggcttagtgggtggaggaaaggcccagcaatgcctgagtaagcccaactcctgcctgcctcttcgcagaaactagggtgcatccaaactgtctcttctcaggctaggcaggacagcgcggcctcacctgtgaaccttcaagacttggactttggctgaagcgagggcgtaggagttctaagtaccgctggctgcacgccctctggcccatcacgtcccaggctgctcctaggtggacacccaacaggttaggcaagtcttagttaaaagcagtgagaggccaagaggctgggcatggtggctcacgcctataatcccagcattttgggaggccgaggcaggcagatcacaaggtcagaagatcgagaccatcctggccaacatggtgaaaccctgtctctactaaaatacaaaaaattagtcaggcgtggtggtgtgtgcctctagtcccagctgctccggagactgaggcaggggaatcgcttgaacccgggaggcggagattgcagtgagccgagattgtgccactgcactccggcctgggcaacagagtgagactccgtctcaaaaaaaaaaaaaaaaaaaaagcagtgaggaggctgggcacagtggctcacacctgtaatctcagcactttggcagaccgaggtggatggatgccaggagttctagaccagcctaggcaacttagggagactctgtctctacaaaaaatgcaaaaattagctgagtgttgcggcgcgcacctgtagtcccagctactcgggaggctgaggtgggaggatcgatgtccaggaagtccagcctgcattgagcccacatcctgccactgcactccagcctgggtgacagagagaggccctgtctcaaaaaaaaaaaaaaaaaaaagaaagagagaaagaaagaaagaaaaaataaaaacagccaacgaccaaacaaataaaagagcagtgagaaccagacacggtggctcatgcctgtaatcccagcactttgggaggcagaggcaggaggatcacttgagcccaggaggtccagaccaacgtgggaaacatagcaagaccttgtctctacaaaaataaaaataaaaaaattaggcttggggatacaggtctgcaagcctacttgggaggctgaggtgggaggatcagtgaaacttgaggtcaaggctgcagtgagctgtgattacatcactgcactccagcctgggtaacggaagagagacactgcctctaggaaaaaaaaaaaaaaaaaaaaaaaaaggcaaggagttccaatcattctcccttcacagagaagcagcttggattcgatgggactgtagtttctggaatccgactgcaaagctgaccgctggtagagcccagcttctaacttaggaaaggcactagctctctacaaagccgccactccccaactacaccctgtagggaccagccaatcccaaagcccgagcgggcgtcatcaccaattgcaaggcgggagacagagccttggctggcaccgggcctcctccccggacccgcagaggcctggcagcgccgcgtttgaggagggttcgtgtcaggaagtcaaggctggatgatcgcttaagcccaggagttaaagaccggcccggacaacaaagcgagaccccgtctctccagaaaaagaaaaaaagagagagagagagagaaattagccgggcgtggtggcgtacgcttgtagtcccatctacttaggaggctgaggtgggaggatcgcttgagcccaggaggtggaggctgcactgagctatgatcgccccactgccctccagagtgagcgacagagccagaccctgttgctaaaaaaaaaaaaaaaatccataaagccggggaccatctttgctccagggaggtcagctgacccgggctggcactggccctggcgcagttcccgcccctcccgggagcgctggcaccgccccttggcaccaccccctccccgcgcccccgccttccaggaaggggcggggtctccgagacgggtggggccggagctccaagctggtttgaacaagccctgggcatgtttggcgggaagttggcttagctcggctacctgtggccccgcagttttgtagtccccgccttgtttctccccagaggcctctcaatcctccctccatgatcttcgcatagagcacagtaccccttcacacggaggacgcgatggctcccaagaaacgcccagaaacccagaagacctccgagattgtattacgccccaggaacaagaggagcaggagtcccctggagctggagcccgaggccaagaagctctgtgcgaagggctccggtactgcctgtgcctgctgcttgaatatttccgccttttagggtgctcgcgcaggaggctgcagcgggggatgggtgctccgaggctcccgaggcccgcgcaggtcacgggtgcctccggctgtgcattctacctgcaggtcctttgacaccagagtgtttaggtttcaacacctctcccgctaggtaacaggaagcagatgagctccgtaacaacagacacacggacttgtcagattccttgttcgtatcagggttcttgcacagttaggacggcttcagagaatcctacctttcctggcgctgtgtgtgctggatttcatagtcacgcttgttagctgcacgtcctcggtggtcagttgtgagagcccccaattccttcctccttagaaagctcattctctgaggtttactggggcttgaacctggggctataaggagtttcgagacactcaaaaacgagctggggcttgttaatcaagtggtttttgtccatgagaagaaagaattggttgtcaagacgtcggacctatagtgattgggtcctcaaatacagtttggtgatcaggagttgttgctttattgctattctaatttcacttacctccccagaagtaacctagttaagagcatttccaggccttcctattccttcttttcctaaacggtgacttctgccatgctgccctaaaatctttttattgtgcattatatgtgatttataaaattgtgacccagtcccatctcgagttttgcagcccaaactgggaagagttctgcattgtactttatccttgtgtgtttctttggctggggtctcaggaaccctgcacgactgtatttactttcacttcagacttactgtttgtgggagtgttttggggaaggggccaaatcctcactcatttttttatttctggtgctcgttgagaccacacagacatggaaaggccgcaggaggtgatgagacagagattaaccgtgccgaatgaaacaaggcttcctttcggggaattcagcagaaaaacctttcgtgagattggagaggaaaatatgtctgttctgcttggcaggtcctagcagaagatgtgactcagactgcctctgggtggggctggctggcccacagatcctgccaccatgccgcagcatcgtcaggaccctccaccagcataagctgggcagagcttcctggccatctgtccagcaggtaaggcattttttgcctcaagtcctcaagggtttacacgtgcatttttactattgcatgctcccaaattagatgatggcttggttcaccagcttgtcagagtggtccgatcacccagactgtggtgactggcctactgggcactcagccaggtaaaaaatgtcttatgttgtaaaggtcccagctggaatgcactctgccccttttgctttccaagattattcgttcgtgtacattgcaaatattttcatgcacagggcaggcagttagctttcctttggtgggaggacttggatctagggctcatccatgaaggaggcagagattggcagtttacccagaacttgggttttaattcaacctaattcatttctctctgtggcaggggctccagcagtcctttttgcacactctggattcttaccggatattacaaaaggctgccccctttgacaggagggctacatccttggcgtggcacccaactcaccccagcactgtggctgtgggttccaaagggggagatatcatgctctggaattttggcatcaaggacaaacccaccttcatcaaaggggtgagcagttccccatgccaggtcgtgctaaagaagtgtttgttggctgggtgcagtggttcgcacctgtaatcccagcactttgggaggccaaggtgggtggatcacctgaggtatggagtttgagaccagcctggccaacatggtgaaaccccgtctctactaaaaatacaaaaattagctgggtgtggtggcaggcgcctataatcccagctactcaggaggctgaggcaggagaattgcttgaacccgggaggcagaggttgcagtgagccaagattgcaccattacactccagcctgggcaacaagagtgaaactccatctcaaaataataataataataataataaaagaaaataaaaataaggagtgtttgttgaaggcatgaaaggaatattgatgtcatccagtaatcatcaggaagaggactgggatcaaaattaactgtgggcattttcaaatacgtaaatgatgatgatatatatttttctaatgcctgtccttaaaatactagaagatatagactattgatcacccatagaattgaagccccttctgggctgggcgcagtggctcaggcctgtaatcctagcactttgggaggccaaggtgggctgaccacgaggtcaagagatggagaccatcctggccaacatggtgaaaccccgtctctactaaagatacaaaaaattagctggatgtggtggtgtgcgcctgtagtcccagctacttgggacactgaggcaggagaatcgcttgaacccgggaggcgaaggttgcagtgagccgaaatcacgccactgcactccagcctgggcaacagagcgagactccatctcaaaaaaaaagaattgaagccccttcttaccacattgacctcatcttacgccattgtcttttctcacttctatgctgtagccacaccagctgtttctattcctgaaaccgggtctctgtaattgctgttccctttgactggagtgcttttcccccatggtcttctcatggctggcgtcttctctgcaggtctttgctgattctacctcttcaaagaggctttcgctggttgtccttactcataacgtagatcccactcctccaccgtcattccctgtatcattaccctgcttcatgtttcccccaagtgttgatgggtgtctgagatctgatgcttatttgtatgtttgcccactgatggcagggacctttcctttctggttcaccatcctattcccagtgcctggaacaaagtttggcctagagtagctgctttatatttgttgaatgagtgaggggcttgaagtgtaattgagcagatgggatgtatacatacgaggtaattaacaatacagatgccaagtgctacagaatgtgaaagaaggaagaaccccttgtgaattggagtcaataaagaagactccatggatgagcgaggaggagcagtattagataaatggagagaaaagaaggaaagacatagtgtgactgggtgaggtttggcacagagttcttgggaatggtctttgttgtgctagagtttatcatccattgctgaggggtgagtgtgtcgtcccctctaggacctttagccagcccagctggtggctgacattggagggctgtgctgtgaaaagtgacactgggtttagagcaggagtcacaaacttatagggctccagaagccagagtggaaaaaaaaaaaaaaagaatgtatggtggtagggtcaggggtaaactagagatgactgttgtgcaaaaatgtaggtcttttgatatcagatgtgatttttctcaaacaaagacacaaatcctcattttttaaatgtcatatatcttgagttttaaaaaaaattgtaaaatacacgtaacataaaatgtatcaccttaaccatttaaaagtgttttttttttgaggcggactctcgctctgtcacccaggctggagtgcagtggcgcaatcttggctcactgcaagctccgcctcccggattcatgccattctcctgcctcagcctccccagcagctgggactgcaggtgcatgctgccacgcctggctaatttttgtatttttagtagagatggggtttcaccgtgttagccacgatggtctctatctcctgaccttgtgatctgcctgcctcggcctcccaaagtgctgggattacaggcgtgagccaccgcccccagccaactttttaaaaaataatgataaaatacatataacatgaaatttactttcgtaaccattttaaagtgcacagttcaatggcgttgggtaaattgtgtaagcagtctccagaacttcattatttttttttatttttattttttgagtctcattctgtcacccaggctggagtgcagtgacacaaccatagctcactgcagcctccaccttcctgactcaaggaatcctccggcttcagcctcccatgtatcagggactacaggtacgcaccaccatgcctggctaatttttagagatgtggtctctctatattgcccaggctggtctcaaactactggcctcaagcaatccttctgtcttgtcttcccaaattgctcgggattacagggctgagccactgtgctgggcctctagaacgtcttaatattggcactgaatgaaactaaacacacgtctcagccgaattctgcttcagtccactatttttctagctctggtttaaaggtagacatgagggggaacccaggaggaggtctctttatttatttatttgtttatttttttgagatggagtctcactccgccgcccaggctggagtgcagtggcgcaatctcggctcactgcaagctccgcctcccaggttcacgcgattctcctgcctcagcctccgaagtagctgggactactggtgcccgccaccacacccggctactttttttatattttttagtggagatggggtttcaccgtgttagccatgatggtctcgatctcctgacctcgtgatccgcccgcctcgacctcccaaagtgctgggattacaggcgtgagccactgcacccagccagcaggaggtctcttaagtggagggatttggagagcagaccaccagaaaaggccaggttagacaggtgtgggagactggaattcaaagtgtgagatgggtgttcaaggaacaagtgccagaagcccccagaaaggcagtcagaggagtgccgcggacagagtggggtaggtttcctgcccagctaaagaggcaggtgaccgctaataaggcagcttgaagttgaagtcagaacccagagctcagacaggaagaaatttgttttcttgttttctccaggagtctaggacatgggaatagaggaatttagcttatgcctggagatgggaagaagcagtgtagggtattctaggggaagagcttcctgactaacaggataatgacaagtgctttgaacttgtgccagactgagattgctttttttctttgttgcatcaccttatgacatgcgtgtaaccttctttacagtgtaaactttctttacactgtaatgaagattggtctaggcattgaattttgtggcttgcatttgcagggagctaggttggagcagaggaagggtatggcagtctggaagagacctgtctggttttactcccagatgctgacagcagaatgctgatttgagaccagttactggaggagcaacagtgcctcattttgtcacttctttagtcatctgaccttggctgtgacctttacattcttcaggcccttggcaagggaacatgtattacagtttcacaatgaagatagcttaattttattcctattataaaaacaatgtatggggccaggcgcagtggcccacgcctgtaatcccagcactttgggaggccgaggcgggtggatcacctgaggtcaggagttccgagaccagcctgaccaacacatagtgaaaccctgtctctactaaaaatacaaaaattagccgggagtagtggtgcacgtctgtagttccagctactcaggaatctgaggcaggagaatcacttgaacctgggaggtggaggttgcagtgagctgagatggtgccactgcactccagcctgggcgacacagtgagactccatctctcaaaaaacaaaacagtgtattcttatcataaaatacagagaaaagtgtaaaaaataaattaaatatgatccaaaatccccattttcagcatccctctgtgcatgtgtacactatttttttttttttccaagtctgagtcttgctctgtcgctcaggctggagtgcagtggtgcgatctcacctcactgcaacctccgcctcctgggttcaagctattctccttcctcagcctcccgagtagctgggattacaggcatgcaccaccacaccagctaatttttgttttgttttgtttttttaagacagagtttcactctattgcccaggctggagtgcagtagcacgatctcggcccactgcaacctctgcctcctgagttgaaatgattctcctgcctcagcctcctgagtagctgggattacaggagcctaccaccatgcccagctaatttttgtatttttagtagagacggggtttcaccgtgttggccaggctcgtcttgaactcctggcctaaggtgatccacctgccttggcctcccaaagtgctggcattacaggtgtgagccaccgtgcccagcctgaattttatatttttggtagaaacagggtttcaccatattggccaggctggtctcgaactcctgacctcaagtgatccgcccgcctcggcctcccaaaatgctgggattacaggcacgagccactgcacccggcctgggtttttaaaattatatctttattgaggtatagtggacataaactgcagctatttcaagtgtacaatttggctattctcagcctatggggtagtcctactccagagaagcagtaagaaaaaaagaataaattgtacaattccatgagttttgacatatgtgtacaactgtgaagccatcaccacaattaaaataactcccatttccccaccctttgttgaatatttggagagtgatagatagatgagttatctatgcccctttgtaatccacccctctctacccaatatcttattcactgtaaactgctgatctattttttatttttagaaattaatttacattttctagaactatatataaatagaatcatagaatatatggtcttttatttttgttctagcttgtttcagtataattatttgaaatttatctacatttttatgtgtagttttttttttctttctgaataatggttcattgttttttgttttaagacagggtcttgctgtgtcacccagggatgatcatggttcagcatagcctcaacctcctcagctcaagcgattctcccacctcagcctcctgagtagctggcactacatgcacaggccaccatacctggctaattttaaaattttgttatagagacagaggtctcactgtgttgcacaggctggtttcaaactcctggcctcaagctatcctcctgccttagcctcccaaagtgccgggattataggcgtgagcccctgcacccagccacattgtactgatatgatacagtttattcatttacctgttcaaggacatttgaatttttttctagtttttgaatgcaacatataaagcgactgtgaacattcacgtacaagtatttgtgtggatatatgttttcatttttcttgggtaaatacttagcagtggaatggctggattatagagtaggaatgttttaaagatactttttaaatgagaaaaggtttttctatttgcccacatattgtcatttccagtgctttcattctttcatgtgatccagatttccttttggtaatattttctttctgcctgaagaaattcctttcatatttcttataatgcagattggtgataaatactttccactgttgtttatctagaaaagtattttgcctttattttgagggaggatgtttttgctaagtatagaattctaggttcacagtttttaaaattatttaacttttattttttaattggtaaattaaaattgtattttattgcatacaatatatttgttcacagttttctcctgtcagtactttaaagatgatgtctaggctgggcgctgtggcttacgcctgtaatcccagcattttggggggccaaggcaagtggatcatttgcgatcatgagttttagaccagcctggctaacatggtgaaaccccgcctctactaaaaatacaaaaattagctgggtgtggtggcgctcaccagtaatcccagctacccgggaggctgaggcatgagaatcttgaacctgggaggcagaggttgcagtgagccgagatggtgtcactgcactccattctgggtgacagagcaagactgtgtctcaaaaataaataaataaggctgggcgcggtggctgacacctgtaatcccagcgctttgggaggccgaggcaggcggatcacgagatcaagagattgagaccaccctggctaacacggtgaaaccctgtctgttctaaaaatacaaaaaaaattagccaggcgtggtggtgggcgcctgtagtcccagctacttgggaggctgaggcaggagaatggtgtgaacccaggaggcagagctggcagtgagccgagatcggccacttcactccagcctgggtgacagagcaagactccgtctaaaataaataaataaataaagaataaaaataaagatgatttctagttgggctcaatggttcatgcctgtaatctcaacactttgagaggctgaggctgggggacctcttgaggccaggactttaagaccagcctaggaaacacagcaagaccccatctctacaaaaaaatcttaaaaattagctagtggcttgaacttgtagttccagctgttcaggaggctgaggtgggagaattgcttaagcccagggggacaaggcttcagtgagctaggcaagcctgggtgacagagcaagatcctgtctcaattaaaaacaaaacaaaacaaaacatcctgatgagaagtctgctacaatccttatgttcctgtctatgtaatttttcttctggtcgctttaaaaatgattatgatgtgcttgtggggggatcactaagcttctttgatttatggattttttttttcttttgagacaaagtctcactctgtcgcccaggctggtgtgcagtgccacaatctcggctcactgcaacctccacctccagggttcaagcgattctccctgcctcagcctcccgagtagctgggattacaggtgcccaccacctcacctggctaatttttgtatttatttatttttattttatttttttagtagagacagggtttcaccatgttggccaggctggtcttgaactcctgacctccagtgatccgcccaccttggcctcctgaagtgctgggattacaggcgtgagccaccttgcccagcccattatttcttacaaagagttcaaaatgaagaaaaagaacagttctttttttcttgggactgcgattacatatggtcctgcaggtggttgatgcactgttcatttttgtctttttccctgtttcattttgtgcagttgttcactgatctttacttctgtaatatctaaccttctgctgtcaatccctccctccctccctcccttcgttcctttctctctcttctcttcctcttccttttctcttctctttcttgcctgtgcagagcagggctgctccataggcaaagtagcccagcgtatttttcatttcagatactgtatatcccctctagaagtttaatttggattttttttcatgtcttccatttctctcctcatatttattatttcctcttctttcttttttgagatgaggtctcactctctcttccaggctggagtgcactggcatgagatctcagctcactgcaacctccacctcccaggttcaagcgacccttctgcctcagcctcctgagtagctgggattacaagtgtgcaccaccacgcccagctaatttttgtatttttagtagagaccaagtttcaccatattggccaggctggtctcagactcctaacctcaagttatccacccaccttggcctcccaaagtgctgggattacaggcttgagacactgctcctggcccgatcctgtgtctttaaaaaaaaaaaaaaaaactctaacaagtaatactgctttttttaaaaaaaattgtgggccaggctcagtggctcacgcctgtaatcccagcactttgggaagctgaggtggacggatcacaaggtcaggagatcgagaccatcctggccaacatggtgaaaccccgtctctactaaaaacacaaaaaattagctgggcatggtcgtgggcgcctgtaatcccagctactggggaggctgaggcaggagaatcacttgaacccgggaggcagaagttgcagtgacccgagattatgccactgcactccagcctgggcaacagagcgagactccatctctattttaaaaaaaaaaaacaaaaaactggtagaaaacacgtaaaacaatttacaatctttactatttttaagtgtacagtttagtaatgttaactatattcacattgttgtgcaacagatcactagaacttttttcttgtaaaactgaaactctatacccactgaacaagcctccacttctccctccccttagcccctggcaaccacagtactactttctgtttctgtgagtttgactactttagatatctcatctaagtggaatcatacagtatttgtctttttgtgacaggcttatttcacttaatgcagtgttttaagattcatccatgttgtagcatgtggcagaatttccttttttaaggctgaataatgttccattgtttgcgtgtaccaccttttgtttatctgtttattaattgacagacacttgggttgatttcatcttttggctattgtgaataatgctgcagtgaatgtggatgtgcaaatatccctttgagaccccgatttcagttctttggggcttatgccaataagtacgattgcttcatcaaatggtaattttgttgttcattttttgaggaaccgctatattgttttccatactggctataccatctcatgttcccatcagcagtgtacaaatgtcccaacttctctacttccccaccaacatttattttctttttttttttttttgagatgaagtctccctctgtcgcccaggctggaatgcagtggcacagcctcagcttactgcaacctctgcctcctgagttcaactgattctcctggctcagcctccagtagctgagattataggcgcacaccaccatgcccggctaatttttgtattttcagtagagacgggttttgccacgttggccaggctggtcttgaactcccgacctcaggtgattcatttgccttggcctcccaaattgctgggattacaagtgtgagccaccatgctcggccttttctgtttttttgatagtggccatcctaagggatgtgaggtgatagcagtgtagtttcatttgcatttctctaatgattagtgatattgagcatctttacgtgtgcttcttggccatttgtatattttctttgaaggaatgtctattcaagtcctttgcctttttttttttttttttttttttttgaaacagggtcttacttggtcacccaggctgcagtacagtggcacaatcatagctcactgcagcctcgaacttctgggctccagtgatcctgctgccttagccacccgagtaactgggactgcaggtgctcaccatcataccttgctaactttgttttgttttgtttttttcgctgtctcttacagaaaggacttactaagttaaaaaaaaatttttttttatagagattggatcttgctatgtctcccaggctggtcttgaactcctgtttgcctgttttttagttgggttatttgttgttgttttgtaggggttctttatatattctggatattaaccttttttttttttttttttttttttgagatggagttttgctcctgttgtacaggctggagtgtaatggctcaatctcggctcactgcagtctccacctcccgggttcaagcaattctcctgcttcagcctcctgagtagctgggattacaggcatgcgccaccatgcccggctaatttttgtgcttttagtagagacagggtttcaccatgttggccaggctggtcttgaactcctgacctcaggtgatctacccgcctcggcctcccaaagtgctgggattataggtgtgagacactgcgcccggccatgatattaacctcttatcagatctatgatttgaaaatatcttctcccacttcatagattgccttttcactttgtcgattgtttcttttgatgcctgaattttttttttttttttaattttgagatggagtttcactcttgtcacccaggctggagtgcaatggcgcaatcttggctcactgcaacctccacctcccgggttcaagcaattctcctgcctcagcctcccaagaagctggcacccaccaccacgcccagctggcccgattgatttttaatagttaaaccaactttgcattcttggaataagttcatcctggccataacatatttatcgtttttaaatattactggattgagctggcaaatattttaagatctttgcatttgtgttcatgtgtaaaattggccaaatccttgtcacatttgtgtatcaagattatgctgatttctggccaggcgtggtggatcacgcctgtaattccagcactttgggaggccgagggggtcggattatgaggtcaggagatggagaccatcctggccaacatggtgaaaccccgtctctactaaatatgcaaaaattagctgggcgtggtggcgcactcctgtcatcccagctacccgggaggttgaggcaagagaatcgtttgaacttgggaagtggaggttgcagtgaggtgagatcgtaccactgcactccagcctggcaacagagtgaggctctgtctcaaaaaaaaaaaaaaaaaaaaaagattatgctgatttctgtgaattgcttgagcccaggaggcagaggttgtagtaagctgagtgcaccactgcagtccagcctgagcgacagagcacaactctgtctcaaaaaaaaaaaaaattatgctgccctctttagcttgggaattattccctctttttctagtctgtggagacggagggtttaagatcaatatctggctgggtgcggtggctcactcctgtaatctcagcactttgggtggccaaggtgggcagatcacctgaggtcaggagttcaagaccagcctggccaacatggcaaaaccctgtctctactaaaaatacacaaaaattcgccaagcatggtagcaggtacctgtaatcccagctactcgggaggctgaggcaggagaattgcttgaacccaggaggcagaggttgcagtgagccaagattgtgccactgcactccagcctgggcaacagcatgggactctgtctcaaaaaaaaaaaaaaaaaaggaaggaaagatcaatatctcttcctcagccaggtccggtggctcatgactgttgggaggccgaggcaggcggatcacttgaagtcaggagttcgagaccagcctggccaacatgatgaaactccatctctcctaaaaatacataacttagctaagcgtggtggcgtgagcctgtaatcccaggtacttgggaagctgaggctggagaattgtttaaacccaggaggcggaggttgcagtgacctgagatggcaccattgcactccagcctgggctacagagtgagactccatctcaaaaaaaaaaaaaaaaagaaatatctatctatctatctatctatctatctatctatctatctatcttcctctttcttcatcttctttttcccttcctgaacagttcaaaccaaaagtcattaggtaggatcaagcaagatagatgtttacgtagtgggaaggctacagtgctggaagtgccagatgctggggcccctgaagctgaggtgaatgtcattacaggtggcaggtggcagctcagtacatagagactgggcccaaacaagatcagaagggcatccatgtaggcaggggtgaagagtagaggaggccgggcatggaatagtgaagtctgaagcggggttgaggatgctgaaccacagggaggcctagagtggggtggcggagtcaagtggggtgagcagggcttttgcatggagaggggcggccgtggcgcctgatgtgggcaaggaagttgtgtctgcatggttgagggagtggagagagggaagagggtgattgtgccctcgggagggtaaaagagtccaagcatcctaaggaagacgtgcatttggggagtgtgtggcagcaatagtggaagactggttacatacaaggagattaatcaaatatgtaagtatattgagtaaaatgggaaccacatttttcactgtcaaagaagggaattataaacatggaaagagagaaactcgaatcaactctgtggtgttgactttgaattgaagacattgatacaaatttaaggttttcagtatacaaagtaagacagttgtgaagcaatctgattgcagattccttttacatttttattaccttaatcttttataagtatctcaccctatgcttaatttgatggctcttctttttttttttttttttcttcttcctaatagagacagggtcttgctctgccacccaggctggaatgcagtggcaggatcatagctaactacagccttgaactcctgggctcaagtcaccatcccacctcagcctctcgaatagctatgagcacaggtgtgcaccatcactcccagctaatttttaataattttttatagaggctggacccagtgggtcatgcctgtaacagcactttgggacgttgaggtggaaggattgcttgagcccaggaatttgagactggcctgagttacatagtgagaccctgtctctaaaaaaaaaaaaaaaaaaaaattggtgacacacacctatagcctatagcaccagctacttgggaggctgaggcgggaggattgcttgagcccaggaggttggggctacgctgagccaggattgcaccactgcatcaaggttttgaactcctggccttaagcgattctcctgccccagcccctcaaaatactgggattatagatgtgagctactgtgcccagccaatagctattatttttgcaactcattatcaagttcttccaaagctttcaacacggcttttatagtagtaataatggcctttgtttttgcatgtatttcatcaatttacatgcttaattaaatttggtgttaattgcaataaaagatacaattggaataaacaggtttgagaacaactacaaccaacccttggtttggtaagcatagaactcaactggagggagccgaagattgtcatactaccagcaagcatttggcagaccatgagcattagaatgaccgtgaggttagaatgttttatagagggaagggaatgtgccagttagtatgttgtgatagctaagtggttgttgcatagaagaacttgtacaggtctgtgaggctgggatagctgcagcgtaaagaagaagtggaaaaggtggagaaaggcggacaagtggagaactttacatcttggggatgtaaagttcttaaaacagtgcctgactgggcgcagtggctcacgcctgtaatcccagcactttgggaagccgaggcaggccaatcacctgaggtcaggagttcgagaccagcctgaccaacatggtgaaacctgtctttactaaaaatacaaaaattagctgggtgtgatggtgtgggcatgtaatcccagctactcaggaggctgaggcaggaggatcactggaatccaggaggtggaggctgcagtgagctgaggttgtgccaccgcacttcagcctgggcgacagagcaagccttcatctcaaaaaaaaaaaaaaaaaaaaaaaaacacacaaagaaaatccccccaaaaaaccagcgcctagtacatagtaagcacttaataaggttaagccattgatattctcatgattattttcatcatcattttcatgaatgtttggaagaataggaaggggcacagatctgactcctgccctcctaactcagccactgctctgagctgaagctcttctaaagagagcactgtgggaataacaaattagggcacatccatgtaatggaatacctcagcaataaaatgagatgagctcttgatacagcaaactcagatgaatctcagaggcatgatgagtgaaatgaaacaagacagtctcaaaaggttgcatactgcctaattcatttacatgacattctatttttaattttattttattttatttttagagacagggtcttgctctgtcacccacgctagagtgcagtgattcgatcgcaactcactgcagcctcgacctccaggcttccgtcatcttcccacctcagccttctgagtagctagaaccacatgcacctaccaccatgtctaaattttttttgtgtgtgtagagatggggtctccctatattgcttaggctggtcttgaactcctggcctcaagcaatccccccgcctcagtctccccaggtgttgggattactgtgctcggtctataggacattctatgagggcaaaacaatagtgatggagaacagatcagccaggggctgggggcgaggggagggtgtgattacaatgggataccacgatggagtttttgggctgttgcaaatgttctgcatcctgatttgggtggtggttatttaagtctatacatatgttaaaattcagagaactttatatcccaaatttgctatatgttaattaaaaaaaaaagtaaaaataaagccttaagaaatgaagggaggcggggcacggtggctcacgcctgtaatcccagcactttgggaggccaagggtggcggattacctgagggcaggagttccagaccagcctggccaacatggtgaaaccctgtctctactaaaaatatacaatttagccatgcgtggtggtgggcacctgtaatcccagctgcttgggaggctgaggcaggagaatcgcttgaacctggaaggcagaggttgcagtgagccgaggtcgtgacagagcaggactccatctcaaaaacataaaaataaaaataaaaataaaaaaaagaaagaaatgaaggggccagacaaagcggctcatgcctgtaatcttagcactttgggaagccgtggcagggggatcgcttgagcttaggagttcaagaccagcttgggcaacgtgacaaaaccccatcttaaaaaaaaaaaatagaaaaattagctgggcatggtggcacgcacttgggaggctgaggtgggaggatcgcttgagcccaggagattgaggctgcagtgagccgtgtttgtgccactgcacttcagcctaagtgacagagaaagaccctatttcaaaggaaaagaaaaagaagtgaaggccctgtagagagcgtcctagtgtctaagctgacctggccccaagcgctgctcgaggggtgcttctgtgacggcgcagcatgtgtgcccaggcctggttcctcacggccaggcccatcatcactcactggctttttccttcctcgtgttagattggagctggagggagcatcactgggctgaagtttaaccctctcaataccaaccagttttacgcctcctcaatggagggaacaactaggctgcaagactttaaaggcaacattctacgagtttttgccagctcagacaccatcaagtgagtagtttaactagcaggggaaagggcttctaagcttaggtgtagttccggcaagagcatccagatcccatttccttaacccaacctggcccagggaagaaaggaaagatgtcagccactttccgcccttctttctctttctcaaactgctccttggctgccctcactttggtccaggtgggttactgctttgggaaggtgttctggagcctcagctcttctgtaagtcatacctgtattagactggaccttgaccctcactagataagccagcatggcgtggacccagaaagccacctagagaatggagcaacagctcagaacttgagactgaatgccctgcactcactgtggtgtaatgacctgacctgttcctgggtggaagcttatatggatggaatcttttccataaagtgctctggacttcccaagagaaagtggctggagaaattacagaatgcggccgggtgcagtggctcatgcttgaaatcccagcactttgggaggccaaggtgggtggatcacctgaggtcaggagttcgagaccagcctggccaacatggtgaaacccccatctctactaacaatacaaaaaattagctgggcgtggtggtaggcccctgtaattcccagctacttgggaggctgaagcaagagaatcgcttgaacccaggaggcagaggttgcagtgagccgagatggcgccattgcactccatcctgggcaacaagagcgaaaatctatctcaaaaaaaaaaaaaaaaaattacagaatactcgtcactttgatttccagctagagccgtgactctgactgctccctgaggaattaagtgagggtgctggggtgtaactagcattggattggatcctgggctgtcccgcagggatgaggagtgcatgcgcacgcaaatcagcaggcaattggatagacaaggctccaggctactcttccgcaagaaatcttcctgcttgaagatattcataggggatggcaaaaggcagtgtagcatggatttgagagtttgagagaaaaactgtgagctgagctcttctggctgaatagcaggatccctgaagcaccctcctagtcagcctcccagtccagtggtttgagggaccagaagagctcctggttgtgttttttcccccagtgttcagaagggggcagaagtgcttttctagccagctctgaggaacagggccaggcaatccctctttggcttgtgtctcctttggcctaaagggtgaagagtgaaaggagagagcagtaaaggaggcttgctcagaacccggggtgtggggggcaggcgtgcctcagggcttgctttatggtataagctttgtctgcttcagggacttttaggagctggggatcctgggcccagccataaccagacagatttctgagccccattatcccatcccctctgtctggacggtagagcagtctgaatgttcctcactaggaatccacggcaagacagttattcattcattcaacaaatatttattgaatgcccgctgtgggttagtcaccggagcggcaacagtgagtaaataggactatctctgtccccaagaatcttacaacacagtctctccctccagcatctggttttgtagcctggatgtgtctgctagtagccgaatggtggtcacaggagacaacgtggggaacgtgatcctgctgaacatggacggcaaagaggtgcgttctccgaggtcctgcctttccctccctcacccccacctcggttctgtgtccccacctgaaccgagctcttctctgcagctttggaatctcagaatgcacaaaaagaaagtgacgcatgtggccctgaacccatgctgtgattggttcctggccacagcctccgtagatcaaacagtgaaaatttgggacctgcgccaggttagagggaaagccagcttcctctactcgctgccgcacaggcatcctgtcaacgcaggtgtgatatcccagacctcatctctcctgcagaccctgcctgtctgaccactgctggggttttccctcagtgtggaagccactacgtcaaacctttacccctgatagcgtctgccaagctgatgtctgggaacctttgtggctgtggctgtccccatcagctgctgagtttccagaatttttttgttgttgttcacagcccagattcacctcttcctttccgctcctgtctagagaggagtgggagggagagtacccctgcaggagaaggcctgcaaggccaggaccacagagggcttgtggttccttcagctcaggggcttttcactttgccagcttgtttcagtcccgatggagcccggctcctgaccacggaccagaagagcgagatccgagtttactctgcttcccagtgggactgccccctgggcctgatcccgcaccctcaccgtcacttccagcacctcacacccatcaaggtgagtggcggtgggaaggagctcgcagaaggaggctgtgatcatgaggccggagcaggtctgcccacagtggggaagggctgatgtggtaagcctgccaccccagatcgctcctggcccgagcacagagcatctcttacccattggctctctctcttccttttatcccacttctgccatcccatatggttgagttttctgtctcgctgataagatatttttctgagttttttcagcccagctctgatctcactgtgagaattttctaagatcctgaccctctgttctgtcttctcagcttcagttacctgtgtacagttgacccacaaaccttcattttttatttttttattattttttttaaggcagggtctcgctctgtcacccaggtgggagtacagtggggcaagcatggttcattacagccttgatctcccaggctcaagcgatcctcctgcctcactttttttttttttgtagagacagggtattcttgtgttacccaggctgatcctttttttttttttttttttttttcttgaaacggtcttgctctgtcacccaggctggagtgcagtggcacaaacatagctcactgcagcctcaacctcctgggttcaagcaatccttccgccttagcctcggaagtagattggactacaggtatgcgccaccatacccagctaatttttttattttttatagagatggggttttgccatgttgcccaagctggtcttgaactcctaggttgaagccatcccccaaccttggcctcccaaagtgctaggattacaggcatgagccactgcgcctggcaactttgccttcttagtttgtcttgcaggtttcagtgcttctaataataaaaataagtcttttattttcccaccttttctcaggctcttgttaatagcttctctatcattagtccccaacactaatagctttcaagtcctttgatgcctttttgcctaagcccccatgcagactgagctctgctagttctgcattcttttccaaaactacagatcctcttcagatcttcaggttttatgcctatacttctctggtcagttcagaatagtggtggggagcgccagtttccagcagccagaccccccgggttagaatccttgggcaaattacttatattttggatctgtttcctcatctgcaaaaagggaatactagtctctaactgatagggttgttgtgaagatgagtcagtatacttaaagcacttggccccatgcccagcacctggtaagtactggtaagtattcaataaatgatgattgaatattgagtggcccccacgtacctcaatcacatccaagctcttaataaataatgtcaagaatccttccccagttggtgttcctgttaatccatcagtgttcccgataatccatctgtctgcatgtcccagtttgtatctagccaggtgtcgtaagtcattacagcttcctgtgtgtgatttgtgacttatttctaagccttcgcatgtactatttcttccttcctgctaaccatgtctttcttccttcaaaacttccttgagaagtttaggaaaatcccatccaattctgccattttaataactgccagatttgtttttagtggggtgatctggggaatgtgggtttccttctcttttttagccattagcaattttacactcagctcttagttattcgtgttgatggagacaggatgacagtggggctcctccagaactcaagtcctgttagggtttggtcaccagaggctttttctgctttgttgtaggcctcttaggtcagtatctgggtcaggctgatgttaaaacgtttaccagttggtatgatcttaggaaatgcaaatgagggagaaggcctgaaggtgccctaagggccagggaggccagctagggattaaaaatgtgcaatggcagaggcacacacaacctaaaaccattcttgtagttttctgtaagacttatctccattattaggttggcttgttactggcaaatactacttttttttttttttttttgagagtcttgctctgtcacctaggctggagtgcagtgacatgatcttcactcactgcaacctccgcctcccgggttcaagtgattcccctgcctcagcctcccaagtagctgggactacaggcatgtaccaccacgcccagctaattttttttttggtatttttagtagggacggggtttcaccatgttagccaggatggtctcgatctcctgacctcgtgatccgcctgcctcagcctcccaaagtgttgagattacaggtgtgagccactgcactcagcccaaagaatacttttgatgttcctctttgttcatatttgtttttgatgtcccccttgatcatgttctgtgtttaccctcatggccggcctctccatctcctaggcagcctggcatcctcgctacaacctcattgttgtgggccgatacccagatcctaatttcaaaagttgtaccccttatgaattgaggacgatcgacgtgttcgatggaaactcagggaagatgatgtgtcagctctatgacccagaatcttctggcatcagttcggtgaggcttgggtcctcaaataatgatgggaggaagcagggattcaacctaccttattgaccaaaagtgaccagaaatcaggtgtctctgctaataccttcaccctctcctcatgttgacactcttgtctctgcagcttaatgaattcaatcccatgggggacacgctggcctctgcaatgggtgagtaggaggagaatgtctctgacttgccaagtccgatcctacttcccaaggttcagtgcgggccagcctcagccccgccctgccacattcaccccagggcagtggcccacgaagaagatggctgggagacagtggtctctatagccaaggccctccattcctctggctttgtcttggtcatgcaatgcctggctactgtccagtttcctagtatttcttttttttttttgagacggagtctcgctctgtccccccgggctggagtgcagtggcgtgatcttggctcaatgcaagctccgcctcctgggttcacgccattctcctgcctcaacctctcgagtagctaggactacaggtgcccgctaccacgcccagctaattttttgtatttttagtagagacagggtttcaccgtgttagccaggatggtctcggtctcctgacctcgtgatccgcccacctcagcctcccaaagtgctgggattacagacttgagccaccgcgcccggccttcctagtatttctttaccaaattgtaggtttgcgggccagccccaggctctgagagattggtaacagaaagtgtaagtcagactggtctcactcttcctaggttaccacattctcatctggagccaggaggaagccaggacacggaagtgagagacactaaagaaggtgtgggccagacaaggccttggagcccacacatgggatcaagtcctgcaagcagaggtggcgatttgttaaagggccaaaagtatccaaggttagggttggagcaggggtgctgggacctggggcactgtgggactgggacacttttatgttaatgctctggacttgcctccagagactgctccagagttggtgacacagctgtcccaagggcccctctgtatctagcctggaaccaaggttatcttggaactaaatgacttttctcctctcagtgggtggtagcagagggatcaagcagttatttgatttgtgctcacttttgatatggccaataaaaccataccgactgagcttctgcgtggatcttccagaagtgacctggtcagagagcttcttgcgtctcagaaatgaagaaaaagcacaggaaacagcactatcagtccaataggaaacagcactattcattctctgggagctgccccagccctattctgggccacagtctagaactttcttttccagctcacaacctgcatgtagctcaggtccctggagaccccagcccagctgagggagagcagtttcctgattcgtgtgacaagcaactcccttcccaccactccctactccctcccaagtacagacaaccttccgtcctgctccagttgaaggggtgacaacgattcctgaagcattctgtctgagtctaatggtggctctagccagacacagggaaatgtggctggctggctgttgggtgatccagttccttgggagccaatgtttgtacccctggtattagctgtttttcccactaaaataagcactgagaggcaagaccgtgtccctctgagctatttgccgaagacttcaggctggaggaaaaagaacagggcttgatagaagtgcaaggtggatccagcaccaactctgccattttctaatcctaggtcctgagtgaacactgactgccagtttacatctcaggtgtgtagggagcgtggaggaggcaaatcctgtttggagaaagccagtgtccaacacagcacttggtaaacatcaggcatgggaatgctgagtgacaggcaccatgggccacgctgagccccactcgctcatctggctggggtcatcagagggaggcccaacccaggatctcctgtccatgggctggggagcagcaacagtcaggagcgagggcccagcccacctcccctaggaggtggagggaagggggctgagtggttgtcaggcgtggtcctccccatctgcgacgtggcggtagccaggaggctgggcctgcatccggaagaggacggtgaggagcagcactatgaggaggaagaggatggagccacatacagccaaggccacaatcacctctgggcatgggggaggcaagagaaaggtcatgtcagcgttccatcatatgccagctactgttctgacatataggagatacacagaggtggccaagacagagtccctgctctcatggagtttacattctaggagaggggatgtaataaataagcaaatgggctggtcacagtggctcacgcctataatcccaacactttggaaggttgaggtgggcagatcacctgaggtcaggagttggagaccagcctggccatcatggtgaaaacccatctctactaaataaagttggccgtgcgcagtggctcacacctgtaatcccagcactttgggaggccgaggtgggtggatcacctgaggtcaagagtttgagaccagcctggccaacgtggtgaaatgccgtctctactaaaaatacaaaaaattagctgggcatggtggtgtgcacctgtaatcccaactactcgggaggctgaggcaggagaattgcttgaacctgggagacagaggttgcagtgagccgagatcacgccactgcactccagcctgggtgacaggatgagacaccgtctcaaaaaaaaaaaaaaaattaggagtgacaggtcagtgacgaatgtgatacagagagacaaagcaaagtaggtcagcagggaaggcatcattgagaaagtgagaagtttaacagagacctggagtcaatgaatgacatacaacaatctgagaagagtatcacagggcagaggagacgaagggcaaaaggcccagatgtggggataagcctggcacatgctagtatcatcaagagtcagtctcaccagagtagagtaagcaaggggcatgtaggagatggggcaggagaccagatggagtagggcctagaaggccatggtgaagaacttggattttattctatatgtgatgggaagccactagaaaattctgagaggacagtagtatgaactggtttacattttttaaaagttaactcagtcggccgcggtggctcatgcctgtaatcccagcaatttgggagactaaggcgggcggatcacctgaggttgggagtttgagaccagcctgaccaacatggagaaacctcatctctactgaaaatacaaaatcagctgggcatggtgatgcatgcctgtaatcccagctactcgggaggctgaggcaggagaatcacttacacccgggaggcggaggttgcagtgagccgagattgcgccactgcactccagcctgggcaacaagagcaaaactccatctcaaaaaaataaaaaaagttaactctgctgtgttgaaagactggtagggacaagaatagaaccagaaagaactaggaagcttttcattcggtcaggcaagagctgacggtagattggactgcggaggcaagagcacatattaatatttgaaaggttgagctgatctggcagtgggctggatgaggggtatgagaaacggtatgcagaatgaccccaagggttatactgtgccactaggtgactcgtggcattgactgaaacaaggaagcctggaagaagagcagctgtggaaggaaaagcatctggttttagacattgcaactttgagatgccttacttaacatgcatgtagagatctcaagttggcagctggatatgagtctctagctcagagaagaggttgtgaatctgtgagtcagggcgtaaggacagaagtgggcatggagatgggcataaagtcatgaggctgcatgagatcacttgggagtgtgcacagatggggaaagctccagggatgagtcctgggtcatccgttctttagtgaggaagggacgcctgaaagtcagaagccaagaaagtgtttcaggaaggggtgaccaattatgtaatgctgctgagaggtgagagaagctaagaattagtcactggctttggtaggaggtgactggtcaccagacaagtatggcttcagggtagtggaaggtgacacaagactgtctaatgtgagtctaagagaacaagtggtgaggaagcagagccagattctaggcagctctttcaaggattccattctgagagggaagaggctggtggctggggaagaggtggctctcagaggtcatggatgggcttttgggagggaagtgatccagtagagaagcagaggcgtcagagctccttgcagagatgaggagagaacccaagtgcgggtggagaggccaccctaagcggtggcttcccccaggaagtaacctggtggtgggagaacgagccaattctctcttggctcttattttctcggtgatacaagtgagacatcacccgagggtgagaagtggggagaaggtataaagcagtctggggtcggggagggaactcctagcaaatgcagtcaaatggctggaagtgcgacagctcttgagatgcgtggatgtgaactgcaggctggtctagggcatgactagcaaggaggccggtgacagctcacctgtgtctgcaggaccgcttgccagctggcactcctgctgccaatccttgggcacgacgggctctgtgaggcgaaggaagtcctgcagtgggcagcggtgagggcagccaggcaggctgagcggccagggggccttgtcactctcgttccgaaagtacatctccactgagaaattcctgagggtcgacaggaggcaacatgggagctgctcagcctgcccatcatggggtccttgggctgccccgagccacctcccgagggcccccctccagaggacactgctagctccactcacccagaatcttcctggtacagttcaaatatgtggcaggaggcgtagggggcttgttcaccattgtagacatccagtgccatttgcagggcaaccagggtagtgtcgtgctgcgggggagaggggctgcccgtcagcattgttccccacacccgcaggaaccgaacagagaagaaatccagctccttgcctgacacagcacgctagggagcgcaggcactcaccgcagagtaaaccagcagcttggggagctgggaggtggtcgccattagggtcaggttcttccttatctgagccagcaggactcctgaaggagaaaagtccccggtgttgctggctacagccacctctgccttctaattagacctatctgtgctcctttcaccctctgccaggcctgggcctcatcacctacacggagaactctttagtgtcatagggaccatgtaagaactctgtggcacccctcctctctaagaactgtcaaatgtacagaaggaagcaagacaaaacaagatatctgcctatatttcaacacggatgtagaaacctgcctgtgtttacagaagcacttcagtttgaaacaaatgtaaacttaagattgcttcagagtacacagcgggtgggtgcatgcccgggtaactaccatatgctctgaaaagtgagatgtcaaaaaggtgtgacagcaggcatgcccttaggtgctcaaataaggaagctggcatgtgtgttactctcagccttctcaaaatggcccccagtggttctcttggggcagctattcatttaggagagggagggtcttctgatgtgggcgaaacttaagaacatgaatggcagggctgggcgtggtggctcatgtgtgtaatcccagcactttggaaggctgaggcgggcagatcaccagaggtcaggagtttgagaccagcctggccaacatagtgaaaccccatctctactaaaaatataaaaattagttgggcgtggtggcaggcacttgtagtcccagctacttaggaggctgaggcgggagaatcgcttgaacctgggaggtggaggctgcaatgagccgagatcgtgccactctactatagcctgggtgacagagcaagactctgtctcaaaataaataggctgggtatggcggctcatgcctgtaatcccagcactttgggaggccaaggtgggtggatcacctgaggtcaggagttcaagaccagcttggccaacatggtgaaaccctgtttctactaaaaatacaaaaattagctgggcatggtggctgaggtcaggagtttgagtccagcctggcgaacatggtgaaaccccgttcctactaaaaatacaaaagttagccaggcatgatggcatgtgcctgcaatcccagctactcagaagactgaggcaggagaattgcttgaactcaggaggcagaggttgtagtgagccaagatcgagccattgcactccagcctgggtgacaagagggaaactccatccccccgaaaaaaaataacaatttttttaaaaagaatatgaatggcagaaaaggaagagaggtggggaaatttggtgactagcggcatgaggagggggatttggttttgaaagagcagggagtgtttcagtagagagggaagtgtgtgagaagcccccacagcagatttttaacgccttagggtcctgaggagtagagtgacacgctgtccttgtcactcacccccctgaagccgggccttctccgcctgctggtagattccgaagaggaagcggaagctgaagtcctttagccggctgagacgctgcatggtttggggtgaggcccagggcggcaggcgcagcccgtgcgtttgctgtgtatcgcagcaggcaggttagcgccccaggcctaggccagcctctccagggggcagctctcttccctagtgggaaggtgcctgtgtgtgtgagggagggagaggggagagaggcagaggggctggaaccagtagacatggcaggcggtgtggatgcttcagggcacaggaaaggaagctcaggcacaaaaagtgagactcagcagaaaggagctctgggtggagagcagcagggactgctgacaattaataaaccatttcccactctgaggatctctgtcacccatgagggaagttcccgtgtttcacaagcacagcctccctggacctccccaggggcgtgacggtatcaggcactgtgttctaccgtcctggtgacctgggcctgctgagagggaaaagaatgatcacagtgggcaccctagtgggctcacctcacagaagagtgtgtcatagacattccagacggtctccagtgtcaggtctgtaagccctgtctcgttggccaccatgtccagaaattgctatgaaaaatggatcagggtctcagtcctgctctggggaaaagacagcgtggtgagctgcacctctgcccccactcactgcattccgagaactctcattctgatactctggtgtctgccgggtctcgttctgcagctgctcataacggggacatgggcccaacgggaacttcagcagctgtagagcgaagcggggaaacaggcagcgggaaaaggagcctggcatcagcaggcctacggccagagctgtcccctcaccaccccagggaagggctggccactcttaccctgtcctcagtgatgggcacagtgtgcacaggaataggctgccacgagatgttcgggttgaagcgctgcatcccgttgggagggaagagtccagccaggttggcctcagcactcatgagagtccggtcaaagtctgtgcttcgcacataaacctgcagcgatagcaacacaagtcgtgtgtgtgtgtgtgtgtgtgtgtgtgttggggaagttttggtcaccctgaagtggagccttgtatgtatgtgtgtgtgtgtggtgggaagttttggtcaccccaaagtggagccccagaggagaacctgttcctgatggtcacccagcaaactaaacctaccatacatctggccctcaccctcctctggcctctggccttccccatcccccaaacactccactgggggttgtcaccactctgtgaagaactcttgtgggaatggccttagttgaaatgccccttccagtcaaaagtgctgagtcaatcagtaaggctctctggtctgtctggtttcataacaacacctctctccctgtctagatcagggtccttggggcagaaactggctccagtgacgacccttagagaccagggagaaaaaaataagataaagggctgggcctggtggctcacacctataatcctagcactttgggaggccaatgcaggaggatcgcttgaggccaggagctcgagaccagcctgggcaacatagtgagaccctgtctctacaaaaaaaaattttttaattacccaagtgtggcgggcacttgtagtcccagctacttgggatgctgaggcaggaggatcacttgagcccaggagtttgaggctgcagtgagctatgactgaggcatgtgctacagtttgggtgacagagtgagacccctttaaaatatatgtatatattttgggccgggcacggtggctcatgcctgtaatcccagcactttaggaggccgaggcaggcggatcagctgaggtcaggagttcaagaccagcctggccaacatgatgaaatcctgtctctactaaaaatacaaaaattagccaggcatggtggcacacacctgtaatcccagctacttgggaggctgagacaggagaatcgcttgaacctaggaggtggaggttgcagtgagccaagaccatgtcactgcactccagcctgagcaacacagcaagactctgtctcaaaaaaaaaaattttttttgaagagcttattcagagatagtggctcatgaaaagggaggaggaaactggggaaggacaagctcaggacagagctgggccttaagagaacaataacaatgtctatggattcttgatacggctgaggctgacagtggtaatcagaggaacagcttcccccattcctggggtggggcgaagactcaaggagcaggcacactcaccagtcctccctgatgtgccctaggaatatagcacgacctggcgcagcagacagggctcaaaaacctcatcttgatcaagaaaagacaagccctctctacgcatgtcttccccgctgtctttcatcttggccctgtctggtttatcattagatacccccacaacattctaagctccatgaagacagagatcatatctgtatggtgcacaactgaatgcaaagtgctagcacagtccttggcctttaataggtactcaatgtcttggatggaaagcctgtgatttcacagtcagaaaccactttgccaggcccgcccttaagtccgaatttggatgcttaatcaaatttgcctcatcccagccaagcaggggcaactcagctcctagggctttgttccagacagctctcagatgtcttttcctgtagttgtgaccaaaaatacaagaaggaggccaaagtgcccagcctcagccttaggctccctgagggcaaaagatgagggcagcataccttgttccccttgcctctggagctcccaaccttacctcttgccggtgataagaggtgtttaggaagccgtgatagcgctgccgcagggcctggcccagttcccagtgctgtagcatcccctcctgtgggcaaacccaagggttaagagggtctagagggaaggggtggcttcaagccccatggggtttaggccctgttgctttccaggttcacgctttgctggagtcaattaatctgatcccagaagtctttcattaagtggccagtcatgcacagcaatatcatgggcacagagattaaggttatgaaatctggtcaaagtcagcacccatatgggaaaaggcagtttagtaggaccccaagttttgtagactgctctagacgtcgctcattctgcagctcatcctgaggaaaggctggcttctgacccaccttggttaactgaccaaacccctggggccattcttcttcctgataggggtccttgggatatgtcttcactggtgaacggtctccatggcggtacagctgagagaataaaatggtttgcctataggtcagaagcatccccttgatagggacccagagcctaccttttgccccatgttagggaaggaagtctcattccctctgggaagcctactggctgcaaaagaccccagctaggagtcagtcacttcttccagattccagagattctaacttagctaagcaatgctactggagaccataggcaaagccaaggtacaggtaggaagggaaaagagaagtgaaagcaacgtatgtggtggggacaactggggaaaaaagataaccaaaggcttctttagggatgagtcttaaccattcaaccacttccctgtctcaaggcagactcaccccgacgtattcggtcatcctgactcccataagccagggctccaggtcaatcctgaatccagcctcccaactacccaggccagtcgtcccctcctaaaccagctgttccttcccgagatcctcgacctccaccagctggcctttgcccttttagcttcagggaagtctttggtgagcccatctctcattaccaaggtaacgaagcgcagactccgggcccgggtgggcggcatcaccaccaggttcacgccgagaaggagctggaggagagccgcccggctccagccggaccgcttgcccgccatcaccgttgtaatctatgcagcaaacaagctggaacccgctgggtggcacctgcaagcagccgcccggacgcacccgtaaggacacacgccggaagtgcgttcgccgccatcttacttagggacctgctggggtgcggggaaaaggcgcagtctcggtgggattgcgtgcaggagggtcgtggtctggctgtggcggaggagcataagaaggtaacgcgacctggcgcggcagacagggctcgaagacctcatcttgattaagaaggccacaaattcgcgtttgcctctgctcggagaaatcccttaccaaggtggcacttgcagtgggcgggaccatgtctggagaaccagcgtcccctccaggcttgaccccatagctagatcgggtgcagaattgaggcgagggatgggaaagtagaggtc

SEQ ID NO: 1244 - DNA, 47568 bp, Homo sapiens
gctcactacaccctctgcctcccaggttcaagtgattctcctgcctcagcctcccaaatagctgggattacaggctcccaccaccatgcctggctaattttttgcatttttattagaggcggggtttcaccgtgttggtcaggctggtctcaaactcctgacctcaggtgatccacctgcctcagcctcccaaagtgttgggattacaggcgtgagccaatgcgcccagcccaattttgacatcttaaaaaaataaaataaaaaaaccttatgggccaggaagagccggcctttcccagggctaggcaattctttgagatagcaaaaggctcatctgggggcatgcatatgcaaaccagccgaccctcaaccactcccctttacccaactctcacaccaagccagtatttcccctgccctaaatcacccagggtcaggtaccagacaactgaagacagcctatagcccagagcccacatgacagctgcagagaggccccatcgggacccagatgtgcatggagatcttgtctgtgcaggggacctcgttggtaaggggtggcacgaggaaacggtgtaattgaggaggtgaagtcagtggggctgggatggaaggggaaggttggccctagggctgggccgggccaccctgcatgtaagttgtggatggaaagaagccacaggggagagaaacctgaagctcctcgtggctgcaggaaagcatttggtgtgtgcttcagaattcagccatgggctcgcctgtgcctgacatttggctcccacccctcctcatggcccctctttctgctcagggttgggagtgcagtgttcagagcacaggcaggtgcttctggatttcagtgttgtaacttccaggcatctacctgctccagctgagattgtcccctgcagtcctttggatctccccaggtgggatccaagttccagttgggctgggctggtggcagcctggcataccagaggcaggtgagacctgctgcctggggtctctgccccttgctggtgtcccctgtgggcagctcagctctctaaatccctgtggcagcctggggcccacattctatctcctccttgtcctgacccaactcctctgggttggccaccctggtacccatgggaagcatcccttgggtactctctgccaccaagctagggtacttgggtctctgggaagtggccctgggacccagcagtctagatgcctgactctctcattgtcttccacagcttggcaccaggtaagactctgctagaccagcaggctttcgagggacccttctcctgggcaacaggcccttcagctctggaatgttctgcctgagcgtcccagggtgtctgcaaggcagcctgagtgtttgtgctggcagagcccaggggtggagcagctctgtctgcagcaaccgtgggtgcccaagagcagcctgctttggggacagtgggaggggcacacccgggacacactgattctgaggacatgtgctaacctagcgtctgcataactggggcaaattctattctcaactctggaacagcttgctgcttgcacttgggcctaaaatcacagccatcttctcagcatggaaacctcctcccacccttccagaatccgctcacacgcccactcctctcaggagctgtccttgaccttctcaggtcattagctgttccctcgtgtcctcatgtcacctctgtacaagcatgcctccccaccacacatgcaaatacgcacacgggcacatatgcatccaagcacacgcgtacacacacgagcacacgcacatccctccctcctggacaggacagctcatctcgctgtaaatatatgttatgacaaatcatacgtgtccattattttacaattcaaacaacgcagaaatgcatgagaggaaacgcctgcagccacatccctctcccctcccctccttcctcccttcctggtaagcactcacccagatttttgcttgtttaagcaaatgaaaccatattctaaacattgttctgtaacttgataaatgtctaataacctgtcacaacacctttccatccttggctcattgtgacaattcacagaatctgggtttgggccagaattggtcaagccactcccctcttccacaaacatttaggtcacttaagtcttttcagatttttttttattgctatacaaataggtgctttgacaaacacaccacctcaaacctcccttaagcggggagctgaatttcccatgacttttgttgtccttcctaccccagagcctggccaggctctccgtgtgtcttgtttgatgcgtttagacgagatgatttcagaaggcagtgggaggcacatttgtcaaattgcctgagtactgggagaatcagtgtttacattacaggactgaggccgggcacggtggctcacacctgtaatcccagcactttgggaggccaaggcgggtggatcacaaggtcgggagattgagaccatcctggccaacatggtgaaaccccgtctctactaaaaatatataaaaaaaaagaaaaattagccaggcatggtggcatgcacctgtagtcccagctactcaggaggctgaggcaggagaatcgcttgaacccaggaggcggaggttgcagtcagctgagattatgctactgcactccagcctgggcaacagagcaagactctgtctcaaaaaataaaaaaattaagaagtttaagaccactctgggcaacaacatggcaaaaccccatctctacaaaaaaatacatcaccaagctgggcttggtgatgcatgctcgtaatcccagctacttgggagactgaggcgggaggatcaattgggcccgggaggcagaggctgcagtcagccgagattgaaccactgcactccagcctgggtgacagagtgagaccttgtctcaaaaaaattacaggactgagtgaacagtcaggaagttgggaaaggttaccctcttggcatcgtgtcggggggttggaaggatgatgagggaatgaaacccaggcaggttgactgagaagaagctgctttgggaaggacgacagatgtgggagtggggagagaagtggccatgtcatcctagaggtcacacgatgtcatttaaaaggtaagcagggccgggcgcggtggctcacgcctataatcccagcactttgggaggccgaggcgggtggatcatgagttcaggagatccagaccatcctggctaacacggttaaacccagtctctactaaaaaaaaataaaaaaattagccgggtgtggtggcgggtgcctgtaatcccagctactcgggacgctgaggcaggagaatggcttgaacccaggaggcggaggttgcagtgagccaagatcgcgccactgcactccagcctgggcgacagagtgagattccgtctcaaaaaaaaaaaaagaaaaaaagaaaaggtaaacggcgaagccttgccgagttagggcggcaacaccaaatggggaaagcaatggatgaccctgtgtacggccagaagaggccaggactgaccttgtagttcatcctgtccttggccagccgagggatgagcctggctacgttgtagatgtcgttgaccaggccctcgatcagtgccaggaagccgcgatctgagcccacctccagggtcgggttgaaggtcagcccatcctcgtccagctccatgcggatctcaaacaggggagcgatactctcctgaaagaggggtggggttggcagtggtcaacacctctgtcctccatcggatgattctcagtgccctgatcatccactccgtaccatcaatgtgtcactgccttccacttatctgggaagcttctgagagctcgtgtctcagcgcaccccgctccttgagcaatcgctacagagccaaatgtacagccacaaggccaaaagcaggcaggggcaggttggggcaaggggaggggcaggatcaggtagaactcagacctcggttcaaagcccacacctgctacttgccagctctgaggccttggggagtcacttaactcccagtttccccaaatatataaaatgaggctaaatattttatagaatggagacattgttggctaggcgcagtggctcatgcctgtaatcccagcactttgggaggccaaggcgggtggatcacctgaggtcaggagtttgagaccagcctggcccacatggcgaagccccgtctctactaaaaatacaaaataattagctgggcctggtggtgggtgtctggaaccccagctactcgggaggctgaggcaggaaatcgcttgaacccaagaggcggaggttgcaatgagctgagattgtgccattgcactccagcctgggcaagagcaaaactctgtctccaaaaaaaaaaaaaaaaaaaaaaaaagaatggagacattgtttccattgttctgggttactacaggggctaaatgaatcactgacacacaaagcaggtactgcaggggctggccaagcctgcctgtccctctcccttggaagtccccgtttacagagttctggaggcccctgtgaggctgcagggctgcaggtgctgctctggtttacagtgatgggattgagaacccaagtgctcttcctgccaaactaacgattctcaaaatgtgggccaggatccaccaggctgtgagatcacactgtggccactgatctccccctgaatgagtccccattggacctgtgggttatgagcttttgagccccccaatttgtctatgagcaggagggggctgtatcagtatctgagtgaggtgctaattgggacaaacggtcaattgtgtgaccagacttctctaaagactcaggtcggctcctgcccccaggctactcacaaagtaggaggactccctggaactctttgaggagaaccctttgttactgggacttctttatggtttttgttgagacgctttcactgggacagtctgtagtgacgagtactttcgtcaactgaattttgggtctgtgactggttaccagctggcatctgagacccatatgccagactcaaacaccatccaccctccctggtcggtacaagggcacgacactgccacgttcctttgttgttggtagcctgggggagcctttgatcttggcctcctggcggtactcaaaatcatttagaaaccatctcaacaaaaaagatgcagggctgggcacagtggttcacgcctgtaatcccagcactttgggaggccgaggttggtcgatcatgaggtcaggaattcaagaccagcctggctaagatggtgaacccttgcctctactaaaaatacaaaaattagccaggcgtggtggcgggcacctataatcccagctacttgggaggctgaggtagagaactgcttgaacccaggaggtggagtttgcagtgagctgagatcatgctactgcactccagcctgggcaacagagcgggactctgtctcaaaaaaataaaaaaataaaataaaaagaagatacaggtaggaaaggggccattgccatggaaagcatgcctccatgggattaaccagcacaacctctttgctgactggtttaccttctactcagccgtatataatcaagtaggtgagtggctgttgttgctgacaggagaccctccccccaatccacatgagtagggggcagtggtgtccactttccttcacctggcagtgaggcaggaccagcctcttaggtctcttgaggttttctgcagccaatttatgttatggcagatttaaagtgaccagtggtcctgagtgcctgggactgaggggattctggaatgcaggacttccaggtttaaaaccaggtcaagtagattgcataagatatattttaataagtctatttataaaatgatagcctgttcatcaagaaactagaaactatagattctaacagataagaatacatatacataaatatattaccttatgttgataacttacatctataaccatgttgtccattaggaaactcagagatttgcgaatgaactggtcaaattcatctaagaccatgtcgtcaatgtagatgacataatccttccagggcaggctcagtgtgtctgccctgaatagttctgcgttttcctgcaaacagaagcgcacagttgggcctcacttcactggctgtgcttgctctttgatcacactgtttagtgcctctctggaccgcccgtccatgttcacacgccggacacacggggctgctttgagcatcttgctggtgctggccgccttcctactcgaggctttgcacggctgctccctcactttcttgctgggtctggcttccaatctttttgatttcagctcaaatgtcccttcctcccaaaggaatcctccatctctagttgggtttcctctagcaaactgttatttatgcctaccatggctcagagggccactcagaattattttatttgtctttgtctttggtctgcatgcccttttgatgcccaaattcatgaaggtgaaggttgaccatcctctccaccactgtacccccagcactcagcagtaggcctagcacagagcaggggctggtgggtgggtggggtgggtggatggacagatgaatggggtggacggatagctggatggatggatggggttggtagatgggtgagtgggtggatggatggatggatggatggatgggtgggtgggtgggtgggtatgtggatgtgtgagtgggtgggtggatgggtgggtgggtgactgggtgggtgggtgagtggatgggtggatgggtgggtgggtggccgagtggatggatgggtacgtggctggataagtggggtgggtgaatgaatagatgaatagagtgggtaggtgtgtgagtccatggatggatgaacggggtgggtagatgtatgagtagatggacagatggatgggtggatgggtggagagatgaatggggtgggcagatgtgtgagtagatgggtgagtgggtgggtgggtggggtgagtggatgggtgggtggggtgggtggatgggtgggtggggtgggtggatgagtggacagatgaatggggtgggtagatgtgtaagtaggtggatgggtgggtggatgggtgggtggatgggtggatggatgggtgggtgggtgggtgggtgggtggatgggtgggtgggtgggtgggtgggtggatcggtggatgagtggatgggtggatgggtgggtggcgtgggtgggtgagcggatgggtgggtgagcagatgggtgggtggcgtgggtgggtgagcggatgggtgggtggcgtgggtgggtgagcggatgggtgggtgagcggatgggtgggtgagcggggtgggggggtgagcggggtgggggggtgagcggggtgggggggtgagcggggtggggggatgagcagatgggtgggtgagcggggtgggggggtgagcggatgggtgggtgggggggtgagcggatgggtgggtgggggggtgagcagatgggtgggggggtggggggtaagcaagcagatgggtgggtggggtgggtgggtgagtgagtggatgggtgggtagggtgggtggatgagtggacagatgaatgtggtgggtagatgtgtaagtggatggatggatggatggatgggtggatggttggatggatggatgaatctctaggatactaagtgctatagggaaactcaaagattaatttcactcagtctataccctcaggcaggtctattctaataagggagagaagacttgggctcaaataacttcagcataagataaaaagaaatggctctaatgactgtcatgagagtagccatacgtggtgacagagttgtgcacaagagacaacaccatctcatcacagttggggaacagaataggctggcttgttgcctctgcccctcttaggctcctgtccctgctgcttggcttcaacctcagcccagtcctgcctcctcgcctgccctcttgctatgctcctgccctctgaaactttactaaccctaagtcaaatctctctcctgtgctctgtttccaacccttctgagagtgttaacaagctaatcagttaactcttccaagtaacatttttgcagtttagcattttaattcagagggagctactggcaccgtggcagggaggggagggatgggaactgggaatgaggcacaacagactctggttcagtcaagtcacttcctggggtgacgatctttagagcaatgatgtgacaataggaacagccaataatggcccatcccccgggtgtggcctgctggtctgtctagatgatgtgactcatcattaaagtccacaccactgatttgcaccacccactggaaaccgccccccccaaaaactgccctaaaatacttttttttttttttttttctgaggtggagtctcactcttgtcgcccaggctggaatgcagtggtgcaatcttggttcactgcaacctccgcctcccaggttcaagcaattctcctgcctcagcctcccaagtagctaggattacaggttcctaccactatacctggctaatttttgtatttttagtagagacagggtttcaccatgttggccaggctggtctcaaactcctgacgtcaagtgatccacccacctcggcctcccaaagtgctgggactaccagcgtgagccactacgcccagccgttatttgagctcaagggagaatattctcttttacaagccaatgcaaagctccacctttcacattctcctcagagacaaactaaaatgcaagctgggtgaaattactaccaagtgaggaggatatgaaaacccctacaatacaatgtcaggactccagacaaagcacccaggaatgccagtctactgttctgcattctcccactgaatgtgccaaccatgggggctcccaggaggctggtagggacatagagtcatatgctgttgggactactggcaagaaggaccagctggcatcctaggtagcaaagcaggcgtgcattatcacattctacccattcacatatgcaggtagtgatacaccctgtgcacgttcaaatggtcctcgctcttcccatgttactgttccctacccacactcatggatgggaaatccacgggggataccgataaacacacggtgcccaccctcggcagctcatcctgggaagacaagatttgttgacctagtatgaagacgttacttggccatacccacattgtgctgggcgagggctctggtacccttagcagagggcaggcccatcataagaggaaccaggcttggaagtgtacagcaagggtggtctactacttaaagataaggctcgcttggattaaagatcataggttttgttttgttttgttttgagatagtctcactctttcacccaggctggggtgcagtggtgcgatcttggttcactgccacctccgcctcccagggtcaagcgattctcctgcctcagcctcccgagtagctgggattacaggcatgtgccaacgtgcccggttaatttttgttttttttttttttgagacggagtctcgctctgtcgcccaagccggactgcggattgcagtggcgcaatcttggctcactgcaagctccgcttcccgggttcacgccattctcctgcctcagcctcccaagtagctgggactacaagcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaatttttgtatttttagtaaaggcagggtttcaccacgttggtcaagctggtctcgatctcctgacattaggtgatccgcccgactcagcctcccagagtgctgggattacaggtgagagccactgcatccagccaggtcacagacttctatgactacaagaaatgtgtcactaatcatttttatgaaatctccagccctgggtttactctctcctccctgctaaaagcaagtgggttctcaaaaaacctcctgggtgtttccttactgcaaccatggcttggatcttcactccagcatccctgactgctgcgtagcgcttgttgaggttggcaattcttccatccaagtctaacagggcctctttcttattgtcctttctttcaaacagcgggttggccgaccagtcctggaaggaaagcacaggagtgagaaaaggtgttctggagaaactgctttcagtcgcagtcctttgctgtgtgcttttgatgtgagtttcgtcactgctgcctgatcttggattggagtctagttctccacgatccatgcccatcaggggctactaaggacctgtgcctaattgactgttgaccagagaaccttaaataatttagctcaaaaccaaaaccagggcctaggggaaccacagaaagaccattgagatgtttcactcaactgggccagaatggggtcactctcaggaaaggagcatctaattctctctttagggggacggaaggacccgagcgtcgaggagtgtgtggtcaatactgggtggatcgtccatagctgcaaacggagggccacgtgggagtaagtcccttttgtgggggccactgatctgccgacaagggtgggaaagggtagagagtagggtcaggaccctggctcccctgcaagtgggagttctaccacaagggtggtggccacttggccgggcgcggtggcccatgcctgtaatcccagcactttgggaggctgaggcaggcggatcacgaggtcaggagatcgagaccatcctggctaacacggtgaaaccctgtctctactaaaaatacaaaaaattagccgcgcatggtggcgggcacctgtagtcccagctaccaggaggctgaggcaggagaatggcgtgaacccgggaggcagagcttgcagtgagccgagatcacgccactccactccagcctggggcacagagcgagactcagtctcaaaaaaaaaaaaaaaaaaaaaaaaggtgggggtggtggccacttttaattatgatttggactttactgttatctgtcattagattttttttccctacacatctccattaaagtgatacatatatggtaacaaaacacctaataagttttttttgtcaaaaaacagtctttggccatatctccctatcctccatcccatcccccactggaaacatgagggaacctcacctttcctcctcctcacggctgcctctgtcactcttatcatttacggactctacatcatcaattcagctgtttctcagctgcctctgtgactctggggtgaacgatgaagacttagatcacccgcctccctcctctggccagtgtttgatatttacgtgagtacttatagtttttctactgatgcttttgtgtgaacataaacgatatgattaagcctgtgtttaccttgttagaaggatttcctttttttattagcagttttattgcttcatggtcagaaaaacgcgttctgtatatgtcttagtcagcttagattactataagcaaaataccatatactagggggcttaagcaacagacatttctcacaggtttagaggttagaaatctgagatcaaggtgccggcatgtttggttccaggtgagggctctcttcctggtgggcagatgatgatggccgccttcttgttgtgacctcacatggcggaggggcagagtgagctctctcatgtctgttgctataagggcacgaatctccttcgtgatggctctattctcatgttctgattgcctccccagggccacgtctccaagacccatcacagcagggatcacggcttccacaaaggagtgtttgagagtcacaaacgtacagtccatggcagtataataatgctgtgttagccttcccattacatttgcgttctgcccatttttcaactcttctaatagcttttgcttttatttatatagctatattaacaatattctcattgggaacacaacattttaggacaactataatttttatatagattttacttgattttgtatggttagctaaatatatatttttgcctctagttgttctttgctgattaatattttatgtgtatgtatgtatgcaaggatgtatatatgtctgtgaataagactaccatttgaaatttttttttttttcctttgaaacagggtcgtgctttgtcactcaggctggagggcagtggcacaatctcaggtcactgcagcctcgacctcccaggctcaaaagtgatcctcccacgtcagcctccagaatagctgggaccacaggtgttgtccagcctgagcaacataggaaggccctaggctcaagcaatactcctgcttgggcttcccaaagtgtttggactacaggcatgagccattgagctcggctgtgagaactgccatcttttaaaggtcaaaaatggtcaattattggaagtttcatatggtttcacctacttgtcaatcattttatcttcaacctttccattttgttttagatatctcttggaagtagcatataactacatttttaaacaatctattttgcttttaaatactttatatatactgtaactaatgtttgccctttgttatcacgttttatcctttctgctttctcaccgtttccctttgttgtggtattttgctttaaaaactatagcttatttgcttttatattctttactgatttggataggagaaatcctgtttctaattccactagaacttgccattaagtttattaagtcttttaaatgtttctctaattttggaaataaaaattgcagctgggcatggtgattcatgcccgtaatctcagaactttggcaggccaaggctgatggatcacctgaggccaggaatttgagacctgcctgaacaacatggtgaaaccccatctctactaaaaatacaaaaatttaccaggcatggtggcccatgcctgtaatcccagctatttgggaggctgaagcaggagaatcgcttgaacccagaggcggaggttgcagcaagccgagattgtgccattgtactccagcctgggtgacagagtaagactccatctcaagaaagaaaaaaaaaaattgcttttgattctcattatccacgtttaggaattcaggatatggttaacttccctgccccaacttttttcctcctcctaactaccaattatcaatcatgtttatcaccatggatatggtttctaccatttatatttttctacaagtattgcttttgactttggaatgtaaccttttacaaccgtatttatctctttatatacttacctctttatatttaattggttccaagctcattgctagtctttttaaatgttaatgctctccttggtactctagaatgtggttgacctcttggtatcctggaatacatcctggaataggtttctcaggaagggtatccaaatggtatttttccaagcccctgcatgtgtgaggatgactttactgctgcattcacagataattgtcaggagtctttctcaagactggccatttttatcatgttctggagatctgtgtaaagtcaaaaggctgcctgatttttgtttctgtgtgggctacctgcttggtagaaacatgcagaatattgttctgtatccttgggattgtaaactttggtcagaatatgtctacatgtgtcatctggcctggaaatcagttacccactttgaccaccacactcaggccttcctttaatttttgtctccccagcttgagaaaattttcttctattacatctttgttcattactattttttttttttttttttgagatggagtctcactctgtctcccaggctggagtgcagtggtgtgacctcagctcactgcaacctccacctcccaggttcaagcaattctcctgcctcagcctctctagtagctgggatcataggtgtgtgccaccacacctggctcctttttgtatttttagtagagacagggtttcgccatgtgggccaggctggtcttgaactcctgacctcaagtgatcggcctgccttggcctcccaaagtgctgggattacaggtgtgagccaccatgcccagcctattacttctttagtaacaactatgatttttatgttgttcgtctccctcatcttacacattatctattgttatttccctttgcatattagcaatttcctaaaattgtcctccgtttaatatatccactgttacacagcactagttctagtctaactggtgcttcagtatattttaattctgcttttgcagttttgactttcttagccatgtcctttcccttctctgctttcctctcattctgttcttagttctcattctgttgttatttcgtagatgtcatggcctttttttttttttttttttggagacagagtcttgctctgtcacccaggctggagtgcagtggcacgatctcggctcactgcaagctccgcctcctgggttcacaacattctcctgcctcagcctcccaagtagctggaactacaggcgcccgccactacacctggctaattttttgtatttttagtagagacggagtttcaccgtgttagccaggatggtctcgatctcctgacctcgtgatccacccgcctcggcctcccaaagtgctgggattacacgcatgagccactgcacccggccacggcctttttaatttaagaaaaaatgtcttaggtttactaaataaagagcttcagtcggtctgtgtttttctgagatatctaaacgacttgttactctcaaatgctgcacaatctttgaacagcctccttttggtcctaacccctttgctgttcacacctgagggctaagggcacagcctgagaatgtacaaactccaaacaggaattgttgattccaggcctgatggactgagtttgagccattttcttttcctattgcttggttttctcactaagctggggagctagatgctgctggctgtcatgtctgtttttgctagttttgagacggcatctgagggcatgtgcctgggagccagtgttctccccggctctgcttccgcacctaagtgcagagcatgctggtcccctccaccaagccccttggctttcagcctggtcactgtgcagctgctgcagcttcagaatggacgtgatgaggaaagtgatggggatggagacacaggaggtcagctgattctgtgaccagtttagtgattattctccttataatgggggttagcagagcccctattgggtgagtgttatgaactgcacgtctgtgttctctcatctcccaaaattcacatattcgagtcctagctcctgtgtggttgtaataggaggcagggaccttggcaagtgcttgggtttagatgagataatgagatcatgagagtagggcccacccctgatgaggttagtgtcctttaagcagagaaagagacaccagagcaacctctctctactacgtgaggcacatcgagaaggcagccgtctgcacaccaggaagagggccctcaccaggaactcagtctgcagtattttcttgtagcctcctgaaatgaccaggacagtgggcccaagtgtttgccttccctcctcggaggtcacctttgcttttctgatgcagaggtgaacttcttcaaaactcacccctgaacccaacaacctcagaattggcaaacagatcattccttccttggtgcccagagacccaactaccgggcttcagcatctcagctcagcaccaggagaaagcaaatactttgtggtttagttaaaaacttctggtgcaaacaagctagctcaggtaaaggggggtttatgtaagacagtgggtctcagagacagagagaaagtgctgccctggtcctctgtagcgggtggtgggcagtggtcaagctggggcctcaggggcagcaggaatctctgcaggatctgcctccagagtgggcctcctcccgtctcctgctcgctccccaccgcccagagcctgcagccaaccctctgagaccctgcacctgctgcggcccctgctgaagattcagaagcccgtggggtttgaacggcctggtttctggatttaacagttcagtagaggagagagagagaacagccacagaggaggctgggtgagcattgcaggtaacagaaaggacagagaccccttggcatgaaacaaagtgaagagatcgagaagccacacgtgcagagacagacaagagacctggcccccagacctgagacactggggaaatggcctgtgtgccagagcagacagggaggtgtggggaggcgtggggaggaggaggagcgacgtcatgcccactagctggcgagacaacgccatcaacaggctagaagaatgttacgacgtccagcggacattaacacaaggaggcacacgtctggacactttggtgacattttctgaccctaaagataacgaagaactctgcacgccccagacagagaggacaggctcatgcaggaaggaggcagagcactgccagcctgcccagcactgaaactgaggcagggctggtaggggctgaactgtgccccccaaatccgtgtgtaggggccctgacacccatacctcagaatgcaatggcatttggagatgagagctttaaagaggtgcttaagttaatatgaggtcattagtgtgggccctcatccagcatgaccagtgtccttatgagacaaggagatgaggacacagacacacagagggaggaccctgtgaagccacagggagaagacagcatctataactaaccagagagtcctgggggagccaaccctgccgacaccttaaccttggccttccagcctccagaactgtgagaagagaaacgtctgttgttgaagtcgcccagactgtggcagtttgtgatggccgccctagcaaacacacacagggccgtttctggagcagtgaaagaaaaggaccgtatcaagaaacccctgacctggacaagatcattgtagatgaggtcaaaagaaagatattttggacaagggaggactcaaagtatgctatcaatgagccctttctgaggaaattgcgtgagaaattattcccgtcaattgaaaattgaatcagagccagatgcggtggctcacgcctgtaatcccagcactttgggaagctgagacaggcggatcatttgaggtcaggagttcaagaccagcctgggcaacatggtgaaacctcatctccactaaaaaaacaaaaacaaaaacaaaattccttttggatatattgctgcaagtgtttttgcacattagagcatcagtgacagaccagaccacctagaaggctaatgaaggattcccccagtgctccggaaggagcttgagttagaactgtactgcttctgtactgagcaacgggctcgttcccagtgggggtgagtcttggcagatctctttccaccccttgctactggcactggcctggcacagagggggccttgtggagctcagcagaatggagcagaactgaatttcacagagcaactgggctctttctgccctgggaccactctgatatcatcctaccggtggagagcactgcacggcagctcccactgcaccccacacatcgcagcactttccatgggcctctacgtagcctggtttgccccagggcagccccaggcccccacaaagccccactctgtgctctgccccttgcttaccttcatagcctgggaaattccttctatattttgttttgccttttgcatcctgttctgcaagttgtgcagaatttctcgcacctcttgaatgtactgaaacacacctaaaatggaaatgtagaggaatcttacaaaatgaacaattcaggctgggcgcggtggctcaagcttgtaatctcagccctttgggaggtcagggcaggcgaatcacgaggtcgggagttcgagaccagcctgggcaacatggtgaaaccccatctctactaaaaatacaaaaaattagctgggcatagcagtgggcacctgtaatcccagctactcgggaggctgaggcagtagaatagcttgaacccgggaggcagaggttgcagtgagccgagattgtgccattgtactccagcccaggcaacagagtgagactctatctcaggaaaaaaaaaaaaaaaattcagcaggatgaaaacttttcttgggttggcttaacactcatcactatgagacagccctgggaaaatactcctattctggaacatgattcccagaagaaatcgctgggcgttctctgaaatgaaatgccaaggaatcacaaatatagtgtccctttggacatagggtttggagaatgtgtggacccttcaccccacgtaggagccccagactcctcacgttaaagggttccacctctgggagcatcagagatggggccagggggtcgggggccttctgcctcgtccagtggtggaatgaagggaagacagggactcgtgactacacttcttcctactttgctgacgtctgccctgagttagccaagatgtgcaccagctctgctcaccagctgtgcatgctctgtgcatgcttgataaaccaacagtggaaactgggcctccagcaagcccagtttgggaaacttggaaacctcttggcagttcccagggagtctttgccggattccgtttctaagtgacacagatgggctttttttttttttttttgcctgggcaggcaggtggaagtaactatcctttagcccccttgaagttaaagcagatccacacagccaggaggcagaagtgaccactctagtggtgtttgaggacagatgctgggcaggttggactcccaagtttaatccaatgtgggaggaatgtggcctccgtaccttcgccattccagaataatgtcgtttcagcgctcaataacttgacatcaattgcttccagttctgactttattagtagaaattctactgccttcactatagtctttatctgaaaaacagaggtgacaggttttgttccgagtccaaccagattttaaattgttctctggtaaggaccttttattcctcaacaccaactaatacggtttggatctgtgtccccactcaggtctcatgttgaattgtaatccccagtgttggaggtggggcctggtgggaggtgactggatcatggggacaatgatctcatgaatggtgtagcatcaccccccgatgccgttcttgggatagtgaatgaattctcgtgcaatctcctttttaaacaggtgtagcacctcccccacttctctctcgatcctggcttgtgccaagtgatgtgcctgcttccccttcaccttccaccatgattccaagtttcctgaggtccccccagaaacagaaaccactatgcttcctgtacagcctgcagagccatgagctaattaaacctcttttctttataaattacccagtcccaggtttttgtgttttttttttttttttttttttttttttttttttttaagatggagtctcactctgtcacccaggctggagtacagtggcgtgatcttggctcactgcaatctctgcctcccgggttcaagcaattctcctgcctcagcctccccagtagctgggactataggcatgcgccaccatgcccagctaatttttgtatttttagtagacgcagggtttcactatgttggccaggctggtcttgaactcctgacctcaaatgatccacccaccttggcctctcaaagtcccaggtgtcaagtatttctttatagcaatgtaacagcctaatacaccaacaaagccaatgatgattgttttttatttggaaatcgtatttcaggacactccacaatttttagaatgacttttatcactgaggatttatgtacggttactgttttatgttatagtattcctatctctttctagcccataccatgactaattaagaattaactgtgtataggttggtgtaaaagtaattgccatcttttccgttacttttaatacataaatcctcagtatataatcacaaaggtttgtacttgatttctttttgtgattctaagccaaagaaatacatgtggatcactgagcatttcttggctcagaccctttccctggtcaatctaaagctcaaaatcttttttttaatatagagatgggatcttgctatgttgcccaggctggtctcaaactcctgagctccagccatcttcccacttcagtctcccaaagtgctgggattacaggtgtgagtcatggtgcccagcctaaagcctgaagttcagttatacaacagaaaacccaggatctgcagagaaactattcaagttgttaatggatcagtgttaacaatagtatagtttctcactttgggaggccgaggcaggcagatcacttaaggtcaggagttcaagaccagcctggccaacatggtgaaatcttgtctctactaaaaatacaaaaattagcccggtgtggtggtgtgcacctgtaatccctacttgggaggccaaggtgcgagaatcgcttgaacccaggaggtgaaggttgcagtgagccaagatcgcaccactgcactccagcctggacaatagaatgagactctgtctcaaaaaaaaaaaaaaaaaaaaaaaaaaaaaaaaaaaggataggttctatatagttttgttctagtttgccctactctaagaaattaatttaatgcttgaaatcctgaatttacaaaacagaacaaacaagggagaagttttcatgattcccttaaataataagcaccatttaggcctaggaatctcatcgtaccaagcaacatcttgtttcatgacttctctaggacccttctacatgaagtatggaatcacagagttaaaaatacacactagatgctgatttgcctttcagaataattctttacatacattttggtactttattttttgagacggagtctcgctctgccacccaggctggagtgcagtggcgtgatcttggctcactgcaacctccgcctgccaggttcaagcgattctcctgtctcagcttcctgagtagctggaactacaggcgcccaccaccaagcccaggtaatttttttattttttgtagggatagggtattagcacgttggccaggctggcctcgaactcctgacctcaagtgatccacccacctcggcctcccaaagtgctgagattacaggcatgagccactgcgcccagcccattttagtgctttaaatagtgtacttccacccatgccttcgaatgttttctgaccattaactcgtaggataggtgcttaggaaagagaaatagagtataagagctgttaccggctgaaaaccagacagaagtaaaggatgcatctacaggattacaaagcaagacgatgtgtagcaggattccgtccatcagggttgggttgttaaacaatgacaaggacagtggtctcttcccagtcgaggaaccctgctctgagactacaccctacgtgagagaatctcagaacacacctctttagtgtgctcgtgactaaatcatggtgctcctaccatacctggagtccaaggcgggagctctttagacagaatctaaccagctggagaaaggtgctgtgtttctaatgaatggaccatggacaaagatattacggcccctggtgatcagaatctggggagccctgccacggctgccggggagaggagcaagattccgtcacaaaaaaaaaaaaaaaaaaaaaaagaggcaagaaggtcaaaagagaaggcatcagtgtgatgacggaagcacaagttggagtgatgtgcttcgaacatgaaataatgtggccgcgagggttaatttgtcaacaggactgtgccacagggtgcccagattaaacatggtttctgaggtgcgtgaggttgtttctggatgagataagcattggaatgggtgggctcaggaaagcagatagccctccccagtgtgggtgggtctcatccaaccgttgagggcctgaatagcacaaaaggcggaggaaggaggaattcaccccttgtttctgcctcatggcctgagctgggccatctcatcatcttcagcctttggactgggatttacaccatctgttcccctagttgtcaggctttggactcagagtaacaccacctgctttcctgagtttccaacttgcagacagcaggctgtaagacttcttaccctctgtaattgcgtgaggcaattcctcacaataaatctccatatatacatgtctatatctctgtctgtccatccatctccatccatccatctgtatctatcccccccatctatagctatctatccattcatccacctatataatctatccatccatctacctgctttcctatctctctagctaccgatctatctatccatccatccctccatcctcccatctgtctatcccattggttctgtttctctggagaactctaactaatacaatggccatgagcccaggaaggtgcagcctctagacgctggaaaagacaaggagacagaccatccccttgagcctccagaaggaggcagcccagcggatgccttgactccagcagaatgaaacagatccaggacttctgacctccagaactagaaggtaggaaatacgtgccgtttaaagtcactcagtttgtggtgatttgttacagcagcaacaggaaatgaacagtgtccagactggccctgttgtactgtggcttggggtggggtcaaagttgtatggtacaaatggtcgcctttcccagggtatatgagtggaatccataagaaatggtgtctagaaggaggacaagcacagtgactgcccgctgagccccacagccacgctctccgggcccctcctgattgtacagggatgtttgtagcagctttatttgtaaaagcgaaaactgaaaacaacccgaatgcccatcaacagaggaatggataatagtgctatatccatgcgacacattgccactcagcaataaaattgactcacgtttaaaaagaagaagaatggtgctacatgcaacaacatagattaactcaaaataattaaccgagtgaaagcagacagagaaaacagaacacgtatgataccattgccctccggttcccgactcggcttccagggcctcgtgccaggaaggaggtgccctcaacaagccctgtgttgctggacgggaccgccccccacctccaacaattactgggaagtttttccaaagtcaacctcttgattactgcgtcaggtccctagatcagatggtgccaggaatcaaggccaaaaaggagttcttgaaccaaagagctgagcagggaccgccacctcctagcccctcacacacagcttcctcatgataatcctactctgggttccaggaaatgcccatccagtcctccccacattaacagaagtaatggaagcaatgttgaatgactttaatattatccaaaatttgttcaggagggtaaatagatctataaagaatcatgtaattggccaggcttggggccttatgcctgtaatcccaacactttgggaggcagaggcgggcaaatcacctaaggtcaagagttcgagaccagcctggccaatgtggtgaaactgtgtctctactaaaaatacaaaaattatttgtatttttactaccaccagctgggcttggtggtacacgcctgtagtcccagctactcaggaggctgagccaggagaatcgcttgaacttgggaggcagaggttacagtgagcctagattgtgccactgcactccagcctgggtgacagagtgagactgtctcaaaaaaaaaaaaaaaaaaaaaaaaaaagtaacgtaagccaaagcccagtgggaataagatattcatcaccagctgttctgagtcatcactatctttgctgctatttgcatgaataatgaagactggcttgaaccatgtctaaatattaaaatacacactaatttaattctgttctgcttggagatcttacaccagaagttgttgggtgacaacaaatgctggtgtaagatctccaagtggaacagaacaggacggcaggacagagatctctgactccctggctcaggaatttatcccaagcacatacacatagcaggtactcagtaagtatgcagtgaatggaagaatgaatttgagtgaatgggaagatttcccaggaagagccacatctctgaaacacacaaacaaacttgacaaaaaaccaaaacaatacaaagctgcatcaggaatagtaccgactcaccaactcacctcattataccagccaacgatgagctccaggttgcccacaaacttccggaaagtttcgttctctgagaacagactctccgcactgtctggaatctctttctgttgctggaaattcaaatacttgacttctctcagaactgccaccaactaaatgacaaacgaagatcaaagaacatgtcagcaggtcaggtcaacagtgcagtgttcaagcaacagaaatgagcatctgccctgggatgttttgacagccgggggggatctcaaagttggtgggaggcagtatttgttggcaggaccaggacgttttcaccctgttggctgatcctgagccggaaagcactgacatcaccctcatgggtggatgacatcaccctcatgggtggatgacatcaccctcatgggtggatgacatcaccctcatgggtggatgacatcatcattgcatgtgtatgacatcattgtcatcaccacgggtgggtgacattatccttatgggtggatgatgtcatcattgtaggtggatgatatcatcatcaccatgggtggctgacatcatcctaattttcttatctctgtcctctcctacctactacccacaagtggtttggagtaagacttcgggtcttcacttgtttcctcgctggaatctaaccttctgttttctctctgctttcacccggttatgacccgagatcaacaacagggacatcccttccaacagtgcttctgtccacaaagctattctcaaagttgagataacctccatattgctgaatccactggtcacatcacgggcctcatctcatgggatcgcccagccgctggcactctttccttctgggcacacagtgtcctcctggcttccaggacactagacattcctggtcaccattattagtctcttttgataatctcaagatgtccatgatggggagccacagaccttgttccttctcaatttaccctcagttgaatgaggtgtgatgtcatccaacgttatagctgccttgaccagccagcccatttgtcatctccgctgaatgaggtaatgagatgtccagtgttgtggctacaagtaccatctctgtgtgggtggctcccacgtttatgtctccaaccccagcctctctcgtgacttccagccttctgtatccacccgcctactcagctcctctctttggatgtccaggtgacatctcacacccaacaaggctaaagcacagcagcccatcctcccctgtggcctctgccccacctgccctcttggccaatggcaattctacctgtctactcacctgaccctaaaacattgggactgactcccctcttccaatcacgctccatttccaacctactaggagtctccatggcactatattcaagtccagaagctcaccaccaccttcactgctgccactctggttccagccaccacctcccagctgtcatctcttgcctggactgtgccaacaggctcccaactgattttcctgctctttcctccagccccagctccgttcaatctacgcacctcacagcgtggagaagggtcctttacaactagaaatctaatcgcagcacacctctgtctgacaccctgcaggggctgccatcttgctcaaaccaaactccaagtccctctgtggtccatggggcccttcctcgtcacctctcatctcttctcctacgaccttcccctttgcccattcccccgccccactggcctccttgctgctcctggactgcaccaggctctcgggcgccacctggccttttctttacccgcatgccgtgctgcaaagctgttccctccatctctgctcagcggcactctgacctcccacaagtctctgctcacatctaaaattgcacctgccccttctaccggctctattgatcttcttaacctgcccttcctgctcttccttccgcggaacctgttgcaccttctaccatatcatacacttgactccctcgtgaatgctagctgatcatcctccccgccctcctgcctggaggtaggctctaggagggcaggacagacagctctctgactgtctggatcactaatttatcccaagcacatacatgtagtaggtgctcagtaagtatttggtgaacgaaagaatgaatgttagtgagtgggaagatttccaaggaagagccgcatctctggtttccctgccttgccacgtgcagattgggcagctctggggctgtgcttgtaggaattcggttccatcctctgctcatctgaactttccgggttttagccatagaacccacatcccagagcccacaagtgtgaattctccccagtgtgcctgccttgaccagccagtgcatttatctagattcggcaaagactttttccccccccccagtttcaaattgtcatttcttcttgggatcacaggaacgctttcaagaagatactcattgaagctattgtcaaagttgcttctgctttccctcatgtcttaaatataccctggacacacttaagaagtaaagctttaggcgaactgtgatataaacatcgacctccataaatccgtgctgagggaaccttggcaggccctccccccgctcccaaggagcctttgacgcggtccccactcctggcacccaccgctttgctgaagttgacgtggatgaggttgctagcggcgtcccgcagaatcagcggctgccccaggttaaagtggcagtcctggtccacgcccgccacccactgctggtagatcttctcgcggtggcacctcagcagctccatcatctcgtcatacttctgataggtcagcttggcctctgctccagacatgaccctggaatcagagcgggaaggcgaggccccactggatatctcctgtggggtgtcttcggcacgtcccatcgttgctgcccgatctggggtgccgaagcggccggccacccaattactcgaggctcacagactgaatatgcaaacaagcagtggccagaccaaatgttcaaatggaactccgacctgcagtctgcagccaccagcccaggaggccaaaatagaacccacgcagcaactggctcccgaccgccaggcctggatgaatgacagccagcccctctccaactttccttctcccttccaacctggggccaactagatgaaagcaaatacgccccccaaacaaccacataaaaggcccccctcctagtcagctgcaccggcctccccaggccaagccggggctcccctgcagccgtccctgcgtccaccgtgaagcctccccggcccctggctgtccaggagacttggccaagtgcacgcaacagtggctcagtcagctgcatacacagcctcttcctgttcctgcctgggtggtcttcatgtctaccaggctggtgggcaagggtggggaccagccagatttctcctgagcactcccaccaagaaggtgatcaggggaggagggaggaccagaaggggtctcttctgggcttttgctctgggaggtaacagtctggtcgacaggaggggtggtcccgctcggggttgggacagtccctctcgctctcccgcaccatggaggcggggtgcctgcccctgcccagggctgtgactcacgggtgttcgacgtgcttcaggtgtttcatggacacctctagcctctcctgcagctccaggctccatttgagctgcccggccacgggaggcatgtttttgtggatcagggggatgttcccctcctcggaggccgccatctgggcatcgtacaagatcttagcattgtctagctcagcgtcaaacagctccagcatgactgaatacctgggcgccacctcggcaagaatcaggggccgctccatgaggcccccacacatgtacaggagctgaggacaaaggagaagggggcctcttcaccacagtctcctccccttccccagcctgtggctgtggacaaaacgggcagggccaatcttcaggagtgagagaatgtgtaccttgccaaaacaaaacaatccactggaacctttgtgtgtgtcaactggctcagtggaagcctctatgcttttctcattgacttaggccgagtccccaaatacttggcttataatcccacagtacaaataagtccaagggctacaagagttttttctaagcctaggaaaaatcagaattctggtaaggaagacttaaacaattaaaaaataggctgagcaccatggctcacacctgttattccaacactttgaggggccgaggcgggagggtcacttgagcccaggagtttgagaccagcctgggcaacacagcaaaatcctgtttctacaaaaaataaaaataaaaaatacaaagaatacatgaaactagcggggtccagtttttgtattcttttgggtgtgcgcttatagttccagctactcaggaggctgagatgggaggattacttgagccccagaggtcaaggctgcagtgagccaagattgcaccactgcaccccagcctgggcaacagagcaagaccctgtctccagaaaaaacaaacccaaaacaactccaagtaaacaattttaaaatagccataacgttgcatttatatacctgggcttctactctgatacagataaatgaagaaatattttatccacaggaagcgttcctcttaggaagagcactgccactctcaagggcagctgaggcaagaaaaccaccatcaggaaatgtgtttcgctctgagaaagctctgggggtcagaccaagtgggagggggaccagagagagggaagacaacctcacacgaaacagggtcccccagtgctgggtgtgagtgggaaatccaagagagtttcccggggctgccataacccacgcccaatgggggccagaccagctgcggtgagcctgagtctcagactttccccagacttgggtctgagaaaggtgaccactgtccctagaaatggccacaggaggaaaaaccaaaacatgactgcgaagagagggagatttttcaggcccccaagagtacagatttcccaaatgcaagattgcggctatttttaagttaattgtgtttttcaaaattgttcaaatcttccttacccaaattctgatttctcctgggcttagaaaaaaattgtcacccttggacctatttgtattgtgagttgtacaaatggagcagccgtggactctcaggcagacatggaaacgctggtgtcctgccagctaccgccttcctccacggtcgcctgctgacgtatgaggtcaccagtttcatttgttcaaagcattgacatggggcagttggaaaaaaaaaatgttcctcttaatggtttatgactatcctgtaatgcgggtagatgttttacttggaagtcagaaaaatagaaaaaaaccccaaaaacctgaagacccatcatccagacaaccgacacacctgtaatcccaacactttgaggggccgaggcgggaggcatttttatttttctctgtcttcccatttctctctcctccttttcatgtttatatagtttttagtttaatgacttttggaaaggaagcgaattctattttccgccaaaaggagatcatgtggaaaattgctctagaacgttcctggctgtgtgcgagttgctgataatgagaactaactccggaacaggcaggggctggaagggacaacaagggagagaaaccccagggccctatcctatttagagcacagggctgtcaaaccagggggaaaatgttcttaggtcaaagagaaacgtgaacagatggcgatggaaatgggttacaagagttatttctccccctgcctccctcccctccgcttttctttgttttaaattgagcataaacatacgtgaaaatttttaaaaagagatctttcttttagagcccaaaagcccctcttgaccctaacaggtgccagggatgcaggggaaagcctggggcggggtgactgcatttgttcctcgctagctccattctgcagaggtcgggttgggtttcttccaggacctcctgctcctcacagggtaggggcctagggctcccgaggggtcacaaagttgaactcgccaacccagctccctccccactgccggatcccctagtgaaccctgggggaggttcagcccagacccgtacgctggtccttatctgctcttccccttgtgccaaactagatgcaggtggcacaatctccatgttggggacagcaagactctggggactcatctggccctggccgggtgaccaagttacttaatttttcagatttttccacatcggaacagcagcagggagtcacagcacctccccgtggagccagtgttaggggtgcaggagccacagaagccagctgcccgcccgcccagcccataagcctgtgccccatctttaattttggagacccaaaagtgaggtttccaaatgaaagaattggctccattgggacccttctgcgctggggcagtcctgacgcttttgtgttatccttcaggggctccacgtggaaggcttatgctagagcgaaactacctcccaacaacattcagaacaaccagcctcccttgtcaagagccagttgtgcactgcaggaaatactcagaagcgcctgccctgtgctaggctcagttctaagggaactcaaatccagtgcctgacctcagggagtttaccttctagtcaggaagacaacgaacacacagacattagtatacaaatgaatatgagggaaggccattgctgagaagggaccagcctgggggcatttgagtggaaggaaggaagtgaggaccctgcaactagatgcagctacctggggaagagccttctgagaaagggaatgttgccagattctttgcttagccaaagattctcatcagggtctccatcctccaccatcccgcaggggatgtctgattaccctaacctgcttccagctagaatcttgaagttggtttagctagaatcccccaacccctgatgtcccctctaagtaattttctatccatggactcccaccctgctcctttgctagaaattcctacttacctgcagtgtattcaaagctgagctcccatcgctctccctacacctgtatctattgagatggtataaatcgtgagtaaggtctgaatcaagtcagcctcatcttgctttagcaagtataactgaataattttttcaaccacagcaaggaggtgctgtattaatttgcattcattgatattttgcctggaacaccaactcgatccaagacttacttgatccttaatttgcggagcttcaaactctcatgtatttgcatttttgcaagagcattcaaaagggcaaaggaacatcctgacgtttgtcggggagagatctttgtccttagcaatctcagccttgaaatcctcctgaaagatgaccaccagcccaggctgcccaggccaacccaattgccttcacagtcatgggagctggtccggctaaactgttcagatcaggggccctggaagcagtcaagcccagaactcatgggcctgggaaacatagcaaaaccttgtctctacagaaacaaaaagtaggccaggcgtggtagctcacgcctgtaatcccagcactttgggaggctgaggtgggcggatcacctgaggtcaggagttcgagaccagcccaacatggcaaaaccccatctctagcaaaaatagaaaaattagccaggtgtggtggcgtatgcctataattccagctactagggaggctgaggcaggagaatcgtttgaacccgggaggcggaggttgcagtgtgctgggattgtgccactacactccagcctgggcaacaagaacaagactccatctcaaaaaacaaacaaacaacaaaaacaaaacaaaacaaaaaacaaacaaaccccttaaaactaaaaatagagaccccagagacctcccttgccccttctgccatgtaaggaccaaatgaaaagatggccttctaggaacggaagtagaccctcaccagacaccgagtctgctggacctcccagcctccagaactgagagaagtgaaatgtttgttgtttaagccacccggtctacagcagtttgttatagtagcctgcatggacgaaggcactctataaattcagctcagtgggccaaaatctgcattaattttatttttacaccaactttacctctttaactttcactccttttgagtagtgggaaaactgaatcaagaataaatggtccccttgtttcttagtgagcataagaagtatcagtaaaataatgccatctcacactcacttgctcctcttcctctaggatgtggcagtaagaaccatcaggagctacactgggtgttcacggctgactgactctgaggcacaggagacgggccctccctccctggacatcagctctacatggagaggatgaaatggtctccaagatcgttctcgacatgaatccaccaccacagtgccaggctccagatctgcctgcgtctccactgcatgcttacctttgcggaggacttgatacagctgcagtcatcaaatccttggcaaaagatcgtggccagcctcctatccaggtcttggattttgatctcaaaatcagcataatcacggtcaaaattctaaaagcaaatggaaatgtcaaccttgtaatcagcgtgcaaagcaagccaagggcaccctctccagcccctgccctgctgagaggactcgggactgaggcgcagctgaatgtgctgttgcggggaccgctctacacagttttcaaagtgttgggatcacctggcacctgcttcctccgtgtgccctcccatcacacccctaagctggtaccgaggctggtgctgttctcaccgagtccagttcatccaaccctgcccgaggacctaccgagtctccagggtccaagggatcatatttgcagtcggcaaaaaccttcaccagctcaaagacctcatcatagatacgggtcaccaggctcccgaggaggttcccacgcacgcccccaagctcgattttctccagcttcagaaactcaattgctgttttatagagttcctagtggaggagaaaaacacagtcaattcatcttcacaacccaactcacgggtccagttacaaaactagctctgaccccaggcaggaggagctggggagcaaaatgtccccaggagacaccaaccatgggggtgggaggacaccctctgtgtctgtgctgttctttaagcaaatattccatcccctgcagaaagaggggatggaaggaagggctctgtgaattatctatgaggtgtgaatgaggaggagctggagaggataaagtttgggatcctgtcctgaccccagactggccaaaccgcatctctaaataaatcacactctgctgggacctccgttttctccgctgtgggaagcggttggaatggtgctgaagatttctgatgctcttgctaagctttaaattccccgctacctggaagaccatcctatgcagagtgccgtgtcccgaaggtgatccaagaagaaagcggctggaatgcttggatggacacacgtgtagaaaattctgcttcctcgccggtgtggctcatgccccctctccctgaagcgctccctgactattttggcccatagcaatgcattccttcccaggggcccggtctcccatctgcgccgcttgtgtttgctttagtcacgttcaggcccatcccgttagctggttgtgtgtgtgcagttcctgtttcccaaatgaggtctccaaggctccctggatgctcttctgtgcccctgcacctaccaggcacagtgcaggcagagtttagactggagatcttcctgtggacttgacatcactcccctgaactggtgctgaggttggtgctattctcccaggtccacgaagcatcaggccacgcaccaacaccaccccgaggagacaggcaccgaggaccaggagctcttggctcttccacccgacgcggaggacacagacaagctggcatggcctgttgtcagggggtggacagcaaagccatttcctccacctccaaagtcccttcctacccagaatcttccttctgattcagaatcagtcatgtgggaaccagagctccttggcccaaagtgtgactgtgactctcctccacattctcggtctgggagatttcaggcattagtccgcgctctgtgactgcaattttgaactcctgagcgggcctccctcccctgccccccaggaggtgtagaagagaactggacaagcctctcccaagcctctgacaatggtgtccacccttaagtcaatgctttacagttccaggatgattttccccttttttaaggatgtgagttatacagttatatgtgcacaaagtttttaaaaattacaccatgcagaagatacaaaaggcaaaactttcttgccctaccccgtcttgatccctctcatctcttctctccagagccccagagaaaaccgccttgaagcttttttttgaaacagggtctcactttgtcgctcaggctggactgcagtggcgcaatcatgactcaccacagcctcaaacttctgagctcaagtgatcctccctcctcggcctgccagagttctgggattacaggtgtgagccactgggctgggccatgcaccatttttaagtttttatctgctgtgcgtcactccgtgtatccacatggtgcttgcacgggggccttcataagtctccatttgtaataattgagtcccactaagtgactgctgttggcccccaggcgtcctgaacgtgggggtttaacttatcagtaacccgctcatgataggatgcacgagataaggggagaagcacccgaagtgggtcatttttattcttggctaacagctctggccacggcagatgctgccgcaaagccttggtttcctcataacagatatttgggcctcacttattttctgcctgggggattattggcaaggggggtagggatggacgctgcaggtgtcctagggtaggagcagtctgggaagtggaggtcaagatgcaccgagttctgtttttacctcaatggtctggatgcgctggaagaaggaatttatcctggaaaaggcaagagaagaagggaattcccaaggcacgggctctttgtccttagaggagagaaagagagatgaggccacgtttgcttcaaatgtcccaagtttatcaaatatcggggctcatatgaactcactcgtcctgccttggccctcgccctgcgaggaaggggtaccttaaagaaaagcttcatgttcacgcagcagaagtcgtacgtctggtagagctccttcagcacatttacagccagggagatgccactcaggacttcctcgatttcaccttgcaggcccttcagcacctcttccgggctcaggaaggttcgtgtctgggcaaaagagaagacagacatctaaagctccgacaagccatttggggtgacgtccaggcacgccgcctgcaggacctgtgatctgttctgacatatggatatctgaaaataacccctcctatctgcccactgctgggccgtttttaggggaccgagctgcttcccctcctcggcccctcatcctttgccaaggctgcagcataaatgggtgggggtcgcagatgatgagaggccctccagggacaggggaccccggtgcccttctggtcctgcagacggggccacagcatggttttattatatagaggtggcccagggatacagcccttcagctcgaacgccatggctggctagcaggtgcttatgaatgggaagaaggaaaagaagtctctgctaagggagacggaaggtggtttgatgtgcgattagagaagcccacaaagcactagatgggtctcggggtacggggactctcagggcagacctcctcctctgtccccgtcttccctttcttttccctcagtaccctcccctagaagaactctaggtagccttgaagagggctccatctcagctcggggcctgaaaaggcttgtgctgacatcttggcctgctttcaaactgctggggaacatgggcagcaggaaaacagtgaaccggggaggggacccagccaggaggggaggaaggggacccaggggccaggggagggttaccatctcgatgatttggttgcagaactcctgcaggatgacgatgatcctggcaggtgtgttatagtactcagaggtggcccagatgaagcagatggtgtccagcaccttggcaatgaaggtggggagctggggggagacaggcccaggcacactggaggggactggccgctgcaccttatcccggtgtcccagcccttcccttcccatggctctcactgggtatccagcagagggttcccaaagaggaggggagaggcaactccctaggcccacacatctgatggcagccaagaaacccacggccccacatgccttgaagaaacaagacccaggccgggcgtggtggctcacgcctgtaatcccagcactttgggaggccgaggtgggcggatcatgaggtcaggagatcgagaccatcctggccaacataatgaaaccccatctctactaaaaatacaaaaattagctgggcatggtggcacatgcctgtaatcccagctactcgggaggcagaggcaggagaatcccttgaaccagggagttggaggttgcagtgagccgagatcgcgccacagcactctagcctggtgacagagcgagactccctctcaaaaaaaaaaaaaaaaaaaaaagaaaaaagaaaagaaaagaaaagaaacaagaccctccccaccaaagccggctctcccttgcctgcgcaccatcgtgaagtcggcttgttccatctcctccagcaggatccgtaggggcttcaaatagagcacgatgtcgttggcttccttcagccctgcacggaacaagaacaagtgcccaccggtaagagagcagaaattgctcagaaacgatgagggtgcggctccatgtgctgagacctgctccttcaggaaatggggcctttctcaagtggagggggctgagaaagctgctcgcagagggaggccaacatcctagggttggtgacaagtctgacccagccctcccaggaggcacaaacagcttcgtgcagaactcatgacagggtcacaggctcaccttcagtgacgttggtgtaaacgttttgcagggctggccagtagcagcttttggctttctctaggatctcaacaatcttgttcactttgggtctgtttagctgagaaggggagtgaagatccacctttcattgacctggaagaccctaaggcgaggccaacctgaccttgtggctggctggagctgcagaatttacgcaggtcatcagagccctcaggactcctgggaggttggcactgggaggcggagagctcggcccggtcgcccagctgggacgaggctgcagccccacaggagagaggaggccgtacctgttcatggatgcacttgaggttcagcagccgagtgtcccagaactcgaactccacttggggcagggggtgcagcccatccagcagcgcctgggctgagtctttgctcagcacatcccggatctggtgggaccagtcgatgatggtggtttcaatggcgtgcaggagcaagttgtccagtgaagaggggatcctgcccagtggaaggttggggcattgctctcatggcgacacacacgtgggtcccaccaagctctcccatgaatccttctgcccaccaatcccaaaccaccagcagcagcaccgtctggtctcatgtccctggtgcctccagccacctcggggacgctaaagaagttcccaagactcccagctaggaagagagcccagggaaataatgggcgtggtcagagataccagggcctggaggcgctcacctccaaggaagcgggagagaattaagtaaaccctatttaaaccctattcaagatggctcccctggtgtcaccaccggacatggtgcttggggctttgtgaatgatcagtggaggacttgcccacgtgaggcaaaatacggaactaattgtcacgggggtctcacatatcagggcggttgcaaattgtggcaaggcaggtgcgaggggacaccttggagtcccttgggcttcccagggcctctgggggcaccgcagcctctacacagacttgcatgtacctgctgagagtccctcccactcccactcactgaccctgtcccacatcttaaagctgtgcctcctgtttcctggccatgctgacaggtgggacaccttctgcttgctgggtggtgactggatcggcacacatgtgtgacccagcggggggtgtggggtgcaggtgccagagccccaggggctgcagagcctgctccctccctgccctggtttcaacttcctcagtctcagcaccacctaacgcaccaccttgccctgcatttccccggctttaacatgtgaagccactctgcagggaaacaacgggtcggagtggggtggagtggggtggggggtgggggtcaagcatgtgcctcttccccacccagcggcagccggaagcagctgggcccacacacctctccatggactccagcgtgccatccaggctgcccaggtgctccggaataggcagcaaggttttgcctttgatcttgccactcatcacaaacatttcattcttcagcctgtggacctgcttcacgatgtcttccgagaccacctggggccatccagccatgttctcactttggtttaacagagaagagaggacctaaaaggaaacacttctgtggttccgccccctgtgccttcaccagctcggcaaccgcacagagccaggtccccggggggttccaaagacccggtgtctggagccctgggaaaactgggtcccgcacagagccaggtccccagggggattccaaagacctggtgtctggagccctgggaaaactggatccttcttccagaaggaggtgtggccggtcatggagtttataccagctgccctgtcctggtggtaccaaagccatccccaagctcttgcacccatagcacacactccttgctaaaagcctaggaggactgtgatgggtcaaactgtgtcccccaaatccatctgctgaagccctaactcccagcaccttagaatgtgactatttggagatagggtctttaaagaggtgagtaagggctgggggcggtagctcatacctgtaaatcctaggacttagggaggccgaggcaggtacatcacctgaggtcaagagtttgagaccagcctggccaacatggtgaaacctcgtctctactgaaaatataaaaattagccaggcatggtggcacctgcctataatcccagctatttgggaggctgaggcaagagaatcatttgaacctgggaggtggaggttgcagtgagctgagatcacaccattgccctccagactggacaacagagcaaaaatactgtcaaaaaaaaaaaaaaagaggtgagtaattaaaatcagattactagggtgggccctagtctgacaggtgtccttacgaggaggggagattagacatgcacagaaggccgaccacatgaggacccagggagaagatgtccatctgcaagtcaaggagagaggccttggggaaaaccaaccccgccgacaccttcaacttcaacctctagcctccaggactgtgagaaaatgtctggtgtacaagcgaagcacacaggcccctgtactgcagatgagaagagtgatgaccaggaaggataaggcacccccattctggaggtccgaatccccaaagtgtgtcccccccacctacacagcacctgccaagggggacagcagagggacacataaaatgacactccattttttcccctttcttaagtcaaagtctcaaaattggagaaacctatctgccagtactcagtccccaccttcccaggccatgggcagcaaccgtacccggcacagcatggcagtctcaatgctgtccagagagaacaaggggatgctcggggcttctcagacttcaagggcacgagcaccacctggaggtcttgttagacagcaggtctgtggccgggcatgatggctcacgcctataatcccaacagtttgggaggttgaggcaggaggatcgcttgagcccaggagtcttgagaccagcctgggcaacaggctattttttggtgagacctcatctcttaccaaaaaatacgaaaattagccaggtgtggtggtgcatgcctgtggtcccagctactcaggaggctgaggctggaggattggttgagcttaggaggttgaggctgcagtgagctgtgctcccaccactgcactccagcctgggaagcagagtgagaccctgtctcaaaaaaaaaaaaaaatttaaaaaccaaaagcaagcaggtctgtctcagcaggtcagggtggacggggcccgagcgcctgcatttccaatccctccccggctctgcagctgctgctggcccagggactccaggctgagcagcaggactcaaggccgctcccgagaagtcggtcgtgctcgacaccccggatggcagcctggacgcactcacctcctccaccaccgcgatcagctggtccacgggtgtggggctgatgtcgccgtaaaggagccgggccctgtagttgtccttgttgatgttctcggactttgtcttgatgaagtaaacccctttggacttgagggactgggggaagcccaggcagggtatgatcatgccggctgcattgagcgtcagcaccagcacctggacgtcgggcttttcaaagaactctgtgaacagggccacgttctcctcggcgcctatcagcttgctccacttgtccggcttgaacttcaggacgatggaggcaacttcctccagatactctagtctgacgtccggggccattgtcatcttggcctttccttacactgtgtatctgttaagagtgcaagaaacaggtacgaactgtctcccgggctccccaatttcccacccatccctggcaccgcaggaaatctctgtttctaccggagcaggaacaaaacagttggtcgagagtgtgcagtttttagctgtggttgggttggggtgggggtgctttagcaggtgctggcacctgccccggccccgccatggggggtgccccgggagtgaggctgcccaaaagtggtgtgtgcttacaatcctgtgaccataaagttcagaggatgggaaagatagagatgaatgctggagaaagagagaaaaggaaatggccgcaaccagacagtgtgaaggggatggggtaggaaaaggcagaacaagaggctggggggtcaggttgaaaggtcctgggaaagcaataaaagacgtcgcagccccagagtatgtgtgaaacgcaagaaggaagcagaccccacgtgcaggccgtgaggctcagcgctcagtcttagccgcagccgtggtgcaccttaactttcactctgctctgcaccctttctccctccagcccccagcgtgcacccctaaaagaatcgagctgcaaattcctgacagacccctcacaagctgctcagatgctcgggggtagggttaactagagaattggggggaagggatccccttaaagaacaccctgaagtcccaaagtttaggcaagtgaggtacttacagaatttaaagacacacccaaacagtcatcaagagaaaaggcatgtcaatatttttaaacatcaaaatgaatgcaaacaaatttatgaacaaaataccaaagtttcaaataaagacaggctctggcaagaggcctgaggtgggggccttggaggcgagttctgcaagggcagggttgaatgcaaagggtcgcctgatgctgtgttttcatcacaatctgggaggtatgcagctcctgaatttcaaggggaaccctggggtattcagctgctctgggggtccgtgggctggggctggcctgctccagacctggcagctgctgaaaagcatcagggtggacagatgacgttggaagcactcacaaattctgccttttggtttgacccaagctattgcttttaagtttgtaacagcctacagttccccaaaagacacgtaataccacggaacaggtttatttcaccctggccactatatatcggcaaaacaactatatgatgggaagcagtagtggatagcatttggatgctattcaaatggtctgagatttattcaaggctccaaacatctctgagagaggacttggggaatatttggccagcaaatggcagaaacatggcggtccacgagcaaagccacccgattcaggcacatctgtgaaagaaaaaggggacaccaccaggcaagtaggaggagcaccgcgtggcatttatggagatgactcgttcaccaggttcccacagggctttcagcatgctgctgaattaatctccacccaggatctccgagacccggggacgcgtcacgtcgtcatttcctagggggatcaggaactcaggggagcccgagtcctggaaggttcctgattggaagtctcgccaagctggtcaggcgactggactggagggaaacatcctctggtttactgattttgtggatttgggctttcacaaagtcatcttttcttccaagaacggcatggggtgggctgcctcccaagccataacatgtgtgggctgaggggcccctacaccccgcaagtttcttgcacgatcgggaggtctcatctcaggctcccacccagccgtttcctgggctgaaggccaggaggtcccagttaacaatagggttgtcccaggccatgcttccggaggggcagagacggcttctctgggaggtggcccatgccccaggccttcaggactccacaggaggaagctggggctaggggcttccaggagaagccagggggctgaggcaaggccttcccaggagcagggaagagtctggagccctggaaggggtcaggctggtacgtggcagccagcctcggggtcccagagccatgaacagctcccggtggcgagcagagccacttctggggtaagtggagggtctgctgtctgccagggcctaggtcccacctccatcctctgaaggcctccctgctccctccaccttggcctccgactcccccagcatggttgaaggccgctcaccagctgaaggcaaacagcttctcccgcaaactgatgagcaactctttcccaaaccaggaaagaaaatggctcccttccctcgaggggctccaactgccacataacttctgggagtctcctcacggtacctggggcttctagaaccttccccttgggacccaagtaaccaatgatagcgcagcaaatgaggaaccaaccgtcaccccacagtggaaaggctcttagatgatcattttgaggggaggttggaggggggacagggtcgcgctctgttacccaggctggagtgcagtggtacaatcataactcactgcagcctcaaactcctgggcttacgtgatccccccccctcagcctcctgagaagttaggacaacagacgcacatcaccacacctggctaatttttgtactttttgtagagatgaggtctcactctgttgcccaggctggtctcaaactcctggcctcaagcaatcctcccaaagtggaaaggaagacattatctctgtttacaataaggtgatcttgtatgtagaaaatcccaagaaatccataaaattgtagagctaatagaggaattcagcaagtttgcagtatacaagatatttgaaaattaattatatttctctgtaattatattatgaacaatctgatgatgaaatttagaaaacaattgtccccataatgaacaatctgatcatgaaatttagaaaacaactcccatttacaacagcatcaaaataatttcgtttacaatagcgtcaaaaacaacaaaatacttaggaataaactttaaaaagaagtgttaagacttgtacactgaaaactgcaaaacatcatggaaataaagacaacctaaatcaatggaaggacatgctgtgttcatgggttagaagattgttaagacgggccaggcgtgatggctcacgcctgtaatcccagcactttgggaggccaaggcgggtggatcacgaggtcaggagatcgagaccatcctggctaacacggtgaaaccccatctctactaaaaatacaaaaaaattagccgggcgtggtggtgggtgcctgtagttccagctactcaggaggctgaggcaggagaatggcatgtacctgggaggcggagcttgcagtgagccgagatcccgccattgccctccagcctgggagacagagtgagactccgtctcaaaaaaaaaaaaaaaagaagattgttaagatgacgacagttctcctcaagttgatctgcagattcaacacaatccttatcaaactctcagctgccttttttgtagaaatgaccctagattttatagggaagtatgagggaacaaaaaccatccaaacaactttgaaaaagaacaaagtctgaagacacacacttcctgatttcaaaactcactacaaagctacagttatcaagacagtgctaccagcataacaatagacagagatcactagaatagaattgaggttccagaaataaatgcatccatttatggacgattgagttagcaaaggtgccaagacaactcaatgggaaaagaatcaccttttcaacaaatggtattggaataactgaatacccacatgcggaaaaacgaagctgggcccttacctcacgccatctacacgaattaactcagcatagattaacagaatgcaagagccaaatgtaagagctaaaactataaaactcttagaagagcacacaggagttgatctgacctcagatgaggcaatgatgtcttacatatgatgccaaaagcataagtgagcaaaggaaaaaagataagtttaacttcatcaaaaccaaaaacttttatgcttcaaaaggcaccctaaaaaagggaaaagatgacccatagaatgggagaaaatatttgcaaatcatatatctgacaagggacttgtcgtaatacaataaaacaacctaattttaaggagtaaaggatatagatatttcttcaagaaagatacacaaatgaccagtatgcacatggaaagcagcttgatatcattagccattaggaaaatgcaaatcaaagtaaaatgaacttcaatgaggtccctagagtagtcaaattcattaagtagaatggaggttgccaagggctagggagggagaataggaatttattttttaatggggccgtcagaggcatttgaaccagagccactccattttgaatggggtctgggtaaaataaggccctactgcattcccaggaggtgaaggcattcttagtcacagggtgagacgggggttcagcacaagtcataaagagcttgctgataaaacaggttgcggtaaagaagctggccaaagcccaccaaaaccaagatgacctctggtggtcctcactgctacactcccaccagcaccgtaacagtttgcaaatgccatggcaatgtcaggaagttaccctagatggtctaaaaaggggaggcatgaataatccaccccttgtttagcatatcctcaagaaataaccataaaaatgggcaaccagcagccctcaggctgctctgcctatggagttgccattctttcattcctttactttcttaataaacttgtttcactttactctatggactcaccctgaatttcttcttgcacgagatccaagaaccctctcttggggtctggatctggacccctttctggtaacagggtcagagtttcaatttgggatagtgaagaagttctagagatggatggtggtggtgtttttacaacgatgtaagtgtactcagtgccacggaactgtacacttaaaatggctaaaatggtaaatgttatgctctgtgtattttcccacacaaaaaaaccccaattcattcccactagaatggataaaattgagaagacagaaaaaaacaaaacaaaacaccaggcacgggcaaggatgtgaaggaattggcaccctcatccacggctgatatggtataaacattgcagccactttggaaaagtgacagttccccaaaaggttaaacatggggctaccaattagctaccccctcctaggggtgcaccagggagaaatcaaaacacacacatattcgcagcagcattcttcataataaactaaaagtagaggtgaaggaagacctctgtcccggctcagagggacatgggaggggtggcagggtcctgtccccggtgggctgagggcagccacattggcagcagggtgcccggcagcatccctgccatgtgaggataggaaggccaccctcgggctctccagaagctaccagggaagggcaatgaacggaacagactttgtacaatcttagggtgtgtccaccacagaagttggcactgtcccacaccaacatccaggagcaaaatcagtgccactaaaccgtcacttcagttctgcatatcaccccagagctcccagacacaggggtactcagcaagcccccacaaattccagctgtctgccacttgagctagtaaccaggcccctctggagacgtcagcttcctcggccacagttctgaggatgagtatccctgagccatggggcgttaggggcaagaagggcattcctggttccagaaacacatggtgcttattgcaaaggagagctggccagctcatgcccacattggcctaagaagagtcctggctaccgttttctgagcgatcaccgggtggcaggttctacacttcatgagcctcctggaaggcacaggagctccatccttcttcagcttctgcctgtggccctgccctcgaccctgggatgtcacctccttccccctggggaggtagcagcttcctgctgctgatctctgggtcacctcccagtcccgctgggctcctcagctctcctgtcgtgtgcaacacagcctctccggcttgagtacccacgtggttctcctccatgttctgcttagatactgtcgcagtttcttgtggctgctatcaaagcaccacaaccttaggcggctaagacaacaaaaagttctctctcccgggggctgaggtctgaatcaaggtgtcgggcag

SEQ ID NO: 1245 - DNA, 253573 bp, Homo sapiens
ttttatttatagggaactcaaccctatgtatgaaggatatctacagcatgatgcacaggaagtattacaatgtattttgggaaacattcaagaaacatgccaactcctaaaaaaagaagaagtaaaaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaagaaaatgaatgtgatcctgaagaggacttggggaagtgtgaaagtgataacacaactaatggttgtggacttgaatctccaggaaatactgttacacctgtaaatgttaatgaagttaaacccataaacaaaggttagtataattcttagactttgataggtagaagcattagcagctacagaattagaattttctcttcctagatacatgtacaatataatctctggctaaaattgtttcaagagaaggaaatttaacactgaatgtgaactatggtgttttaagtgctatgcttagattagtgtgtgtgtatatattgtatgcatatatatgtgtgtgtgtgtgtgtgtaatgtcattaaagtaattttaatttatagcttataaagtagggaagttcggccaggtatgttagctcgcacctgcaatcccagtactttgggaggcctaggcgggcagatcacctgcggtcaggagttcaagagcagcctggtcaacatggtgaaaccccgtctctactaaaaatgcaaaaattagccaggcatggtggcgcacgcctgtagtcccagctacttgagaggctgaggcaggagaatcgcctgaacccgggaggtggaggttgcagtgagccaatattatgccactgcactccagcctggggcgacagagcaagactccgtctcaaaaaaaaacaaataataataaagtagggaagttcagtatattttaatgtacatttaagagtacatttccctttatgcagtgtttgacataaactgatgaaggacattgcatttagtgaaattttaaaagtaaagactaagtacagtcatgtgttgcttaacaacagggatatgttctgagaaatgtgctgtttcattgtgtgaatttcacggtgtacttacacaactagatgctagagcgtactacacaactagcctatatggtatagaccagggtatctaatcttttggcttccttgggccacactggaagaagtgtcttgggccacaccacacagaatacactaatgatagctgatgagccaaaaaaaaaaaaatcaaaaaagtctcataatgttttaagaaagtttatgaatttgttacgggctacaggcaagctttgcatggcctattgctcctaggcaacaaacctgtatagcatataactactgaatactgtaggcaactgtagcacaatggtatttgtgtatctaagacgtatctaagcatagatatgtaaacataggtacagtaaaaataatcatagactactgtcacatgcggtccattgttaaataattgaaacgttggtaggtggtgcataactgtaagttacacgatacttgaactagatttttacctagttttgtccagatctacagatatcagggaaaatgtgtaatattgatatagtgaatagttttaccaaaaatgtcatccttattctgggtttattctatggggaggtgtctgtaggaagggagttacaatacaactgacttttttttattttttattttttttatttttttggagacagagttttgctcttgttgcccaggctagagtgcaatggcatgatcttggctcactgcaacctccacctcccgggttcaagcgatcctcctgcctcagcctcccgagtagctgtgattacaggcatgcaccaccacacccggctaattttgtatttttactggagacagggtttctccatgttggtcaggctggtcttgaactccgacctcaggtgatctgcccgcctcagcctcccaaagtcttgggattacaggcttaagccactgtgcccggcctacaactgacttcttttaaagacagtaatttcatagtcagttttatctttacagggaccttaaatttcattaatagggtacctctaataagctaataatgctaataagctgatctatgaaaatggaactgttattcatgatatactttatttaaatggaaaattggttatttggactataatgagaaactaatctgtatagacttacattttcctattttcattttaggtgaagaacaaattggttttgagctagtggagaaattatttcaaggtcagctggtattaaggacgcgttgcttggaatgtgaaagtttaacagaaagaagagaagattttcaagacatcagtgtgccagtacaagaagatgagctttccaaagtagaggagagttctgaaagtaagcaaaattggagtcttgtgtggaccatgatggaatatttataattctttaacaacacaaagtttaatagtagctggtgtaattagggaggggaaaaaagctagcttttagtgtctaatgtaacctttctgcttatctggcttcacttataaatggttagcatttgggaaattgtgacatcttgattttgatgtagagtgtgttagaatggaaaactgaaatgctttaataagtgtacttttgggaacctgagtctttcagagctactgagggttttttttaatttttttgagatggagtcttgctcggttgcccaggctggagtgcagtggcgtgatctcggctcactgcaagctccgccttctgggttcatgccattctcctgcctcagcctcctgagtagctgggactgcaggtgcccaccaccacgcccggctaattttttgtatttttagtagagacggggtttcaccatgttagccaggatggtctcaatctcctgacctcgtgatccgcccgccttggcctcccaaagtgctgggattacaggcgtgagccaccgcgcctggcctactgaggttgtttttaacacaataattgagccactgttgtgtctagagcataccacaaaatatggaaataccataggaaataatcatgagacaggtttacctatcacatattgaaagttggcaattaaatgtaaacagactaggcttattttgtttttgctgtctatcatattttttggccgatcaaatatatttaaaaggtatgtatactgttgaggatgcacttatgaaagtagtttctgaaagtaaaaatctctttagttatttaggaatgggtcggtcaattgaaattaaatgctaattttgaacctgaaactttgtggtttattttttgaatgcctgagagaagtatttgagtgaaaggattctcttttttagtttctccagagccaaaaacagaaatgaagaccctgagatgggcaatttcacaatttgcttcagtagaaaggattgtaggagaagataaatatttctgtgaaaactgccatcattatactgaagctgaacgaagtcttttgtttgacaaaatgcctgaagttataactattcatttgaagtgctttgctgctagtggtttggagtaagtattgtaaataagaactatatgaagaaaatgagctgctgtagaagataagtcttgttcaaaatgctgtaatagtaggaatataaagtactgaaatgaagtagattgtaaagattgcttcagtaaagttttgttcttattaacagtttccctgtaaaaatgaaacaacttaaatccttttgatatgaatacatattctattaagtatgatttcttctccttttttttttgaaacagggtctcattccagttgtccaggctggagtgtagtggcacagcctcagctcactgcagtcttgacctcccaggctcaggtggttctcccacctcagccttctgagtagctgggactacaggtgcatgccaccatgcccagctaattttttgtatttttagtagagacaggatttcaccatgttgcccagtctgatcttgaacttctggactcaagcaatccacctgccttagcctcacaaagtgctgggattacaggcgtgagccaccatgcccggccagtttctttattcatcttttcatattcattccctcttagatgttagtagcagaattcagtagaactgactaaagcagggaacaaattttgtatacatcaagatttttttgaaggggcgggaaaggctaaattcttcctagttttaaggtaagccaggaaatcaaactagtctttcaacagtttgaaaaaaaatgctgattgttttggatagtctgtttttttctgacatgtgtaatgtcattgtatgtgtgactcctttgtacattagttgcttgtttgaaattaccacgagggcttcacagtagctctctcacacttgattatgtcaaaagataacatatagccccttattcagtggaccttccctttgctaatagtataaaatactattttatttactttcccaaattttggtagagaaaaacttcacactaaaaatgactaaaatgggctgggcgtgggtggctcacacctgtaatcctagcactttgggaggctgagatggatggcttgcacccaggagttcaagaccagcctgggcaacatgacaaaaccctatctctacaaaaaatacacaaactagtttggcgtggtggcgggcacttgtggtcccaactactcaggaggctgaggaggaggagcctgaggtgggaggatcacttgagtccagaaggagccatgattgcaccactgcagtcagcctgggtgacagaccctgccttaaaaaaaaaaaaacccaaaacgtaacatttttggttccggttcagtctatttaaaataccatttattttcttaactgcacaaaattaggaaaataaaggaaaaaatacaattatttcttccacagaaatgcctgaatattagcagttatttatttttttgtttctgcatatattataaatattattcaaagttggggtcttgttttgattctgcttttctgatatatgaacactggatattaagggttcattcagatttttacttggtttcagattggggtataacattttgaatttaaaatagaactgcaggaaaccttttctttttttcctcccaaaggtttgattgttatggtggtggactttccaagatcaacactcctttattgacacctcttaaattgtcactagaagaatggagcacaaagccaactaacgacagctatggattatttgcggttgtgatgcatagtggcattacaattagtagtgggcattacactgcttctgttaaagtcactgaccttaacagtttagaactagataaaggaaattttgtggttgaccaaatgtgtgaaataggtaagccagaaccattgaatgaggaggaagcaaggggtgtggttgagaattataatgatgaagaagtgtcaattagagttggtggaaatacacagccaagtaaagttttgaacaaaaaaaatgtagaagctattggacttcttggaggacaaaagagcaaagcagattatgagctatacaacaaagcctctaatcctgataaggttgctagtacagcgtttgctgaaaatagaaattctgagactagtgatactactgggacccatgaatctgatagaaacaaggaatccagtgaccaaacaggcattaatattagtggatttgagaacaaaatttcatacgtagtgcaaagcttaaaggagtatgaggggaagtggttgctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatgtatatgaatatttgaattttttacttgtatatttttataaatacagctgagttttcttaaagcgaataagtgtgtgtatatatatatgtatatatatgagagaataagcatgcataattacctttattactgaatactttctgacagtgcaggagtttttcaaagaggagaaattgtgcttagtccagccaagctgtcatacttaaaagaggtttataatgaaatctgttgcatctaattgtcctttaaagtagacatgatttaatggaatccaaaactggaaaagttaagatgatgctttgggcacacataaaaacttggttaaaatttcattttaaactagtatactgaagtggtaagtgatgaatgatttcatgacttgttaatggacattcttggtactaagtttttcctagaaatgattctaaatatgtaaatgctattggggtaacactttaataccccatttcaacaaggagtaccttctcaattaaaaaaaaatcgcagtaggctgggcgcggtggctcacgcctgtaatcccagcacattgggaggctgaggctggtggatcacgaggtcaggagatcgagatcatcctggctaacacatgaaatcccgtctctactaaaaatacaaaaaattagccgggcgtggtggcaggcatctgtagtcccagctactcaggaggcggaggcaggagaatggcatgaacccaggaggcggagcttgcagtgagccgagattgcgccactgcactccagcctgggcaacagagtgagactccgtctcaaaaaaaaaaaaacacagttacataatgtcttatattctttcataggatgatgagatggtaataaagtcatggttctccccacctttcagaatcactaatggaaatccttaaacagtcctgagcgctacctgtaagttttgaatggaatgggtctaagatagacactgggcctcttaatactcgagagacagccagttctaagaactaacacaaattcctgatgtgagaaagttccattttaagaaaaatgaagtttgtaagaggtttgtatcatacgaatgtttaagaggaagcctctgttctgaaggatgtcagaaaataattggttttgcataattatataaatcataaagtccttgatattactgagatttctgagatttttgtccaaactgttatataaatgtaacctaatgagaagtgacccttcagtggttccttattctctcccttatgtttatacccaccactgacccccaaagaagaagggaaaatgtcactttttttggaggggagggatttccattcttgactccttacctttccttattgttcatttggctcctcaaatagagttttgaggttatgcccttctgactcagatttggtctaacaatgtagactcatctgaaaaatgtttttgtgattcagtctttgaattgatatagataagaggaatttgagatgatactgcccattaaagtacatggagtgtgggatatcaaccatcacttaggctctcagaagtagatattttttagtatattttgaatatttactacattgactatagaatgaaggcaatacgttaaatctgaccagtttttgttttttttttttgaaacggagtctagctctgtcacccaggctggagtgcagtggcgtgatctcagctcactgcaagctccgcctcccgggttcacgccattctcctgcctcagcctcccgagtagctgggactacaggctcctgccccctcgcctggctaattttttgtatttttagtagagacggggtttgactgttagccaggatggtctcaatctcctgacctcgtgatctgtctgcctcggcctcccaaagtgctggtttttgtttttgacttaagagtcttgctctgtcgcccaggctgaagtgcagtggcgccattttggctcgctgcaacctccactttccaggttccagtgattctcatgcctcagccacccaagtagttcggattacaggcacgggctactacacctggctgatttttgtgtttttggtagagatggggtttcaccatattgaccaggctgttcttgaactcctggcctcatgatccgcctgcccctgcctcccagagtgctgggattataggcctgagccactgcacccagccaatctgatcagttcttttatatatatgtgtgtgtatgtatgtatgtgtgtgtgcgtgtgtgtacagatgatagttttttttttttttttttttttgagacggagtctctgtcgcccaggctagagttgcagtggctccatctctgctcactccaacctctgctgcccgggttcaagcgattctcctgcttcagtctcccaagtagctgggattacaggctcctgccactgtgcctggctaattaatttctgtatttttagtagagacgggttttcaccatcttggccaggctggtcttgaactcctgacttcgtgatccacccgcctcggcctcccaaagtgttgggattacagatgtgagccaccgcacccagatctggttagttcttaagtgattcatgtaactggtcagtagaagaaaaggattataaatgatgccattctgtaaactgcactactacccaaaaaccattgttctaaactgttctggaaatcattactatgcatcgttttggaaaaacttgccaagaattaaaatgttacttctcaaattttttttctgtatgacttgcatataattttagatgaattaaagcacctaattttactttttatatgcttctaaactttacaagtgtcagaaaataggtaatttctcaaactccagctgtgttaccttcatggtgctacaagatagctttaagtagattctaatttactggtttacatcgtcaaaaactgatggctggttttaatttgaaacagagaaatcattcattttagttgctaagaatcatgaagttcttactactatcattggtgtaataagatttaatcaagttaaggtgttgtcactggtattagttatccccgtatttaaattattttacacaaaggttttactaagtaaagttctgcaattctaaattcctgttttgggtatgtaaatggaaaataactttgaaacagttaccaaactcattaatttggggctatctatgatttttattctgctaggtttggaactagttcttgagtcaaccctttaattgttctctgccattgtcaataataaaaattttgaagtcccactcggtaaaattagtgtaaacattcacatatttaatagtacctttaaaataagcattactacatttaaaatggttccaaaatgaatctataaatggtaatataaattaaaaaatacgaacttaaagtgaataaatttttaaccttagctatggtataaataatggtaaatgtatagtgtacctttgagtcattaaaatgtcttaaaagataacagcttgttaccagaacattagaaaccatagccatgattctcaagcgttaacaatctacatttgatattttcttggccactgcattcttcaatgaataataatttccagaattccattccatgttgttttccaatagatcttttcacactcgatgttgaatacatggctctttgcagatgaataaaacaagtgcattcagtttagagatccattttgcgaaggctcattcgactgaaggaatctctgggaaaaaaatgagaggacatagttagttaaagagaacaatttttgcatatacctttaaatgtcttacatggttttttctgccagttaccttaaagttttgccaccatttcttactaacttccaagttggatgctcatcctacctactctgccttatattttggcttatagatttagctatagaagtgtattacagtcaccacttactggtcttttgtattcgtttgtctgactgatgctgcagatattgtaataaacaagacaaggacttaagggataatgggagagattttaggaaaagatttggggttttttacacggcaaaaggcaggtgtttattaaattttaagtcttaaaccagttctcaaactttgtctcaggtcccttttacactcttaaaaattattgagaaccccaggaatcttttatgtgggctatatatggatgtttatcatatcagaaattaaaactaagaacatcttaagttactataaaataacccattacatgttactataaatagcattgcttattaaaaatgatctgcaagaagctttaggagagtggtactcatgtaggagtgtggcttaatgcctatgttctcacatgtgcttctatagtcaatcttttccaatgtcacatctcaacctgtagaaatctccactgtaccctcacaagaaaataagtgagaaaaggccaatatttggcattaatatgaaattagttttgacttagggaaattcctgaaagggtcttagggactcccctctcatgggtccaggatccctactgcaaatattcctgatttcataaaccagcaaaattaaaaattcaaatgctaaagaagaattttaaacttaaattctaaaaaagagtgaagggaacgatactcctggaatactcttaacatattttccattatcagttggtttcttttacttatccttcgtgccattaaggttaagccatgaggcttaatatctccaggaaaggaaaaggccaagtacaaagagatcacattggcttcaaatctcaaagcttgctttgaagggaaacagcagtcttgaaaactagatactgttcatcaagaaaaagtttttcaaaactgcctacatatgttaaaaactaaagcttggaggattggccaaaaagtagatcatagaggacggcaaaaactcggatgttgtaaggcaaaattttggtcaggaagaatacagcctttccatggaaaggagtttccatggagatctgaaggaactgagatgaggattaggcctatctcagggacccagcaccctggctctctgggatctctgacctggtgggtataagactgggagagggggagtggaagcagcaagaaggaaaaactttcaaaaagattgaaggggaaaccaaaagtggaggggactagtatgtttcccattgggaattttgagaggaaaccatcttcaatacttgtatgtaaattcgatttcaaaatgcaagaaagtttactttctgcagttattgtgtcctttccagaattccggtactataaagtgaaatgtcaggcactgtcctaagaacttcacatctgtaatgtcatttaatctccacaaaaacctctttaagttctatctcattatacagaggagaaatctaaaaaaattatctgcttaaataatagaactaggatttcgttgtagaaaattccaagttaatgacaagactttgtgtggtgtcccggttaatgagtaccaactttttgattctcaagttatttaccttgtagaatgattatagatgatacaggttgaacatccctaatccaaaattctgaaatgttccaatatcagagactttttaagcgctgacatgatgctcaaaggaaatgctcactggaccatttcagatttttggattagggatactcaaccagtaagtgtaacacgaatattccaaaatctgaaaccccaaacacttctggtcctaagcttttcggatgacagatgctcgagctgtaaaaagacttctactagtttaacatgttaggtttcagaggaaagaatatctaaaaccacttaaaaataagcatacctgtggcaggtgacaggcaatactgccttgtataactgagggatctttctgttgatcagtggctgtagggcctctttaaggcgatgatagtttctctccagttccctttgatactccttttgatccggcccaattaagctcttattttttcttaaggcatcttcacacctaggaaaaacaggatgttatcaagatattacttctggcatagtttgtgggtttaatgccatacacacgcaaaatacatatacatatatatgtgggcttaatgacacacaacacagactatatatgtgggcctaatcacacacacatacacacaaaaatataggccaggcatggtggctcatggctgtaatcccagcactttgggaggtcaaggcaggtggaccacttgagcccaggagttctgagaccagtctggacaacatggcaaaacctcgtctctacaaaaaaatgcaaaaattagccaggcatggtggtgcactcctgtagccccagctattcatgaggctgaagtgggaggatgcttcagcccaggaagtggagaatgcagtgagctgagattgtaccactgcaatccagccagggcaacagagtgggactgtctcaaacgtgggtgtgtgtgtgtgtgtgtgtgtgtgtgtacgcgcgcgctgagattgcatcactgcactccagcctgggcaaccgagtgggactatctgaaacaaatgtgtgtgtattcaccatgatgaggacatttagtttttcagctgaatgttaaataatcatcttttgttttaggtttaaggcagggaacagataatcaactgagttcctgtaaaatctactatttacttccagtgtcattaaattgaaaattatctgaaggcatttttttcacatcaccacttgactagaagctctttcagggatgtaatcatgctcatttatgtggcaccaatgtcatctggcacagtgtctgcctgtgttcaaatatttcttaataggttttgtttttttttttttttgagatggagtctcactctgtagcgcaggctggagtgcagtggcgcgatctcggctcactgcaacctctgcctcccaggttcaagcgattctcctacctcaacctcctgggtagctgggattacaggcgcctgccaccacgcccagctaattttccttatttttagtagagacgggtttcaccatcttagccaggctggtctcgaactcctgacctcgtgatccacccgccttggcctccctaagtgctgggattacaggcgtgagccaccgtgcccggctaaatgaatagattttgatgacagtcctttatccaagttaattcaagtatttgagaaaagtatctggaccctgacagacaatgaaggaaaggatatttacaaataatatatatatctctacatatttgtggaatgccactaaagtgatgcttagtagaaaacacatagcatcaaatgcttatattagaaggctaaaactgaagagttaagcaacttaaagtattagaaaggaaataagattttaaaatagagtatcaaaaattgcaaaagttggttctttgaaaaaactaaaaaaacaaactaagctctggcaagattaaatgaaagaggtcaaatatcccctaccagaaatttaaaatggaacataaagttaaatacagcagaagttttaaaaggcagagaggatataatgtactttttttttttttttttgagacagtgttgctctgtcacccatgctggagtgcagtggcatgatctctgctcactccaacctccgcctcctgggttcaagtgattctcgtatttagccacctgagtagctgggactacaggctcacatcgccacacctggctagtttttgtatttttagtagacatggagtttctccatgttggccaggctggtcttgaacttctggcctcaagtgatctgcctacctcagccatcgaaagtgttgggattgtacaatttacaaaactgtacaatttcatacaaaaaaaccctctgaatttatattcattgatattaatagattaatgtagattttttgctaaattattaataatctgttaatctagattaatataatttagcaaaacagactcaatgaagaaaaaaatggcaataatcctaaaataatccaataggttgaaacaactgtcacaaatctatctacaaagaaaacactaacttctactaaacatcctagggaccaatacccgaatgtaatgcaattattctagagtatataaaaaaatgcttccaggccgggtgcagtggctcatgtctgtaatcccagcactttgggaggccaaggcgggcggatcatgaggtcaggagatcgaggccattctggctaacagtgaaaccccatctctactaagaaaaaatacaaaaaattagccaggtgtggtggtgggtgcctgtagtcccagctactgggaggctgaggcaggagaatggcatgaacctgggaggcggagcttgcagtgagcagagatttcgccactacactccagcctgggtgacagagcaagactcgtctcaaaaaaaaaaaaaaaaaaaaaaaaagattccagagtataggggaaaagaactattcttgaggggagttcccaactcatatttcaaggctgggataccaaaacctaatggagactataagaaaaaaattataatccaagctcacccataaaaataattgtaaaacttccaaacaaaacacagttggccctccctatctgtgggttctgcatgcatgaattagaccaaccatggattgaaataataattaaaaaaactgtgttgaacatgtacagacttttttcttgtcattatttcctaaacaatacaatattaacaactatttacattatatattaggtattttaagtagtctaaaatgatttaaagtatacaggaggatgtacataggttatatacaaatactacaccattttatataacatattaaacttgtcttcagattttggtatccacagaaggcacactgatggacaattttagcagaaaacttgtgccaatgtattgaacacacacacacacacacacacacacacacacacaccctccaagtatttttctttttttcttttttttttgagacagggtcttgctcttttgcccaggctgaagtgcagtggcacgatctcagctcactgcagctttgatctcctgggctcaagggatccttccaccttagcctcccaattagctgggactacaggcgtgcaccatcatgcccggctaatttttgtagttttagcagagataatgttttgccatgttgcccaggctggtctcaaacttctgagctcaagcggtctgcctgcctcagcctcccaaagtgctgggatttacaggcataaggtaccacactggccaagtttattaattcctggaataaatgaaaagttgggttataaaatcactaagtttttagattaaaagattaaaggagatgcagaataaaagcacttgataacaaacttttaaaacctgtcatattaaaaactctttgcataactacaaataggtgggtagtcctttaaccataattaaaaatctacaaaaaacctgtagcaaacatacttagtggtgaaaacccttttagagaaggaacaagaaaatgatgtcctctctattcctagtcaacagagtactggacgtcctaaatatcattataagacaagaaaaagattctacagataaattattagaattaataagtctattaagataataattctaataagataaattattagaattaataagtaagtctggtaaaattctcatgtaaaagtaatatataaagttaactgcagctgggcacagaggctcacacctgcaatcccagcactttggcaggctgagaccagaggactgctggagcccaggagtgagagaccagcctgggcaacatagtgagactctgtcactataaaattaggtatagtggtgaacacctgtggtcccagctacttgggaggctgaggcaggaggatcgcttgaatccagcaggtcaaggctgcagtgagccatgatcacaccactgcactcactccagcctgggtgacacagtgagaccccatctcaaaaaataaataaaataaaataaaataaaataaaataaaataaaataaaataaaataaaagtcaactgatttttggtagagcaggaaacagaaaacacaattttgaaagataacattaaggccgagcacagtggctcatgcctgtaatcccagcaccttgggaggcagaggcgggcggatcacctgaggtcaggagttcgagaccagcctgaccaagatggagaaacagcatctctactaaaaatacaaaatttgccaggcgtggtggcacatgtctgtaatcccagctacttgggaggctgaggtaggagaatcgcttgaacccaggaggcggaggttgcagtgagccgagatcttgccattatactccagcctgggcaacaagaacaaaactcatctcaaaaaaaaaaaaaattaataaaatcataaaagcattatatactaaagaataaattttaaaatgtacaagacctctacacaaaaaatttaaatagtattaagaaaacatttaaaagacctaagtaaatggaaaaatataccatattcatggactgatgtcaattctcttccaactgatctataaattcaggttattttttgggtgcatggagtgaaaaattgattctaaaatttaaaatttatataaaattgaaaacagccaaaaacagtccttcaacaaaacaaggtgagaggaattgctctgccacacggcaaagcttattataaagcggcagtagttaagagagcatgacattagctgaaagagagataaatagagtactgtaggagaataaagatcccaaaaacataggcacataaacacgggtgcttaatttataatagtgatgacactgcaaaccagaaagaaagaaatttataatagtgatgacacagcaaaccagactttcaccacaaacctgtgaatgctttttaaataagtggtaatgagtcaactggatatctgtaaggggaaaaaaaacctaaaccatatctcataccatattcaataaatggcactgagatcattatcagttatcagtatggacaaaaatcaaactgatccctaccttgaaccatacacaaaaatcaattgcaaatggatttttttttttaagagatagggtctcactacgtagacttgaacttctggcctcaagccatcattctactttggcctcctgtgtagctgggattacaggcactcaccggctcttgcaggcacatttttttaaagtagaaaaagcttttttttttttttttttttgcctcccccaccctttgtttaacctatattgataaaggaaaagactgaatcatttaactacattaaatttaagaacttctgtttgtaggggaaaaatgagaagtctcaaattcagaggagatatttgtgatattaagaaatgataaagcattcagaacacacaaatacccttagaaatcagtaaggaaaagaatccaataggaaaatgataaaagacttgaatatgtaactttacagaggagggaagagaaatggctaacagacacatgaacctctttggtaaagagatattcaacctctttggtaatcagggaaatgcaaatttaatccacgactacctatcatttcacatccactagttggtaaaagttacaatgttagataatatcaagtattggttaggatatatagtaataggaactcaaatgctactgatgggaatgtaaatttggcttacacacttttgaaaaaaatgtggcatcgtctgaggatgaacctatgaaccagcaacactattcttaattttaagccctagaaaatctcttgtacatgtatgtccagaaataaggtagacggatatttgagtagcactctttgtaactaaaaacaaaacaaaacaggaaacaaccaaaatatccatcaacagaagaatgaataaatcatggcatattcataaaacggattatgtaaaaataaagcaacatttaccatagatatatctcacaaacactgaaaacagcaactcacaaaacattgtatacactgttaaagttaaaaaaatgcaaaacaaaatatgttatttagggaaccatttatgatagaactataaagacaagaaaggaaatgataaatatgaaattcaggatactggttacccctgaaggaatggagggaaatggtatcagataaataaacatagggaggggatctcaaagtcatggtcatgcttggtttcttaggctgggtggtagacacatgacttttttcttcctattctttaacagcaaatgttataaatattattttcaatctattcaagatttaatgaaaaacgttttaaaaaaacaaaaccccaaaacaaaaagtaaacacatggaaaagtgcttactgtttttagtaataaaagccattttctttttttttgagccggagtctcgctctgtcacccagtctggagcacagtggtgccatctcggcttgctgcaacgtttgcctcctgggtccaagggagtctcctgcctcagcctcccgagtagctaggattacaggcacatgccaccatgcccggctaatttcttgtatttttagtagagatggggttttgccatgttggccaggctggtctcgaactcctgacctcaggtgatccacccacctcggcctcccaaagtgctgggattacaggcctgagccaccatgcctagccatcagtctgttttaaatggtgcctcaatttgcttttattggctgggcgcagtggctcatgcctgtaatcccagcgctttgggaggctgaggcaggtggatcacctgaggtcaggagttcgagaccagccaggccaacatggcgaaaccccgtccctactaaaaatacaaaaattagctgggtgtggtggtgcgtgcctgcaatcccggctacttgggaggctgaggaaggagaatcgcttgaacccgggaggtagaggttgcagtaagccgagatcgcgccactgcactccagcctgggtgacagagagagaatccatcccccctaaacaaaaacaaaaacaaacagactgaccaaaaaaaaaaatcctatttaaatgcaaggtgtattgagactaataaatgtgcactgttggcactgttaatacagctgaccatttaacaacataatttgcaactgtgaaagtctgcttatatgtggattttttccaatgaatgtaactctttggagatttgcgaaaagacttgaaaacaaattgtgtagttgagaaaaattttaaaaagaaaaagatgtcatgaatgcataaagtatatgaagatactagcctattttattatttactatcataaaatatatacaaaacttacccacataaacacggaccctgcatggcaccatttgtagtagagaaaaatgtaaacagatgtaaagatacattaagtcacaactgaaaaaaactgcagtacatactgtactactgccataattttgtagccacctcttgttgctactgtggtgagctcaaatgtatctgcttaaaatgccatgtgatgctacttatctccaggtgagcagttgttgctgcagtaaattgcatatcacagtaaagagtgatttctcatagttcttgtgtatttttcattgtatttagtgcaaccataaactttgaataatccatggggcctacatgaagtgccactagtgatgctggaagtgctcccaagcagcagaaaaaagttacattacaggaaacaggtgaattgcttggtattatagattgagatctgtagctacagttgcccaccatctcaagatatatgaatccagtgtaaagaacactgtaaaaaaaaaaaaaatttgtaagcccgtaggcatgaaaaccttgcactttttgtgaaatactgtttttgttgttgttgtttgtttttttgagatggagtcttgctctgttacccaggctgcagtgcagtggcacaatctcagctcactgcaacctctgccacccaggttcaagtgattttcctgcctcagtctccggagtacctgggattacatgtgtgtgccaccatacctggctaatttttgtatttttagtagagatggggtttcagcatcttggccaggctggtcttgaactcctgacctcatgatccacctgtcttggcctcccaaagtgctgggattacaggtgtgagccactgcaccaggcctagaaataccattttatctcatatcaaaaatgcagcttttatgtgggtataggattgctgtaagaaaagtgtatctgtagattaatgatttgagaaaaagtgaagtcattacacgacaaggcaaagggaaggtaaaggatctaaagctggatgatttaatgccagcaaaggatggtttgataattttagaaagaggtttgcctttttaaaatgccagtaaacaggagaggcagtttctactgacaaagaagcagcttctgccaaccaagaggcagcagacaagctcccagatgccaatacaaaaatcactgaagaaggggaatatttgcctgaacaggtttttttttgttgttgttgttgttttttctgaacagatttttaatgcagataaaagtgccctatttagaaaaaaaaatgccacaatggacatttgttactaaaaaagagaagtgagcaccaggatttaaggcaaaaagggataggctaactctactgttttgtacaaatgcagtcaggtttataatcaagactgcccttacttacaaagctgctaacgcctgaaccttgaagggaaaaggtaaaagcttctggttgaacaacaaaaaggtctggatgagaacccaatttatggattggctccatgggtgctttgtccatgaagtcaagaagtattttattagttaagggaatgccctttaaagttcttttgatattggacattgcatctggccacccagaaccccaagtttaacaccgaaggtcttgaagtggtctacttgcccccgtaaaaacaacatctcggccaggtactgtggctcacgcctgtaatccaagtactttgggaatccgaggcaggtggatcatctgaggtcaggagtttgagacaagcctgaccaacatggcaagaccccatatacaaaaattagccaggtgtggtggtgggcacctataatcccagctactcaggaggctgaggcacgagaatcacttgaacccgggaggcgattgcagtgggccgagatcgcgccattgcaatcaagcctgggtgacagcgagattctgtctcaaaaaaacaaaaacaaaaacaaaaaaaaacaaaaaacaagaacaacacaaaaaacaagaacaacaaaatacattcctaattcagcttctagatcaagggtcgtaaggacctataaggctcattatacatgtactttatattcatagaaaggagtgtcagcactatggaagagaactctgttaaggagaacatcacaagtctggaaggattataccattgaaaatgtcatcactgtttacagagaaagccatcaggcccaagacaatcaattcctgctggagaaaactgtgtccagaggttatgcatgacttcacaggttttacaacagggccaatcaaagaaaccatgaaatagttgtagatatggcttaaaaggtggagagtgaagggtttcaagatatggatcttggagaaattcaagagctaatagaaactataccacaggaattaacagaagatgacttgatggagatgaatgcttctgaaccactgccagaaaataaggcagaaaatggaagcagcagtgccagaaaacaaactgacatgagaccatctggcataagggtttcaataacctaagactgcttctgacttcttttacaatatggactgtttatgataagggcacagaaactaaagcaagtggtggaagaatgactgtaccatatggaaacatttttagaaaaatgaaaaagcaaaaatgtcagacagaaattatgatatccatacagatgaattcacagctgaattctaccagacattcaaagaagaactggtaccaatcctattgacattattccacaagacagagaaagagataatccttcctaaatcattctatgaagccagtatcaccctactaccaaaaccaggaaaggacataacaaaaaaagaaaaccatagaacaatatccctgatgaacatagaagcaaaaatctttaacaaaattctaactaaccaaatccaacagcatagcaaaaagatagtccaccatgatcaagtgagtttcatgtcagggatgcagggatggtttaacatacatgagtcaataaatgtgatacaccacaaaaacagaattaaaaacaaaaatcacatgattatctccacagatgcagaaaaagcaaatgacaaaatccagcaccccttgatgattaaaagcatcaaggccgggcgcggtggctcacgcctgtaattccagcactttgggaggccgaggtgggcagatcgcctgaggtcgggagttcgagaccagcctggccagcatggtgaaaccctgtctctaataaaaatacaaaaattagccaggcgtggtggcaggcgcctgtaatcccagcaactcaggaaactgaggcaggagaatcgcttgaacccgggaggcagaggttgcagtgagccaagatcgcgccattgcactccggcctgggcaacagagcgagactctgtctcaaaaaaaaaaaaaaaaaaagcatcagcaaaattggcatacaagggacatacctcaatgtaataaaagccatctatgacaaatccacagccaacataatactgaatggggaaaagctgaaagtattccctctgagaactgaacaaaacaaggatgtccactcttaccacttctcttcaacatagtactggaagtcctagccagagcaatcagacaagagaaagaaataaagcaaatccaaatcggtaaagatgaagtcaagctgtcactgtttgctgatgatatcactgtatacctagaaaaccctaaagactcctccaaaaagcttctagaactgataaatacattcagcaaagtttcaggatacaaaattaatgtacattaattagtagctctgctatacaccaacagcaactaagctgagaatcaaatcaagaactcaaccccttttataatagttgcaaaaaaaaaacaacctcaaaaaacttaggaatatacctatccaaagaggtgaaagacctctacaaggaaaactacaaaacattgctgaactaaatcacagacgacactaacaaatggaaacacatcccatgttcatggatgggtagaatcaatattgtcaaaatgaccatactgccaaaagcaatctacaaattcaatgcaattcccatcaaaataccaccatcattcttcacagacctagaaaaaacaatcctaaaattcacatggaaccaaaaagagcccacatagccaaagcgagactaagcaaaaagaacaaatctggaggcatcacattacctgattttaaactatactgtaaggccatagtcaccaaaacagcatgatactggtataaaaataggcacatagaccaatggaacagaatagagaagccagaaataaacccaaatacttacagccaactgatcttcgacaaagcaaacaaaaacataaagtgaggaaaggacaccctattcaacaaatgatactgggataattggcaagccatatacaggagaatgaaactggatcctcatctcccaccttatacaaatcaactcaagatggatcaaggacttacatctaatacctgaaactataactagaagatagcattggaaaaatccttctagacattggcttgggcaaatatttcatgaccaagaactcaaaagcaaatgcaataaaaacaaagataaataggcaggactcaattaaactaaagagcttttgtatggcaaaaggaacagtcagcagagtaaacagacaacccacagagtgggagaaaatcttcacaatctatgcctctgacaaaggactaatatccagaatctacaatgaactcaaacaaattagcaagaaaaaaacaaataatttcgtcaaaaagtgggctaaggacatgaacagacaattcccaaaagaagacatacaaatggccaacatatgaaaaaatgctcaacatcactaatgatcagggaaatgcaaatcaaaaccacaatgcaatacctgccaccttattcctgcaagaatggccataatcaaaaactcaaaaaaaaaaaaaaaaatggatactggtgtggatgcggtaaaaagggaatacttctgcactgttggtgggaatgtaaactagtacaaccactatggaaaacagtgtggagattccttaaagaactaattccttaaagaactaaaagtagaactaccatttgacagtaaaatggaagaaaagaagtcatttcatgaaaaagatacttgcacacacatatttatagcagcacaatttgtaatagcaaaaatgtggaactggcccaaatgcccattaatcaatgaataaagaagctgtggtgtatacatacgatggaatattactcagccataaaaaggaatgagtaaatagcattcacagcaacctgtacgggattagagattatttattctaagtgaagtaactcaggaatgaaaaaaccaaacatcttatgttctcactcattaagtgggagctaagctatgaggatgcaaaggtgtaacaatgatacaatggactttgaggactcggtgagaaagggtgggaagggatgagggataaaagactgggatgagggataaaagactatcaactgggttcagtgtatactgcttgggtgatgggtgcaccaaaatctcacaaatcacttctaaagaacttactccactttgggaggccgactcaggcagatcatgaggtcaggagttcgagaccagcctgaccaacatgatgaaaccccatccctactaaaaatacaaaaattagccaggcatggtggtgggcacctgtaatcccagctactcaggaggcagaggcagaagaatcgcttgaacccaggaggcagagggtgcagtgagctgagattgtgtcactttccagcttgggcaacatagcgagactccgtctcaaacaaaacaaaacaaaaaaacttactcatgtaaccaaataccacctgttccccaaaaacctatggaaatcaaaaaaaaaattatgatgtctgtaaagttatactgagtgtgcttgccccttctgcctcccctgctacctcccccacctcctctgcctctgccactctttagacagcaagatcaaccccacttctttatcctcctccgtagactcctcaacatgaaggcaaggaggatgaagccctttatgatgatccacttccacttaatgaagagtaaaatatattttctcttccttatgattttcttaataacattttcttttctctagcttactttattgtaaggagacagtatataatacatataacataaaaactatgtacctaatgactgtattatcagtaaggcttccagtcaatagcaggctattagttaagtttctggggtggggagggtcaaaagttttcatgggttttcagctgtacaagggacagcaccccaacctctgtgttgttcaaggtcaactgtacttagaaactttttagaatgtactacatactgtgagccaataaaaatgttcatgtaggctgggcatggtggttcttccctgtaatcctagtactttgggaggctgaggtgggaggatagcttgaggccaagagttcgagaccagccagggcaacatagcgagacttcatctctaccaaaaacacccagccaaccaaacataaccaggcatggtggtgcacaccataaggctgagacaggaggatcccttgaacccaggagtttgaggctgcagtgagttgtgattgtgtcactgcactacagagtctgggcgacaaagtgagaccttgtctctaaaacaaaaaatgttcatgtactgtgcctcagtcatctcatgctggaaattttaatttaacaaaagaaaaagatccattgtagtataaactataccacattcaaattcaacttaaattccagtatattaattttaggaaataatgtaaccattaaaattatagtttaaactctaattgaaaaataagaatttaagattataagtatattatgactacagtatattaatttgaagaatataaccattagaatagtttaaactttaattgaaaaataatttaagattatacgtatgactattgtaaaatacatatgcataaaggtatactatttagttaccatactgaatggtaacacacaaaaataaaaaatgtagtattggctataactcctttgtaaggtttatattatgtagttttatttttgttgctgttatttcgttttttttgttttgttttgtttttttagatggagtactcactctgttgcccaggctggagtgcagtggcatgatctcggctcactgtaacctccacctcctgggttcaagcaattctctctgcctcagcctcccaagtagctgggattacatgcgcccaccaccatgctcggctaatttttgtatttttcagtagagagggctttcaccatgttggccaggctggtcttgaactcctgagctctggtgatccacccgcctcggcctcccaaagtgctggaattacaggcgtgagccactcacgccccacctgtttgtttttttgcaatataaaaggagaaaaccttctctacagatagtaacacttaaggagacctgttgactacaggaattcattaccctacagtaaatgtatacaaaaagaaggacatttaagaattgtagtcatggcaaaatattccaaaaacaaaagcaagaaacaaagcacttgattgttactaaatgtctatgacctaaagaagtatgtactgttccataatcatctggtttacaaagatggtagggtgtattttgttgttgttttcttacacctcccaaataataaaattaatgccagaaatcagtcaattctaaaagcaggaaacaggtttctttctattactaccacagttcacctgctaaatacttgctttccttctgagagtctagaattttggtacatctcagagagagagtgcctacatgaccagctcctgataaaaacttttggcactaagtctccaatgaggttccctacaacatttcacacctgctgtcacaactcattgctggaggaattaagcaagtcctgtgtgacttgactggcagaggacccgttgaagcttgctcctggtttcctccagatttcactccacgcacctttttcctttgctgactttacttggtattctttcagtgcaataaatcacaggcaccagtataactatatgctgagtcctgtgagtcctcctagcaaatcactgaaattggggatagtcttggggatggacacacccataaattatttcacctaatctgcacagcttccctacgggaggtagatatcattatctttactttatagattagaaaatgcaggatcatagaaattaagtgacctggaaaagcacaattaatgataaggtcaggatctgaacacaagttttttgcttccaagtttactgcttgtaagtattctggggggagggaagcagaaactcaaatactgaagattcacaacaaatagtagcttttaaattaaatgatctaatagtagtttcaagttaataaaatttcctgagccttggcttttctaatttttaaaattaaatacatggcactatagagtatggtagggttgtgggagaggggaataagtatatgctattaaagagtagtaaattctacacagattacttattattgtcaaccgcttttctgtttttttgttttctctctctctctctttctgacacaggctcctgctctgtcacccaggctggagtgcagtgtacaatcatagtttactacagcctccaactcctagctcaagcaattctcctgtctcagcctcccgagtagctggcactacaggcgcacaacctacacttggctaatttttaaatttttttcgtagagatggggtcttgctttgttttccaggctggtctcaaactcctggcctcaaatgattcttctgcctcagcctcccaaagtgctgagattgcaggtgtaagccactgtgcctagcctattttctcttttcaatggttccttaaggcccttatgtcatactgtggtattggacagtctcaatttgaagatctttacgcagaaagccttgaataccttttagtaaaatctttaaagcagagtcgcagtttattatgatgtctgaagagctttgggtcactaggtatttcagacagaaaaacctgggcaacttccaaaggcccctgcaaaataagaaaataagaagtgtgtttttttgttatctctaaaatcacagagacagaatttactcaaatgatttttcttagctctgagatggctgcatttaagcttaatgcatatatgcctatgcctatattaaaactccacagactatttcagtattttctaatttcattctacattcttatctagtggaattaacttcttatgagtttattcttcaaagaaacagaataggaactcaaggactgactactatgttcattaatgtattttgctttgtatttttcacattctttaatgtatcctggatgtaaaagttgtcaagctactacatctgccaatccgctgattatcagagttgattttgctaaaacaggttccctcagtattccaaaggtattccggacattgtgttaaagaagataatcttttgtaagctacatcatttggagacaaaaccttaaaatcgtgcatgtttctaagagcttttgtaaaggtcttaaggtatttatttcagttttggtggggcactttttggctttgttcttttaatctgaaaagtagttaagacatggtacaggaaatcttacttgaagcctttctgtattttcccttatcatggaatattcctaagactggggccatgcctaaaatcataaacaagataattttaatgaaccaaccacaaggactaatggggatggcttctaatctgcatatgacaaaagaacaataatttcttgtgtcaatatatttttcaaattaaaaaaatgattccatatcacttatttaatcctcacaacttattgtaaaggagatctggggaaggtaacatcagggagaatctaacatagtagaggttcgcaaatatgtacatagctctgaaaatgagtccttgttttaaagatcacattcttttgtacaagctttttaaggaaatattattttaagtgaatcaattccttcttaatagaatttataagatcgcataggtagaaaaatacaggcagtagagaaggcagatccttttcatctgacttaacaattatttctgatctgaaattatcccaaatcgtatttacagcttaaatcacacagtgctagcaaaaagcactaacctgattcactgtggtgcctacagatccctggagtaccatctgaagcattttggggtctgcgggatcctgatgtgttgcaaatgccaactcctgtgtctttttctgcatgtcctcaatagcaacttcaattggtgttaagatgatctgagtaaaagagcatctgttaaatcagtgtactgactgaaaactatttaatgaactttatgtataatcaactgaaattagaaaaaaaaaagatcaattgtaaactttcatgtaacaataaaattccaaacttggattcctaaatgaaaaaaaaaaaatcaaccttttaaagaaaaagctgggggtgaattagggtcttagaaaagaagtaaaaaattgaggactcaaaaatgggtaaagttctaatatgttatggtataagggatggtacatatcttctggtacatctgagttgttgttacatggcttgaatgtatttgcttcactaatgctgtttgcccattaatggacttacctcttctttatgagtgacattgacccttgttttaatataaggaaaggcatgagacgtagtcagaatggtcttccttttgaattgttcatgaagttccccatgggcacggccatctaaagtaaagggtgtacagtacatgaatcgacgaagattgtaatttttgtcgaaataggtgattctgtccttcatctcatatgtgtcaaagtatggctccacataggtaatctgaatatatgcctaggaaagaaaaaagtccttcatttcctcactgttaagtcatcatttagtctttctcaaacaaaattgcacagaggatttcaaagagatgtctatatgtcattatagtcgaatcaactataccttgttaggatctaatttacacttgtctacaggattagagtctttgattacttcaaccacatcctctccaaatctttctccgtaaaatccctacaataaagaaaaagaaacattttatatgaagttaaaaagactgcgaaatagagaaggcctgagggtgactcctgagcaaaattaggagaattagtgagttctgtacaatcatatcaataattaaaagtaatgatttaggcttacaaaaattatactagcttataaattagcatggtctcggtccatatttatttgacattattcccatccacaaactttaaataacacaaaatatcagaaaacaacaattttctccagtaaaaatacaggattccacaagaagtcctcaagagaaacaaaagggaacagaaagcaaagacaaaagaaactcattattgttgatgtataaaaatcttagttttactgagtttattgtggcttgatttcttagagaccatgggttaatgaataaacattcatttttatgaactatttttttaatcccagaattttcaaataaaagcattgacctgttgcagttctctatgggtttacattttgaaaaggcaaccttaggtcaagaatatagtgactactccatatgacactgagtagcagcagcatgggtaaaggatgaagctattcaaaaggaaaaatcgaatttgaatcttcaaaggagaaacccccactgctatcccaaaggtaatttttataattgagtaagtctcaattaatatttcccaagacttacacctaacctcttgaaaaataaaaagtcacagtttgagccaatttatgtcagtttggccagagaagtcaccaataggaatataacattcaagaaattaacatcagtgagaataaaaacaagcccagagcactacttctctttgtgaatacaaatcacctggggatcttgttaaaatgcagactttgattcacaggggctggggtggggtctgaggttctgcatttcaaacaatctcccaggtgaacccaatgcttccggtccatccactacactttgagtaacaaaaatagagaaaggttggaaagaataactataacagaaaatactagttagcccagtaaatataaaacgcaatcatttatggtgaaaattaagaaattataaaggttaaaggaagtgtttttaaggtgtgatttcaggcttttacgttctaaagatacctcacctggaaccagttaagccaaagagataatatgcttgggtcagaaatttcttagggttctggttctagttcaattattagctactacttaattctttgtctttttcaacaaaatgtgggattatactatatatttctccgttaagtcgcagtaattctgaaggatacaggggtttctaaaatatgtgtgaaaatagtctcaaaaaatagacaatattactattttattgctgccataaaagatttgaaagagtattattgtaactattaaaagtccttattctctaacggagtagtttacttggcaagatctggcttactaaatgattagatctggatctgaaagtctaatcatcagagagaatacaaactaaagatgacattttatgaaccaccacagcattcacctccaatctgtgagatatctctgcaagtttggttattgcaggctccttgtaaacaaattcttgttcatccaaatccccgaacttggttccataaaaaccaacacgaaaataggtgccaaacatccgcttaccatcctaggtttaggaaaatggagaaactttaatatgaaatcttcctgtttttcacattatgtttagattgttacagcataaaatttccaaaacattgcaaaaagttttaattcaaaattataatattttaaatgaaggtttaaacaaagtaaacagtctttcctttttcattatttctaacaaataagtatgcaaatagggctactaacaagtgactaaatcacatataatatttttcggagtttgtacgaagtgcctctatcacattggtctatgttttttaaatctatataactgagataaattaactcattttccttattgcaagaaaagatgcttgatataaactgtcttaattgtactgatactagagcatactaggtcaagttaaattttaaaacaacacttacatatttttaaattagcattagcctttatataacctcttcacgtattaaatgagattgtaaaagttaggagtcaaagatagcacctggcatagagcaggcaatgtaaatgtcaagaccctccagaagcactaatgcaaaaattctacaattagcagccctgtgccaataaattattattattattattatttagatggcgtctcactcttttgcccaggctggagtgcagtggcacaatcttggctcactgcaacctctacctcccaagttcaagtgattctcctgcctcagcctcccgagtagctgggattacaggcatatgccaccacacctggctaatttttgtatttttagtagagacgggtttcagcatgttggctaggctgttctcaaactcctggcctcaggtgatctacccacctcagcctcccaaagtgctgagattataggcgtgagccaccgcacccagcccagtaaaaaatttttatgtagaagagttactaaaaatggaacagaaaaggaaaaaaaaatctatgagtgaaagataataagtaaaaaatttttgagatgagttggttattctaaatcacccaaaccacccattggcatgcattaactacacattcatgtcaggtacaaagtacattaagatcaccttaactctcacacagcatatcagaagacaaattctttcaataaagataaatatttggacactttctatgcaatttttacaattttttttaaaaaagtgtcacctcagcctcctgagtagctgggattacaggtgtgtgccaccttgctcagctaatttttacaatttagatacaaaattattttaggattctctggtggtgcctatatgcgcattacaagtaagtaaatacctctgaattctctttaagcctaatctgctttatatttatttttcctatactgaaaaagcaaaagggcatataaaataagctagaaatgccacacataattaagcaaaatgggaagctctaatccttaatttaccagttttataataccaaaaaaaaaggtatagtgatgaaaaatatccctacatttttgtccaaaaacatgtaaagttttaaagaaaaatgtatttggagctaaagaaagttgaggcttctaatttaaaaacattttttcagttactttatttcaaaatttaacacacataaaaattaactgatttctacagcaaattaatccatctatatagattgaatgattcaactaaaattctgattaaaaccataagtaagccaaaagaacaacataataatagtaaattctgacttaagtaataaaggcactgcatgaaaaataaaaaaaagaacctaagaaaattacttaaaaatttgtcatttttttcaaaacatgtcatacacatatatacatatacattcctactttttgttttttatttatttttagtttttagtttttttgagacagggtctcactccattacccagactggaatacagtggtgcaaccacagctcactacagcttctgtctcctgggctcaagcgatccttccacctcagtctcctgagtagctaggactacagaagcatgccaccacacccagctaattttttgtactttttgtagagatggggttttgccacgctgcccaggctggtcttgaattcctgggctcaagtgatctagctgcctcagcctcccaaagtgctgagattacaggtgtgacctgtaatattaatatgctgctactctggctgtcctcctctcagaggtttccagtttaaaacaatattccaattcttcaatattgtggccctttaaatatttgaagataacaattaggacttgttccctttagttaaactttccagttttcaatcttcatatgacagtaatttctactctgttgacactttattacaatgccatcctttaaagtgtgatatcccagatataaccataatactgttgatgtgatctgaccaatgaaggtgtgttgctgggctcaatgtcaccttcaatctgaacactgaattttattaaggtagcttaaaactaacctacctctttttattatattttctcatgacattcggttcaaggaaaaataattaatgggtgtttattatgttagccactgttcatcttcagtaataggaaagtaaaaataagttagacttgcttcccaagagagtaaaaaatgtattcaaataattacaaaacaaagggatatatgctatactaaaaagaggtataagggaagattaatcttgttgcaagtaagtcacaacagaggtaatgcatagggttctactcaaaataaacggccaagtggacagggaagggaaggaaggaacactgatagagggtcaggggaaggcagatacaaatattagggaaagcgttcatccattcaaatacttattgagcccttactatgtgttagcaaactgttctagatatttatgataaatctgtgaacaggccaggcgcggtggctcatgcctgtaatcccagcactttgggaggccaaggcgggggggatcacgaggtcaggagatcgagaccaccctggctaacacggtgaaaccctgtctctactaaaaatacaaaacataagcctggcgccgtggcgggtgcccgcagtcccagctgctcgggaggctgaggcacgagaatggcgtgaacccgggaggcggagcttgcagtgagccgagatcgcgtcactgcactccagcctgggcgacagagcgagactccgtctcaaaaaaaaaaaaaaaaaaaaatctgtgaacaaaagggacaaagaagatggtcagggtaggtttcatctgagcaaagactgaaggagatggaagacttattcatgtgaatccctgagcgacgtgcatcccaggcagaggaaagagccagtgcaaagatcaggaggctaaagcctaccgagtgtgtttgaggaacaggaaggtaagcagtgtggttggagcagagtaagcaaacaggtagaatcggatgagataaggttagagaagtaactacaaggagttactggatatttaaaaataaatgtttgtgtgcagaatggagtggaggagagagcatcaggggatgaggctagagagaaagaaaggctgagaatttgactattttcaacttacactccctctagtgtcaaactactacggaagtatgcttcacggaagcacagtcatattgcttcgcctgcaggaaaaactcacttcatctttatttcttcttcagagctttggaccacaggatgatacctgtttttcttttgaattaaaaaaaaaacaaaaacaaaaaactttcctataaattaggctgtttttctagcattacctttctttactgttatgaatcctttctgaactttctatcactcctcacaatacagcttattcttccttagcgattctacttactgcttccacaatcctctgggtgataagactatgtccgggacgaagaaatccatctaccatgtttctaaatggttcaaacctcttatgacaaatatatcataaatctattttagttttgttgtctttatttagcaagaaacattccgatggactagttgtatatttccacagtgacatcatttctctaacttcttttatcctctcccagttgttttccacaatgcttcctttaagttaactgatttccatataggcataccagtatttcacacaatggtgatctttctttccttctactaggtttattcctcttaaagagcatttaccagttcacttctagatgcagatctcaactgggaaatataaaacctcttagattttattaactagtgttaagatttctaatagtaattatgattaaatcatattaacaacaaaaataacaactttcaacattttttgagtacttactatgtgctagacactggttaaccactttacatgtattatatcaatccttatcacaactttatgtgatagattaaattattttcaccctcattttatagaggaggaaaagtatcttgcccaaggtcacgctgttagtaagtggtggagtgggaagttaaactctaatatatttgacacccgactctaagcatttttttttttttttttgagacaaagtctcactcttgttgcccaggctagagtgcaacggcgcaatcttagctcaccacaacctccgcctcccgggttcaagcgattctcctgcctcagcctcccaagtagctgggattaccaccatgtccggctaattttgtatttttagtacagacagggtttctccatgttggtcaggcttaggtgattcacctgcctcagcctcccaaagtgctgggattacagacatgagccaccacgctcggcctcaagctcttaattaagctttatgttccccatattctatatatactggtataaacaccaggacattagcataacccctgaactatcatccacttctctggtgttttcttgagaattcttacaaatttcctcaagaaattcttttgaggattacctccttccctatgttgttttcctctatatttcatcctctactgcaattatttttgcatgcttgcatatcctttatacttcagcataaaaatcaggttggtggcttactgacaaaacacattcttccaagatatattgtactccatttcttatcagaaggacatatctgaccattttatgtcccagtccgaaaaaaagaaaccacatctaatatcatctacatagtaaatatttgctgtccatatttttctttctttttaaaagacagggtcttactatgtcacccaggctagagtgcagtggtgatcatagttcactgtaacctcaaactcttgggcctaagtgatcttcctgcttcagtctcccaagtagctaggaccacaggtacacaccaccatgcccagctaatttttttttttttttttttttttttttttttttttttgggtagagatgagatctcagtgttgcccagactggtttcaaacttcaggcctcaagcgaggatcgcgccttggcctcccataatgttgggattacaggtgtcagccaccatgctgggctttcatatctttctttttcttctcaaaagtagcataaggggcagaaaaaaaatcagtggtatgggatatattatcaggtgctcagttatgggtctataccagtcatcagggagtcactaactaccagaaagtatctcctcttagagatactaagattcttcccatttactatgttttccttaactttcttcatatctaactttacctttctgaggtaaaggctcatggatgttttatacctacaatgttctgatttcttttttttttttttgagacagggtctcgttttgttgcccaggctggagcatagtagcatggtctcagcgcactgcaaactctaccttcccggctcaagcaatcctcccacctcagccttccaagtagctgagaccacaggtacatgccccagcaattttttttgtttctttttggtagagacatgggttttgccatgttgaccatgctggtcttaaactcctgaactaaagcgatcctcccaccttggcctcccaaagtgctgggattacaggtgtgggccactgtgcctgacctgttttactttctcctttagagtgtcacatttacccacttgactacccaaaagtacttgttttcactatgctctattcttgaatttttatttcatttccctctttcagagttgatcgccctgctcattataatttgctgtttctaatcctgttctatcttttaactgcttggatgtgttactttatgtcactcagctttagtgtggattgaagaaaataaaaatccaacagaagccactgagccagaactatggccagtatttctgaacatataaaaaccaaaatactggctcacattcatgtccattcagtccaataatgagagttaagatatagtcaatttgcatctgtcaatctcaaaagttagggtaatctatatttccttagggatctagtagagatcttctctagcctttccagaaaatgtaagatatactttactagagtagtggtgttctttaaagaaatatgttgtgatctttgaatggaaaaaaaagtatcacatgactatgttatcactggggattgatttttctgaaaaatttaaacttgtattagtgtacttctgaatacaaattcgtcactatttgataactgaacaaacttttcttttttaaccctgaccctaagatagggtctcactctgtcatccaggctagagtgcaatggcaccatcatagctcactgcagccttgatgcctggggtgaagcaatcctcctgcctctgcctcccgagtagctgggagtacatatgcacaacaccatacctggccaatttttctaattttctgtagagatggtctcactatgttgtccaggctggtacaaacataattacaaaaatatatatgtatatatacatacataacatagaaagtggttataaaaattttcatacagaaatttaacatttctctttctgctaaaaataattaaatatgaatcataaaaaaagaagagttcaaaacatgcttttaggctgggcatggtggcttattcctataatcctagcactttgggaggctgaggcaggtggattgcttggggccaggagtttgagatcaacctgagcaacatggcacaaccctgtctctacaaaaatacaaaaaattagctggtggcatgcgcctacagtcctagctactcgggaggctgaggtgggaagatcacctgaactcaggaggtgtcaaggctgcagtgagctgtgatcgtgccactgcactccagtctgaattacagagtgagaccccatctcataaacaaaaattttaaaagacaacaaacatgcttttacttcctactatttcgagggaaaagtaaaaataaaagtgaacactaaacagccattaaagaactgaaactaccagaggagataacagccacatgactcccgaaaggttcatgatttattattttgcatggtaaagactttactgaaatactaagttttagagttatctttcacacacacacacacacacccttctaaaaagctttgccaactcaaataatttgcactaaatcaaggagcacaataaaaaaatgaaacatgtgactaatatataagcccagatggggttttcctgtaagttggggagcaagttatcaattcaaagagcctttctacaatgcacagattatccttactggacttcaatccagtgaaagatctaccagaatactagaaaattagctaggaaacattgcttttagaaaaaacaaaattactgaagttttcatcgagtcaaaaagaaaaatatacacaagatagaacttaccacaatagacaatagtaaaagtggggagtagggtcagcaaccagggacaagagagaagagaaaacagaaagcattttaattacagaaatttcaaaacaaataagcagcaaatggtagaaaacacattttttaaatgcaggcatccatttaagttttacaaaggaaaagcaaaaaacaaacgtgcaacaaatttagcagctacaaagctaaaggtccagtaaaaggtagtgacaagtatataacaagaaaataaagtctgtgagacttttaccatgcaataaacatgatgacagaatgatattaatgtcataaccagtgaaaattatacctttcaggggtcgatttagcatcacggaaactagtaataaactgctcagaggtttcaatttattattttatgcctaattttcaactaattctatttaatgttaggaaatttataaggagttttatcattcatagataaccatggcaagtctctttatgtatgtcttaactgagccataggaatgaggattatattttgagtattgatacagtcatatacatttaatctagagaattaaggtagatttataaaagtactggcttcatctaaagaaaaacaagacttgggtactatttcagaaatagaggaaaactcagtagtaatatttattcccaaggttttctatttgggtcttaaaacaaggattgcaatgcaaacccaaaaagagaagcctaagtgttcgatcaacataaatctgacaacaagtgagaggcaaagcacacaactttacaaatatacctagctttaaataaacctgacttattactaccttgctttacctcatcaaaataaattagggcatattttatagaattatttcctttgcagaaacgtttaaaataatggtaatcaattcttcctggcatttttttcgggtaagattgtatttacatataactttttgtgagtcttaactactacataaaaggaagcatgtgtagtcttatcaaacaatatatcaaatgctgtcagaatacgaggtcaaattaaattataagttctcttaatttctttatccctttccccaacaaaaattaaatgacaaaagtgaatttctttcctcagtagtgctcatagtcaaggtgaagtgactcaagatcaaattaacacagtatctcatcaattctaaaatgtactttttttgctcacattttaatgtttttgtagttggtattcatctttcaactaataggatatcctggtttaatacacagggattttttttttcctttcttaaaggcatataaaatactagtatgttttgtaattgatgccatctgagatcagatgaaatagagtattttttatttacacctctgagcaataacacataaatcgacctctgtaaaatgaggtgaaacaatatggttaaaaaaagaaatctgtgtataaatgttgatgagagaaatgcttcaaagggtaaaaactaaagtgatgacaaagtggctcatttaccaaagaatctcattagtgtaacatatggatttccatgcactgcctacgacctcataataagatatttcttaaaataacttacaatattttaacaaaatttctttggttaatgaattcagttgatagcagatagcaacagaatgcccacagctagcacatgtgggcaaagcattggcataagaaatctgataaaatcaatctattagtgtctttaactaactaaaacattacctacctcccagccagtactctgtataataaaaagtaaaaaagggcaagtcataaaaaaactgtttgaaagaacaaaaaaggccaaaggcaccatataccataaattcttctccacaaacagaagacagcaggatattttaaacagcatattcatttacttaagacctgcaataatttcataaattgcttggtcaaaacccagtggctaaaattttgccttttaaaaactttaagtgaaagtacaaattttagggaaagagagccagcagcttgttccatttacatgtttaagtaagatctctaactaaggtgagctgcacttcaccaagtatccaggataaattaaaatacaaactgcaactctgctcaaatgccaacgacacaaatggctaaaagtttctcagaaacgactagctctaaatgttccagacctaacatttataatttgcaatttacagctctagaaactggcttgaggttcctgtgatagtatatatacaactgattattaaaagacctacctgtcatggtcatgaaacctaatcaatatttttcaactttaacattttaatagatgacaataaaatcctgacttaacaggatagcagccctatttttagactgtcaaaggcttttcagattaatcagttcatttagaacagcttaattcattgcaaaaaagaagaggtcaagctgataggtaacaaagtaggactaatactgaatacaaaagtggatagtcatactccaactcctttgacactagcagcagtaggtaacagtagggtagcacggggaagggaacagaaaagtggaggaggaggagactcgataggatattttgcagtatttcaatgaagccaaggatttagtttcaaagaaatcaactgctagtagtgtacttcattttaaaattaagtttaatttgatgctaattttagtgataatatgtagattccataatgaactacaaagattaagtaatgaaatactattagaattaaatatacattaagacaaccattttattcattattttcacaaaataatatttttgtattagaaatatatcaaaggatgattgtaaacatctaggaaaaataaagttcagttgcagtcattaaaaatattagtagtttaattattaaagtttcacatcatttaatttaaaaaactgaaatataaaaacttcattttcacagcaaaggaataggtatcaattttaaaatgagattcacaactatgatctaccttgtgaaacagaaaatcacaatttttaaaaacttgctaattaataattcaaaaatgaaaaaaaaaagctatgcagaaagtttatgatgatcaccatttactttaggtgaattcatttttattgttaatgagctttgctttggccatgaactatcattttgaccgctcatttgtagtctgattaaaatggtcatttcacgggatctagtttgacatcagtgcaaaacaacattaatgctttcagacagttttttccctttatagtgaagctagaaattggaatcattacctgatgaacaattttgctgaatgcttcttgaagtttaccatgaattgtggatagtttctttgcatcccgattagcttcatgaataggaataagtactttgtaaacttcattaactgcttcatacatgccagcctataagaaaaaattttgttaagatgttgctttcttttacatcaataagaaagaaaagtaattatatgaattcgcaatatttctattaagataatacactgaggccagacgcagtggctcacacctgtaatcccagcactttgggaggccgaggcgggtggatcacaatgtcaggagatcgagaccaccctggctagcacggtgaaaccccgtctctactaaaaatacaaaacattggccgggcgtggtggcgggtgcctgtagtcccagctactcaggaggctgaggcaggagaatggcgtgaacatgggaggcggagtgtgcagtgagctgagaccgcgccactgcactccagcctgggcgacagagcgagactccatcttggggaaaaataataatagtaataataccactgaaatttttccaatagaaaataaaaacaaatactactaatttttaactgtattaaggtttaataaaagaattttccagtgtatcttctcctctggataaatgggtatgtatgtagatatgtgtatgtgtgtgtatattaatatatatacatacacatatgtgcatatttatatttctataatttgaattgggcattttccttttatctgcccaataattacttcactaaggttaatgtgtgtatgtgtacttatctatgcttataatcttttgcaaaaactaattctgagcagaagaaaaataaatttaatattacactggtcacagatacccaattctcctataatagcatcctgggacataaaaatcatttacttttccaaaatattaagctgacgaaggcaatctcctattgtaaatctcctatggaaaaatcacaaatctttaacaaagcatagaaagttttgagccaccagatttccttccactgtgggctagttggccagtggttgctatggttataatcacataatcagagtgagagacaagatgtctttgtattggtcttctatcccttatcctttttttttttttttttttaaataataagagacagggtcttgttctattgtttaggttggagtgcagtggtgtgatcatagctcactacagccttgaactcctggtctcaagcaatcctcccaccccagcctcctaagtagctaggactacaggtgctcaccaccatgcccagctaattttttcattttttgtagagatgacgctcttgttacattgagcgggctggtttcaaactcctggcctcaagcaatcctcccaccttgcacagtaatcctaggattactatgcaacctcccaaagcactggaatgacaggtgtgaggcactgggcttgacccagcctttatctttaataatggattggtgctgtagtaagagaagagagagatgttttccaaaagccaccgagtcctcatcggttcacagatcagcaaacatattttcccaaagaaaaacatatggtccttgaatttcccagtaagttcgtaggagtatatttaaacaatcatgtagttgtactagtgaaatatgtttagtgtaactaaaatgctccagtaattattttaactaaaatcagattaattgaaaaagaataaaatttacaattatatacaactgcaaaagaattttaataatataggttactgtcccccaatctaaatgcactattgtgaattattaaaaatcacacatatacaaacacacagagttatgttaattaaaatattcctccaaaaacaaaaaaatttttccccctgctagcttagacaagtgtagggatggaactggaattggaatggtcaaggtccttagaggcaaacattttaaaagaggatcgacacctaatattttaactctgcaaaaacactcttaagagtctcacaattgccaataatgatgaaaatgatggtaacagtaaacacactagtacttacttggaacgaggcgctgtgataagcactttaaatacatgaacttacttaattctaaaaacattcctatgaggtaggtactattactagatgtatttaatagataagaaaagtgaggcaccaacaggttaaataatttgtgcctgaagtaagacaactactaaatggcagagccaggatttgaactttggcagtatgccttctaaatctaccctttatcaatatattgcaggatagggataaggcctggtgaagaacgaatcaattcccaacagcagtagaaatggggaaagagggcagcattgcatattacctcaagcttctctcttaccctaacatgaacctcagcgtgtcctaaacctcggtgctggtacactaaacatttagcagaaaagtcagaggaagtaactgatcctatcaacatggtttaagaaggtaagcatgaattcagctaactatcttttctttctccaataaacatcccatctgggtttcatctgactgctttaattcttcacatacggatggaagggaacaagattggggttatagcatgacagcatagtcaggtaaaggattcaggatgcagttcataaaactaaagagtaaggcccaggcctccaataactacctaatgaggattactatgcaaccaatggaatgagtggtcataactttcttggacaccagggcaatgcccatcatactggaaaaaagattctccatttcatccaatagacaagatctatttatagagccctgtcagtctaccaactaggaacttatatcactcagagactttctgttttgttttgctacgttttttaacttaaaggttttagaaaatgtttggcagtaacagttttattaaccaaaaaaaatctgctacaaatcacatgctggttaataaacaagcaaacgaaaaacactggtgggtctgggcacagtagctcatgcctgtaattctaacactttgggtggctgatgaggggaatataacttgaggtcaggagtttgagactatcttgggcaacaaagtgaaaccccatccctacaaaaaatacaacaattagccaggtgtgatggtgtgcccctgtgcccctgtattcccagctacccaggaggctgaggtgggaagatatcttgagcccaggagtttgaggccgcagtgagccaaaccactggaacactgggggaagtgacagattattaagatgaaaaggagtaagccaataatgaatctagaaagaaaatcttttcctagatagtttttaggggacttgaaataaaaaacaatttttttttctttttttggagacagggttttactctgttgtccaggctggagtgcagcagcataatcatggctcactgcagcctcaacctcttgggctcaagcaatcctcccacctcagcctctcaagtagctgggaccacaggcatgagccaccatgcctggtgaatttttaattttttgtagagacggtatctcactatgttccccatgctggtcttgaactcctggattcaagcaatcctcccgtcttagcctctcaaagtgctgagattacaggcatgagccaccatactgggtccagaataaattatctttaaagaaaagtagggtcataagccagagagaataaatacacatgtcattgataattagaggtatgaaactgtgggaaaagaattaacaagagtcatctaccatagagaaggaagcagctgcttgttccagtaatcccacaagtcctgactcagtaaagtattttccagagcagataccttcttcatctggagataccacatcatctgagaccgcagattcttctaaaacattagatgaaatattctagggaaaaaatatattgaaaaggtttttgaaacagaattttctagcataaaaatgtataagaagaaataactgaagatgaactgtaactatcaggttaggttaaaaaaaggagagtgatataaaggtaaaagataaatctctaaaaactttctgtattttgaagatgataataaaatgaaaacaccattgctagataacttttctcttaataaaaagttgtatgaaagaaaattaagaaaaatcatgggctaaaggaaattgtaatataacataagacatctaaggagacatcaatagtctttcttatttatttaattgatcttttcaaaactctctgtaaaggaaaaagggtacaaaaatggtctcttgacttatctaatgtacacggagttaatgaaaaaagtcaggtataataaaagccctcttattcaatgagattggaatcagccattatttctaaaaaagaaatgatacatacataccctattttattttaacctaaacatttacagtagatgtacactcattcatcaacttttgaagtagatctaaggccttttctttgtgtgtatgggtttccagatcagatttccacggaatctcttttgggtaaataccgataaggcaacactctttttaaagatttcaagttttggtttcttttgagtgaaaacttaaaagattatcaaattattctagaattttaggagtttcccctcccccaatctatttgtctggcccacagttaattcaacagcaattgttttggagattcacctttcctgagtctttgtaaaacattcaactttgttttccgagaaacgataactttctttttgcattctgatttcatcagaagatataacatttaactaaattttataatatctcaaacctactattaacaggttttgaagaaaagcaaagcataactgactcttggtaagcagagaattcaactagtgggtcagaattatgtaccctactagagggcaaactcatctgtgagtcatggtattagtcataaaataatctaatattttatgtagggaatagagaatgttggtatatctgctatgtgaagtaaaagccaattaagaatttctactgaattctgattatcagtaatacatttccatagatgttaaagtatgtaacggattacaaggcagtaaagacaaagagaataaataagcatagtgctgataattcagaggtaagaaactgtggaaagagaatcaacaagaagtactccttaaaaatgtattaatgacaatcactgtgaaatgttaattcaccttgtgaagcattggcttaagtctttaagctttccttataaactaaaaaaatctaaacaccagtgagaaaagctaaaaccaaaaaaagatataccttgatttaatgtacatctggaagattcctacctgaaatgttacacatcccacaggaagatatttccggtcctccagcatgctcaaatattcagcaacaagtgctgctgagtggactagacactgtgcagcttcagcatgattgcttcgttctgagtgcttgcctgccatgttctgcaaccaggtcaatcgcagatctggagaggtctggtaacccttggcaattctaattagaacagaaattcttctccattagtatgtgcttcccaagctgggagggagtttagatagctcgctcagagtttacctagaaaggtttttgatactgtgcacaacctacttagttttaaagtagtatgaaaatgtcgctatgcaggcctagagaaataactgtggcctatggaatggataatatcagttggtggggggggcaggaggggcaaaaaagaaatacgccatattaaattctgacttttaagaaaataaccagttaagggaaaaagtatggaaatttatgtgttcattacagaaacatagagaagttttatacacaagggaaaaagaaaacttctaaaaggtacttttattactttatttcaaagagattaaattgttttatttgtgcttttaatgaaccccaaaactgcaggaacagagggtcatatgacagagaaaaattcttaagttttactattgtatctattaaggtgttaatacaatacgatttatggagttttcaaaatgtgcccttagaaatatcattcttcagtcataactgtattgaaaatcaggtaattaatgttatcgtaaaacattcatatactgtattttcttctgaaaagactgagttttacactgaaaatattggtatgggccttcaaaggaactctggggcccaggacaccaaggtgttaaatgtgtgttatgaatacttaaaaaaatcctcgtttttgataatcaataagtacatttgcattgttcttaaaagaagagacacagaagatccaaagatgccacctggaaaaagtgcatttggactttcaatctaccattagaaaaatcactcaaggccaggtgcggtggctcacgtctgtaatcccagaactttgggaggccaagacaggcagatctcttgagcccaggagttcaagaccagcctgggcaatatggtaaaaccccatctctacaaaaaagtaaaaaataaaaataaaaacaataaagaatgtaaataaagaaaaatcacaaatcatttttgtgtgtttatttttttcatctaatgcttactgtatgtcttactaagtcccttatacaaagcataaatgaatcaaataaatgctacctgtacattagatcaatcaacatttcaggatcctcctggtgttccttcattttcacagtatcagaaagaatcatatggagattgaaaaccagatcctggacctgcagcagagaattatatgaaaaacattcttgaattgtcattcatccataatcaccaaattagtttcagagatatttcagataaatatctaaagatttcaaaacaagttgtaggatactgatatgattctgtacagtataggtatgtggggatatggtaagtgaagggtagtaaactttatataaattcctcagcagactatgtttatttttgttctttcacctggaaacaagcagaactgtaagtagaaataaaacagagggatatgggaaatacaagaatacaaaaggaaaattctctcctatatttctgattttactaaaaggtagtttgtagaaactttagtttttaaggcatattattgtttgattaataagtaggaacgtttcatcataaagctttgtctgcactgtccaagtctgctgttctacttattataaatgcacagaattaaacaccacagaattaattatttccaaaaagaagggtagcttaataaaacaaagagattcagtcctatctatggcacatgatgtgtggattgaaaatgaaataaatgatcctccagcaaaaatcaacttttgatttaacaatttggaaagtgcctatttaacaagcctatttcaattaatgatctagaaagcagcatttctgacctgatcaggaaatgttgtttccctcaattccagatcttcttcagcatatgtcaatatagtctttagagaacgtcttaagaattcttcattaaaattctgagatgtgcccaccaaggaggatagtgacattgttacctgcattttaaccctggcaaagttctgtaacagagaaattgtccagtcaatacttaatatagaaaagctttaaaaagtctgctatttttccttgctaaaagtatatttagtgaaaaaataccattctaagcaaaatattttttaaagtaataaaatatgcatatcaaaatcttattttagaaaggttgtaaaacttagaattttgttgtgaataatgtgctacaaaacaggattttaagaagtcatgtgttaagggttgaattagaaattctgcttatctctttacatttatttattatgggcatatgttattaatataacattttacagatgaggttaaatagcttgactgacattataaaattcttaaatggtagatggagtatttaaattctagtccatttcatgacatccatactatgatgaaagtaatttaacacacatcatgcataaagtaatgtaaggtagaatcttttggagtgatgcctttaacagtttataacttacattcttcctttttttagtgtaaattcatttctgctccaccattttctaccatgaaatcactctgaagagattattggtgataatatatcaattgtcaaatccaatattttttggtcaatattctactttacatctttgtatatttaaattactttcaccttgaaaatctcctaccttatcttcagtggcaccactttatcctggttttcctattctttttcgactctttttctattttattccttggttattcttcctaaataccagtattcccaaagattctgtcaaaaaccttttctcacttaacatactctaaagagcctcatccatgtctttgcttcaaccagtatatacacatgtttctgtctccagctgatatttgtctgtagaactccaggctactatattttactagatagcaccatctggatgtctcataggtaccacaaagtcaacatgtctaaaataccttctctccctattgattatctaaaaaagtgatactattcttgtagtcatgccaaaaatctaggggtcacccctactcatcctcccctctcatttttcataccataaatccaaatccacaccatctcctaatgtgttccaatatatcctttctccattccaaatggctttgctttattttacaccctcaccatttcttatttggattactgtaataacttcctaatcaatctccatgcctttttctttcatatctctcagtctaacctctacctagcaccacggaactttttgtaaaatgcagatctgaacatgttcctcctctccttaaaatgctcctaaggcagctgtccaaagttttgaggataaaattaaagaattcaactcagtaaatatgtcacactacatagtaggcactgagagtatagtgataaaataattcatagttggctaggccttttcaattacacctttatcccttactctttcttccagccataaccatcaaaaagtgcttttaaaaaaaaaagggggctgggcatggtggctcacatctgtaatcccagcagtttgggaggccaagacaggaggttcactgaggcccaaagtttgagaccggcatgtctacgaaattttttttttttaattagctagatgtagtggtacatgcgtgtagtcccagctacttgggaggctgagtggaaggatcccttgagcaaaggagttcaaagctgtgccactgctctttagtctgggcaacagagtaagacctcatctcccaaaatttaaaaaaagtgctaaaaaactgtctttgtgtttgcccatttccttctttcatctccatccctttctaattatgtatgtgtcattatctttacctaaaaagctctatccatttagccatctgattgggtaattcttcattcttacttcaaacatctcttctttctgaaaacccatccctgaatcataagctatttttctatgtgcttatgaagtaccctgtgcttatctcgcattatattaacaacaccaagtacttatttagcacttgcttagtgccatctactgctatgttttacttaatattaatttatgtaacacttacaaaaccatctgaactagattcatctgttattaaatgaacatcactttctaatcctcttctcccactaggtgccaagctacttgaaaaaaaaaaacaaaaaactgtccttttatctatgtctgcccaatgcctaccaaagcagccaagacacagttccatattttactatgttgtacaatatacagacataatactgcatctgttgaataaacatatatatcactgccagttttaaattacccatttctttcttttttttttttgagacagagtcttactctgtcacccaggctggagtgaagtggcgtgatcttggttcaccacaatctctgccttctgggttcaagcaattctcctgcctcagcctcccaagtagctgggattacaggcgcccgccaccatgcttggctaatttttatatttttagtagagacaaggtttcaccatgttggccaggctggtcttgaactcctgacctcaggtgatccacctgcctcggcctcccaaagtgctgggattacaggcgtgagccactgcgtccagccacctattcctttttggaaacactgcctgatactaatactataaattgtcctttcttcttttatataaagcttttccaaaataacagaaacatgtatcaagaaaactgagtgtggtcaaattttagagactttatttcataaacaaagtaagatcaataaagtaaccatattcttctattctgggttaagacagaagacttcccttccagtaaaaaaaggacagtatgagatagcaatttcccacttctggatttcatgtaaaaataaaagatgggggaatagaaaaaaccccacaaactctatctttatcaaaatgaggagtcagatataattcatttattagaaaaatgggaggttgccaacacaagctaagttaggaagcagttccaatataaggcaaggaaaggaaagcaaagagtgaggaatcctagggcacagattttagaactaatgagggaaacaaatatttcctctaagtaagaaacttagcccggtgtgatagtagctcacatctgaaatcccagcactttgggaggccaagacaggagagctgcttgaggcaaggatttcaagaccagcctaggcaacagagacagatcctgtttctacaagaaaaaaaaaaattagccaggcatgacatggtggtgtgtgcctatagccccagctacttgggaggctgaggtgggaggatccctttagcccaggagttttgaggctgcaatgagctatgactgcaccactgcactccagcctgggtaacagagcaagaccctgtctctaaaaaataaataaataaatacacaagaaacccatcttgaagttgtaaaactgttctgaaaaaaaaaaaatgagctaaaaatctggtaaaattggacagagatggatcatccagaaagtttaggcagttaggcaagatgtgcctgcaatagcaaaatcccagccaaaacacatttctgaaggaactccctataaatgcttgggccaagataacccagcttatcctatgttgagtagtaaaaaggtaaggaagagcagcaaaactcaccagataaagaatacttaatagacaaatgatgtcataaaacagacgaaaattctaatgaaatattttgatttaaattatacaaaatttatgaagacatctttagaataaaaaaggcagaaatacaagaagtcaaggaaagatggcaaaaatcagaaaacaataacatataatcaattacatgtgagctggcaaaagaaatttttttacttggaaaagtaagaaaaaaacagaaatgaagatgaaattttaaaagtgttaaaaaggagaagacaaaatgataggtaaagtaaaagttccaacatatgtataatgaacccagcacagaaaccccaaacacaggaacaaaacaagtattttatattcaagaaaattttctgaaataaatgaactaaaagtacacatcatgtacctgagaaacttaacacaaatcagtcaatactaagacaaatattctagaaaagtcatttaattataaatataaagaaaatctcatgagcagctgggggaaaaatgttatttaaaacggagaaaaatacctttcaatatatctacaacaatatttaatgtcagaagacaatggtactcaagtaccctttttttcctatgaggtgttctttatctgataagttttgctgatttttctcgtgcttattattattcaaagtataaggcaaagatttcataaccacccttgctgtcctacaagtacagacaactttaaacaatcaagaacttggaaaactggctgggtgcaatggttactgcctgtaatcccaacactctgggtggacaaggtgggagaacagcttgagcccaggagttctgggctacagtgaagtaccatcatgccactgcagtctagcctgggtgacaggaggaaacgctgtctctatttttaaaagggggggtgagtggggtgggcagggcgaggtggctcatacctgcagtcccagcactttggaaggccgtgcagggaggactgcctgagcctacgagttcaagaccagactgggcaacaaagtgagttcctgtctcgactaaaacaaacaaaaaaacacttggagaatattactcctaagaaccttgatgaggacaatatttagctaaataaaagataattacagccctaaaaaactggtggtaagcaatatttcattttacaactaagactacaaactaagactgaaatgttacagctaagaaaaacactaggagggtgagaaaggagatagaaagaagtacttaactatctacagtagacataaaacaaataatattatttgaaggtggcaattaaatcaagtgaagtatatgcagattcaacaatacagatgtaaacagtaagaaagataattttttgaaatattgaggtacaaagaatgacagggtggaggagagaaaagaaaatcagcaattttatcactgttcattaaagggagttaatagatacttgtctcaagtagagtttctcaatatttttttcattattgtccccctaataaatctttttgaacattttttctaattacatccctatgatattttaatatcagagatgtatacatctgtttatgcactctatgtatttctggatttatatacacgtaagaaagtaaatataaagcttactctttttacttgatgcaaggttatgaatgactagataaaaattttaagttaaaaatctgaaaatgatttacatttagcttatgtttataggctggttttctgaaaaacttttaatataatcttttagcttaaataaactataatgtatcaaattacacaaataaattagcaacttatataactacaaaacaaaagcagcaatgtaatcaattttttaaaccattcaaaactgctatttattcagcaaaagaaaggaattaaaaattaatttcttaaaaattatttcagtgaactttcactatttgcttgatagaaggaaataagttctggctactagatattcattcagatattgttgactttttttattttcagcaaatgacatgattaaaaatgggttgaataacttttgtagaatgaactaataaattggaaagtttttttcttgggcttaattttcaaagcccaagtcacacacgaatgcactgagaaccaaacataaacaatatccacaaggcagccaatggaagcaacctcttgccatatgactgagatcaagcaattgattaaaagtctccctatcacagtcatctattctccagttttataagcccaatttcgcatacattttgttttttgtttatcttccatgaacttaatgtcaatgctgctcatgtgatatccaataagaccaatgagacaaataaatactaaggaatgccatgttgttgggtagtgttgagctttggaggaccataagctaagatttttctcatcctccacaaaaacgaattttcactcccttggtggtaattactgccctggttgagaatgcatgatctaaagaaatagagtactaggggtattacataactataaaggcaaccattagagcaaaaccagaaattttgctaaatatgataaacactacatccccaaaacaaggtaaacagaccatatagtgtaagatgaaaacaaccaacacaattttttttaaaggggaggcaagagggaaaggcataacaaaataatagaattccaggacgtatgtaatataataacaagtatgaaaggtttaattcaattagaggttggatcacaaagcaaaactcaactcttatgttgtatatgagaggcacatctaaaataaagtgaaaattaaagaacaggcaaaggcaattaaattaagttcaaattaaaaagaaagcagaggtcaaaatcttaataccataagagatgaaattcaggccaaaaaataaaatagaataaaggttttaagtaaaaccaagacgagttcttttaaattccaaaggagaaaaactcttaagaagatacagtagttatgagtattagtacaccaaataaaagctaaaggagaaacagacaaacacagtaataggctttaatttacttctaccaagtgaaacaaaaacaaggatatagagagacacaataatgtaattaataaggtgtatttatctagtatatgtttaactcaatattctgaaaacagaactacttcctttttaaagtttttttgtagaacactcataaaaatggattatatttagacacacaaatacacagatccacagtaaagaaagggagaaacagaatacacattgtacaatcacaatgtaataaagctgaaaattaacataaacaattttttttttttttgagacaggatctcactctgtcactcaggctggagtacagtggtgtgttcatagctcactgcgacctcacactcctgggctcaaagggatcctcccatctcagcctcccgagtagctgcgaccacaggcacaggccaccaagcccggctagtattatttatttttttgtagagatagggttttactatgtcactcaggctggcctcaaactcctggcctcaagcaatcttccttcctcggccacccaaagtgttgggattacacgtgtgagccactggagccagccaaaactttgaaacaaaaaggctagcagccaggcgcggtggctcactcctgtaatcccagcactttgggaggccgaggcaggcggatcacgaggtcaggagatcgagaccatcctggctaacatggtgaaaccccgtctctactaaaagtacaaaaaattagctgggcgtggtggcgggcacctgtaatcccagctacttgggaggctgaggcaggagaatggcgtgaacccaggaggcggagcttgcagtgagccaagatcacgccactgcactccagcctgggcgactgagtgagactccgtctcaaaaaaaaaaaaaaaataaggctagtcaactctttgggttaaaaagaaaacacaaactgaaatgacaacattactaaatatcagaaccaaggagacgccaaaaatagcacttaaaggaaaattcaaggccttaaatacttacataagcaaaaataaatgaactaaatatttgactcaaaaaggaaaaatataacacatgaatataacatataataaaagacaaatgaaaaaatggaattcttcaaaggctgtgacatgtaattgtaaaatatcaagccaagatacttaaacttgtatttctttttacttagggacaattaaaatttaaaactgctcaatgtacatttatattctaagtctgtattaatatacatacatacatacatacgtacacatgatatgcacacaattggagatttggatttttgtaagatatacacagaatgagaaatatcaagatagcctatgattagactaaaaatatacaaaaaactccatgctctcccaaaaactgatttaataactatcagcagaagttatatttcattatgaatacagagaattttcatgataaaatacttacattcccaatctcaaagttttgcctcattagtaggtaaagggaggcactggcgtgtgaccgtattgtaccgatgctactgctacagtgtcggagaagcctgaggcataaatcagcacactgctctgtctcttcttcaaataagagttcaggaaactgtaaaacaacaaaacaaaccaccactgaatttttacagtaaaagtttctgagatatgttaatataacctgaactggagacttgttagtatagcccagaaattaaaagaatggttaggacaatattagctaatggttaatagtgtgagacacagagtcaaactgggttcgaatgctcattattccacttactaactagtagtgggaccttggacaagttttctcatccacaaaataggcctaataatatatctacaagggattgttgtgaagcttctatcagaatgtgcataaaacacttagtaatcaacatatatgaattctatatttattacaaaataatacgtaagttattttcatcaacatctctgcattccatcctctaggatgattaaaatgaaatagctaccttcaaaatttaagaatatacatatttctaagggaaaacaaatataagaagtaaacatttaaagcagttgaacaaacacataccttcttttccattcatcataaaataatttcagtgggttgaattgcttatatattgaattctttataaattgagttttttataaaaacagaaccaagtgaagagaaaacaagagaagccccatatttaagattggctattaatttcaggcccttctccacatccaagttactgtttttcaaaccagaactggttaaaggtgattcgaataaatgaaaaattctaaaaggcaggcagcagtagagaggcaaagaagaattaagggtcttaggttattatttaaattttaactacacatattcattaatatattactacatatattaaccaatgaatgtgtcaaatgatcttagacaatgttaataaaaaaaacaaagtctgacaacactgcaggtacaaaataacctacctttgaaaccaaggctctctgtgtagcaaaacagtgttgtagataaactgcactttggttacaggccatgctgtgtagtagcacttttagcactccaccaagaatgctctctttggattccgttacagaaacggtctgcaatttaaaaataaacaaataaaatagagatgtacttgcaatttagttatggatgttacaggcctccctatgtataaataaaggcctccctgtatgtataagtaaagttttaaaagataaaaaaatgataacataagatctaggatggcttcaagaaggagctaagcaggatttgaataagaaaagggggaaaaagaataaatataatttaaatgagaaaaaacaggagtaagatacaatggcaagaaatcataaggtgtgttttaggaaaattagtaagtaaatttgaattgacttgaggttcatgtagaaaataactagagataaggctgaaaaattgagtggtgcctagagcaaaaaatgttggtggtacacaaataaccattcttttcttctttaataattgaaatcctgaattttagctgaagactttgaatccggctacagagagaggtgaacaaaagagaagttacatcttctgagtcatgcccttaaaaaaagaaatgtactctgtccctgctgtttcttttcactgaatgaaatacagacatgatggccgcagctcaagcaaccatcttgggatcagttatcttggacttattaaattttttctatttttaaaactttagtcaggataatgactgataaaatctttttttttttgtttttgagatggagtctcactctgtcacccaggctgaagtgcagtggcttgatcttggctcactgcaacctccgcctcctggcttcaagcaattcttgtgcctcagcctcctgagtagctaggattacaggtgtgcgccaccacacccagctaatttttttatttttagtagagtcagggttggctgggtgcagtggctcacgcctgtaatccccacactttgggaggctgaggtgggtggatcacctgaggtcaggagttcgagaccagcctaaccaacgtggagaaaccctgtctctactaaaaatacacaatcagctgggcgtggtggcgcatgcctgtaatcccagctacttgggaggctgaggcaggagaatcacttgaacccgggaggcggaggttgtggtgagctgagattgcgccactgcactccagcctgggcaacaagagcgaaactccacctcaaaaataaataaataaataaataaataaataaataaaatagagtagagtcagggttttgccatgttgactaggctggtcttgaactcctgacttgaagtgatccacccacctcagcttcccaaattgctgggattacaggcatgagccaccgtgcccagccataaaatacttttaaaggaaaattctcacaacaatgtacagaatggatggtgggaagaatacagagtgagttatgaagtaggtggccattgtaatagcgtggaaatatgaacctggcagagtagtggtagtagaaaaggaatggaaggaataggtgagagatatatttactaaaacatctgaaagatcttgctaactgatttgaatcctggctcttctacatactagctgcgtcattatgggcagttatttaacatctttgtgcctaagtgttctcatctacaagatgaggatactgacagtttcaatgtcatgagtttcttagaaggatcaaatgagttaatatttgtaaagtgcttaggacaatgtttaacacagaaaaaactaaataaatgtcagctatcacattgttactacagaatactgcccagagggcaactgttaggacccaacacaatgattatagataaaaagcctgaaacattgctgtggtatacagaggatactgcataaacccagtttatctatatgtagctatagctatacatgcatgttgaatctcacctgatggcagaacttccacctataaatactcagaggatatttggaaatgcaagactaggccatcaaggggaaagacaaggagataaagatttcataatcatcctccatgaagaaacagttgaagctatgggaatttataattacagagaatctcagaatgcttggaacgaaacttttaggaactaccaatatttaataaaatgtaattttatggctcacagtaaacacttttccctccaacctcaatttaccaaatccgtattttaaatttctcttctttgcattcttacctgaacaacaatctctaatgtatctaaaatgattaggtttgcttctgtagccaggtttccatcaatcagtgcttcgtgttcaatctctgctcttgatctaatacaaaatattgtaagaaattatatttatctttttgaaaactacaattctgaaaagacttaaggatgcatagaaataaaaaatttcaaaccattttcaatatttgcctgataaaaaattacaagagaataagaaaaaaggcagtagtttacacatttatgcagcttttttgttaaccacaacaatacacactttctcaccccattacagaagtgtaatgccactaaaagcataaatgtttatgttttagctttcaaacatgcagcagacagttttattctaagtgacactgacactaggtggtgctatgtgggcttgtatttaggactgcttcatggaaaacaacattcaaatatttagtattcatcttactatttcaaatatttccaatgtctgtattcaggataaatgtacttaatttgtctaaggtttcatctaattttcccccaattttttttatataaatatgctcagatgataatttaactcttcagtgagactagatggaattactcattggaaacacaacaaatttggggaaaaaaggatgtgaggtgacgaatatgctagttagcttgcctgtggtaatcatttcacaattgtacacatatattaaaagatcatgttatattctgtaaatatatacaattttgtcaattataactcaataaagctagaaaaataataaagaaaaaagaacaaaacagtttgatgcaataaagtggtttacttaaatactaatatttgtaaaagtatcatttaatgcaaataaaaatgtaagaataattacacatgatttatgaatatagttgagatttttgttttagcaataatagatatacagatactatatattacaccaaagtagacaaaataacacataaagtacaaggccatattaaacactaacttttctaagtttttagatctgtaagtctgtgagtctttattattaccactaaagagaatacttcattaatttacagtttacaaattcaatttaagaataaaagcactttgaaaggctgaggtaggggatccttgagaccaggagttaagagaccagcctgcacaacatggcaaaaccctgtctctacaaaaattatttgggcgtggtggtgcacagctataatcccagctacttgggaggctgaggtgggaggctcacctaagcccaggaggtcaaggctgcagtgagtcatgattgtgccactgcactttggcctgagtgacagagtgagatcttgtctcaaaaaaaaaaaaaaaaaagaatacaattatcaaaattaaactggaaaataaaatatttaatgttcaaacttaaaatttccagtgacattttataaagaaacataagatggtttaaacaaaaagaatcaggagaacaccaaaaaagtctccctcaaaacacagcaagataagccaagagaacacattctacaaatgcagaaataaagcactactatactgatagtacagtacctggctactctgtgatttctaaaaaataacacatgtagaaaaaccatcagagaaatagatttggacagacggagaaaaagaaaggaaagcacacattccaaggttaagaattttaatatatttatattacattcaatatctgattatttcaagctctcatacatatggtactgaaacttgtttctctgctggctctcacttgtttcctctgttttatgattttactgtctgtgagaaaatattgtgaaagtttatttgtgagaatcttctgaggcttgggctgatgatggttctcagatagggtaatcaatcatcttggtttgccttaggacaggactaaagggctccctgggatgtgggacaatcagtgctataactgggagagtgctaggcaaacctgaaatgagttggtcactccattctcaaagttttatgggccagtgaagctacttgcgggctaacttataattagaaattctcaagaaaaaaattttagccccttgactcagtgccaaatctcaagccagaaaagtttacctgcagccacttgggcagtaagaagattcatgtaagtgtattgtaggtgtttatggcagtaggatcagtcaatgtatcaagtctgcctttatgctagaaacagaagacctgtattgttttgtctttcttgaattatattataagctccataacgacaaatgtcaggtttctgattctttgtaatatttgaaatattagttcaatgtgacacctaaaatatgttcaaaaaatagttgctgaatgcattttccaagaggatgttttaaagaaaatggagtttaaaatataatattttgccttactataccacgagaagttcttcctccaaatctttttaaatctaaaatttttaaattaaatattttgttctctaagacttaatatatttattaagtgtaaatactaaatgtaaatataaagtaaaagttatcattttcctcttacattttaaaattcaacacacccatcagtaacataaaatagaaagctgtattacttgtcaagcttctctgtgttttgacgccagtgagtcatatctttcctccacctcaaattttcttgacttccaaaggcacttccagatgggcttctctctgtcaaataaatttcaaaaccaattttcaaatgttatttcagttggaccacatatatgtatacttgcaatcatgtaagaaatatacaacaataatttgtacaagccattttatcctcagtacaagttgaaaaacctgacaatggtgctttttattaaaaattttcacaataatttcagaagaaatgtacttgctatatgcagtatcttttctttaaaacaatacccacttaaataagcaaatgttctaacattggtttgcttaaaatcttaaccatggcttataaggccttacatgatatgactttatttcctaccattcttcctcttgcttaccgctttctgttatccttgcgaatctatcagtatatactctgactacgcttctgacttacaacctgtgcaatggttgttgttcctttttcctaattgttcttctcacaaattttcctttatcgcctccttagaaaggcctcccactctccaatacctccttttccttttcttttgctttgttcctttccataacacttaggaccacaagtatataagctccttaagaacagaaatgatatgtactttgtccaagcatgttatgtctaggctgataaagtggtttctaggtttgaaggcagactgcatgtatgggttcctttaaggggtggcagcaatagaaatgattcatacaaatccattaggagtggagacagcattgagaatgtggagaatacacaaatatacatttaaacaatggactcagtcataatttcaaactttcaactataaaactgcttgtttttggaaaaggtaagactttaaattggttaagaggatgaagaataatgaaagtaaatgttcagagttcaaatataaatttttaaaaatactgaaaaacaaatacaaaagaatacaactatacatatgtcaattaaagaaatacaaaaaatactgagaaataagaatcatttcctgtacaataaaggacatggctctatttcttctaatttctttcccttttctttcctttctttccttatctctttctcttttttaaattctgaaatccatgtctttaggaaatttatggaaaaaaacaaaaagatatgcctatattaagatagttagcaaaattaactataatattctatcatttacattttttcccacgaaactctcaatagttaataatgtcttagaactgaaagttaagaaaaagaaaacaatgtctattagtagacctaataagccaatgtctattattgacctagcttaaatgtagaaatgtaaataagaattacaagacaagtaagaattacaagaattataagacaagaagacttcaattgttatattcaaacaaacccaaaagtacactgtaaattgtatataactaaagtgaaaaaatggtgctctattaatttttttaaaggcaaagactgtgccttttcattattacaaaacatagtatataaatgatacttagattattattatgctaatgaactgtcagaaaacaattaaaaatccattcacacttacattcatattttaagtcaacaaataaatattgtgctgttggcatgtatcatctacacagatgaccaacccatggccctggccttaagaaactcttagcaacagtattgtctgtatgtcactttagaatttacaaaacgtttctgcatgcatggttactataaagatgataagatcagttagttacactatcttctaaattctgaaaacaatcacaaatttataaggaaaaggaagatggggagattaagtgacttggccaaggttatttggctaatgggtagcagacctgggattagaaaaccagtctcaaatgctactaaactgttttgtctcactgatatttgagtttgatgggcaatatttttgccttatatacagggcatattaattcattttgcaaataaagagtaaaaacaggccagacgtggtggctcacagaactgtgagaggccaaggtgggaggatcacttgagctcaggaatttcaagactagcctgggcaatacagtgagaccatgtttaaaaaaaaaaaaaaattacttgggcatggtggcacacacctgtagtcccagctaccagggtaggtgtgtattgggggatgaaggtgtaaaaattgcttgggcgagggaggtcaatgctgcagtaagccacaatcacacgactgcactccagcttgggtgacagagcgagaatctgtctcaactaaaaaaaaaaagtaaaaatagatgttatatggaatgatccctaatgtaaactgcggactctgggtgatgatgtgttaatgtaggttcaccagttacaacaaatgcactactctgatgggggatgttaataatgggggaggctacgcatactaaggggtatatgggaaatctctgtacctttgctcacttttgctgtgaacttaaaactgctctacaaaaataaagtctatttaaaaagggaggatggatgctattaatcacataaggactttctagagaaagttttctagagaggactttctagagaacgttttctagagaagactttctagagaaaacgggggggggggggcggtatgctgactcacctaaatcagaattctaacttttattactgcagagaaatgattattcaagttaattcacagttacacttaaaacactttttaaaaagcataggattgacattgaagactagcaacaatgatcattacaatatacaactcaaggaaattgaagaaattctcaccaggaggagaagctattgtgtacgtaccgagctgtcctcggcttcgccgtaccatttcttgcctggcacctatgctcccaagaatagcttcttcaagctttgctctcatgtcttttgatttcttaaaggtcaagctattcattcgttcaaacacttttttcccctaaaatgtaaacattagaagagaagaggtattgaggaaattttcttctattttttccacattatgtttctcctttcttgttctttgcaatggtacaatgaccacttactttatactcaaagcaagacacacagagataaagcagatctaatagccggtttagctgcaagactgagagatctgtaaaccacttctgtagaactgtttcatctgcatttttgagaacccaaagtagacagatcaaaaggcttcgacttgattctgctgaaaaggtagtgtgttgcctgccactctgaaaataaagagcagtagaatgagacagattgatcaaagaccatttcttgttttttggctatcaactgttttcttctaaaaacaataaaacaaaagttgcttaaaaataatataattaaaaaccatttgattcagacaacacttgtacaaaaggatcatatataaccttaaggttaagagcctgaagtttaatgaacctttcctgataacagaagtttgttttaatctactgcatgactgccagcaggggataaataaatgttaataaaaaacataaagataaaaactaaaagattctaccattaaaaactaaaagatatatatcacagaatatcagatataatgaaaataaaggaaaaaagcaactgactcacagtaaataagagtgggctaagagtagaaagtaatgacaaaatcatgtatgtcagacttagaagactattgtttttaatcaagcaccactgatacaaaaaggaaaagtcttaggctatatagaagtaaaaagctatttctacttatagcatataaggttgaaatgctattttcaatcatcaatctatattagtatatagtatgtaaaacagaaatgaaaaaataaaaacacatttacagtaccacttattggacatacactctgtttcagtcatcatactaaacattttacatacattatttgatttagtcctccaacagtattgccaagcaggtcgtatcatcccaattttacagataaaaatacagatgataataataataataatgatgatggcaaaaaataaaatttgaaatgtgcaagaaactatgctaatcatgttttatttagctctcacaacaactgtaaactataacattaactattattattattagtttacaggcaagaaaactgaaggctagagagtaatttgccttactataccaagaaagggtaaagctaggattttagtctaggttaaccagactccaaagcccatactcttcactattatacaatgttctaatactcggctgacaaatatactaactaaaaatgaggaagaagtagaggggatgttgagaggaaagacataggaaagctgaacatacacaactgttgaagtcatgatctcaactacctcaccaatcttccttctatagtggatgataattaatgaccaaatgctttatgtgtattaagttatttatccttcacaatcactcaaagaaataagtattattactcacctcatcttacagaaaaaaaaaaaaaaaaacctgaccaccagaagtattttgtaataagaggcgggacaacagtttcaacacagaaagtgtggctcccgagacacaagctccaagctcatatccactttgtttactgcctctcatggctgcccatgcatataagtgaattcacccacataagcttgcttaactattttgctatactgcttctgagctgggcacaaaagaactttgaccctgatccctaaatccacaattgttctcataaggaaaatgctcctttattttaaagacagacactttttatagccgaactttcagatatgcataaatacacagcactgactgaattttcaagtacctattttttagaaatacaataaaaaattattctcatcttgacaaacaggcatatgctgacatctcttatattcccacataaattgccagtaacacagtgacatctctgggaagaattaagacaaacatgaaaaagactcagtaatgtaaagatgtcagttttccatcaaattgttctataggatcagtgcaattctaatcaaaatcccagtcaggttttcctggaactttgaccaatgatttttaaatttaatgggggaaaagcagagagccaagatactcttgaagaagaacaaggtgggatgtggggagcagggagatgaatgtgttctgccagatatctgcagttactaaaaaactaaaataattaggacaatttgattttggcatatttttggcagtcaaatgaaacagaataaagaacacaaaaagtgtcctatgcatatctgaaaatctgatctgtgacagagctggcactgtggatcactactgaaaggatgaactgtttaataaatgatgttgagacaactgatcttccttgaggaaaaaaaaagcagattcctaccttgtaccaccatacagaaaataaatctagacaaagaaagaactttaaatacaaaatgtttaaaactttcaggaggaaatataagacaatatatttataatcttggggaaaggatagtatatcttaaataagacataaaaaacataaaccataaaaaagatggtcacatttgcctacattaaaaatgagaatttgtattcattcaaataaatacattaaaaaggcacatcataaattagtagaaatgtgcacatataaaaccaacctgagattagtatccagaacagtctcaaccagggttccgtggcataattaagccctacaaaaaaggatttgagggactattttccccattctcccaaagacattgatagcaaggaccactctaggtgtatagaagttaatctatcacctacaataaatgccctagcccattagttcttaattttctggttgagaagggatgacctctagaaaacagaaagaattgtttcataacattattaccaggaatgaggaagaggtcccagagttctacattttctaggccaagattcatacctctccttcatattataacaaccagagcttcacgattactctctgccttcagaccatcaggattaacctcattaaattattttccccagtttgtgtctaccacctcaacaggcccagccttcagaaggcttcattcatgactcggactctgatcaccacacacatagctctttatattgtctcttcttacctcacttgccatgtctgccccttctcctaaaattcttccactatgacctctgaaacacatggtcaatcattaacaaaactgctttatatctataagaatacatagcttatgttctcatagatgtataagaacacatgtatctttgtcagactatacaacctactaaccttcatcactgcagtcatatactaatctccagaagactggcccttatatcttgatgcttttagctcctgactcactttcactattttaaacactactttttgtcacagttcttagtgatttcaatgtctatgtatttgattctctaaatatcctgtgctattttttacttccttaaccaacttgtctaattctcaagaataccacttactacacacactcacccttgcagtcaaaccttatgccttttattaccattatggcatgttcccctaaatttccattttaggtatgtcccaccatgccaattaaaaaacaaaaacaaaacaaacaaacaaaaaaacaaacaggccgggcgcagtggctcacgcctgtatcccagcacttcaggaggctgaggcgggtggatcacctgaagtcaggagttcgagatcagccggaccaaaatggagaaaccccgtctctattaaaaatacaaaattagctgggcgtggtggtgcatgcctgtattcccagctactcaggaggttgaggcaggagaattgcttgaacccgggagatggaggttgcagtgagccgagattgcgccattgcactccagcctgggcaacaagagtgaaactctgtctcaaaaaacaacaacaaaaaaaccacctccattttaatgatctctcttcacaaccaccacttcaactttccatctcattacttcttataaatcaactccaacaacacacacaatatcaagtattagaaagaacatggagcaacaaatatttcttcattgctagaaggaatatatattgctagaaccacactggaaaacaatctaaccaagtaaaactgaacatgtgcataacctctaacccaaaaatgccactcttaggtatataccttagcgaaactcttctacagagtgacgtaaaggaacattcataatacctttatctgtaacagcccgaaactacaaacaacccaaacttcctttgagaagagaatgaatacataattatattttctaacggactgctatgacattacagactacaactatacatatcaacataaatgactcttacaaacatatacaaaaaaatcaagtcatagaagtacacatagtatatattcataaaaaggtgaaaatatgtgaagctaaataaaatattgtttagaaatatagacaaaactggctggatgtggtggctcatgcctgtaatcccagcactttgggaggctgagtcaggtaaatcacttgaggccaggagttcaagatcagcctggccaacatagtgcaactcatctctactaaaaatacaaaaaaattggtccggcgtggtggctcacgcctgtaatcccagcactttgggaggttgaggtgggtggatcacgaggtcaggagattgagactatcctggctaacatggtgaaaccctgtgtctactaaaaaaatacaaaaaagttagccaggcgtggtggcgggcgcctgtagtcccagctactcaggaggcagaggcaggagaatggcgtgaacccaggaggcagagcttgcagtgagccgagattgcgccactgcactccagcctgggtgacagagtgagactccatctcaaaaaaaaaaaaaaaaattagccaggcgcagtggcagtcacctgtaatcccagctactcaggaggctgaggtgggagaatcacttgaacctgggaggcagagcctgcagttagccaagactgcaccactgcactccagcctgggtgacagagcaagaccctttctcaacaacagcaacaacaacaagaagtcaataaaagagagaaaaaaaaaactataatggggtaagacaatataaagtaaaacataaaatgttaaatacatccaatttaattaaactaaatgtaaatggattagaaactctagtgaaagagagagattaacaaaccagatttttaagatacaagaaaaaaatctaactatatgctgtttttaaaagaagtatctaaaacataatacaaaaatgttgaaagggatgaaaaagtcatgctatacacacacacacacacacacacacacagagcaaagaaaacctagtgtaattataactactttaaaaagcatcatagttcatgtagatgaaagtgcaatccaccaaaaattatataaaagtgttaaatgtttcataatcaggcctcaaaagaaacaaaaatctgacagaatgacaaggagaaattacaaaaccacaattgtagtgggatattagaataagcatgcaaaatttagtaaagaccaaaaagatttaaacaacaagagtacaggacatagaatgctgtaactaacaatgaaagaatattcattcttttagaatacatgagatatttacaaaaactgaccatatactagaccataaaactagtttccacaaacataacaaactgatatcatacagagttatgctctctgatcatttaatttggccaaaatcagaaacaaggatatctagaaattttcatgactgaaaatttaagacaaaaacaacttcttaaatagctcaaaggcctaagaagaaatcataatgaacttcagagtcattctgagatgaatcttgaaaatgctacctattgattatgataaacttgttcccccagctcacaatttagaagtcacagatgacagaagggagaatgtagtaggcaatgtgatcctagaggcgatgagaagggatgactaactggctaaaagagagagagaagatgaaaccatttggggaagatgtaagagaatgcaactaagttgaataaataagatacacattttttaaaaaaaatgcctgtatagccaagacaatgagcaaaaagaacaaagctggaggcatcacactacctgacttcaaactatactacaaggctacagtaaccaaaacagcaggtactggtaccaaaacagatacatagaccaagggaacagaacagaggcctcagaaataacaccacacatctacaaccatctgatctttgacaaacctgacaaaaacaatcaatggggaaaggattccctatttaataaatggtgttcggaaccgcctagccatatgcagaaaactgaaactggatcccttccttataccttatacaaaaattaactcgagatggattgaagacttaaacgtaagacctaaaaccataaaaacccttgaagaaaacctaggcaataccattcaggacataggcatgggcaaacacttcatgactaaaacaccaaaagcaatggcaacaaaagccaaaattgacaaatgggatctaatcaaactaaagagcttctgcacaacaaatgaaactatcatcagagtgaacaggcaacctatagaatgggagaaaaattttgcaatctatccaactgacaaagggctaatatccagaatctacaaagaactcaaacaaatttacaaggaaaaaacaaccccaccaaaaagtgggcaaaggatatgaacagacacttctcaaaagaagacatttatgaggccaacaaacatatgaaaaaaagctcatcatcactggtcattacagaaatgcaaatcaaaaccacaatgagataccataccatctcacaccagttagagtggcgatcattaaaaagtcaggaaacaacagatgctggaaaggatgtggagaaataggaacgcttttacactgttggtgggagtgtaaattagttcaaccattgtggaagacagtgtgctgattcctgaaggatctagaactagaaataccatttgacccagcaattccattactgggtatatacccaaaggattataaatcattctactataaagacacatgcacctgtatgtttactgtggcactattcacagtagcaaagacttagaaacaatcccaatgcccatcaatgataggctggataaagaaaatgtggcacatacacaccatggaatactatgcagccataaaaaggatgagttcatgtcctttgcagggacatggatgaagctggaaaccatcattctcagcaaactaacacaggaacagaaaaccaaacaccacatgttctcactcataggtgggagtcgaacaatgagaacacatgaacacaggaaggggaacatcacacactggggcctgtcagggggtaggggggtaggggagggacagcattaggagaaatacctaatgtaattgatgggttgaggggtgcagcaaaccaccacggcatgtgtatacctatgtaacaaacctgcacattctgcacatgtatcccagaacttaaagtataatttaaaaaaagggaaaaaaatgttacatataaacagcatttaactaaacaatcaaagaaaaatgcataggctgaaaatacatatcaaaaaagaaaggatgaaaattagtgagttaagcatctatctcaagaagttagaaaaagaacatgaatgtaaacccaaagaaagcagaagatagtaaataataaactttaaaaagtgagggtcaacagtgccaccatactggttctttataaagactaacaatacatttcgactgtctggtaagactgataaagacaagaaaaggtacaaaaatctagccgtagaaaaaagtttacatctactacagatgatacagacatttaaaaaattatacaaggtatttttgaataactttataagtcaagaaatttgaatacatttctactagaataaaatttacaaaaatcagttgttaagaagaccaggtgcagtggttcacacctgtaatcccagcactttgggagactgaggcggggggatcacctgaggtcaggagttcaagactagtctggccaacgtagtgaaaccctgtctctactaaaaatacaaacattagtcaggcacagtggcaggcacctgtaattccagctattcaggaggccaaggcaggagaatggcttgaagccaggaggcggaggttgcagtgggccgagatcatgccactgcactccagcctgtgtgatacagcgagatatcatctcaaaaaataaaataaaataaaataaaaataaataaatacaatcaatgtaagaagaaacaaaaaacttcaatagtctcacagataataaattataacagtaattttaaaacttgaaaaagaaaacacttcaagcacagatggtttcataagttctccaaatattccaggaagagataattctaatcttaggtacttgcagagaagaggataaaagagaaaactccctacctcattttaattggctagcctaaacttgattctaaaacctgaaaagaatataagaaagaaaaattataggcaatcttaggaacatacgtatacaaatcctaacaaaatattagcaaacgaaatccattagtacacaactatgaagaagttgagtttaattcaggatttcaatgttggtttaacactagaaaatcaatttaaataaacaacattaaaagaccaaaaagcaaaacaatacagccatctcaatgaatgtggaaaaagcattcgataacaattcaactattcataactaaaaaacaaaatgcttagtaaactagtaacagaaagagacttccacaataaaggaaggtatcttaaaaaaaacccaaaacatacagaacatatgtttaagaatgaaatgttgaaagttttacctttaaagatacaaacatcaccacttctattcaacactgtactggaggtactagccagtacaataaattacatatataaaaaaactgacaggaagaaactacattgttattattcacaaattatatgattgtgtgtagaaaaaaagaatctacaaatatgttattagtttatcactttatcatttattttatattgtggaaataaaaatcattgtacaaaaatcaatttttttgataatgagtattttgtttctgtacaaaaattgattctatttccatataaagcaatcaacgttagaaaacagaatttttgaaaaagacaccatttataggaacattaaaaaatatcaagcacgaataataaatctacaaaagatatgctagtcctccttggtagaaactaaaaaagtttatgtactgaaagacactaaaggcagcctaaacaatggggggatttgtgttcaaaaattacgagattcaatagtataatcataattcaatacaatcttaactaaaattttaacaggtttattggtttttgtttatttattttagtggaactttacaagctgattttcaaatttatgtagatatacaaagggccaaaaagtagccaagaaaaattttaaaaatgtatgactttctctacatggtagaccatatacaggcagtatttcagagatgtagggaaaatattcttttaataaacggtgctgaaataatctggcataatatgcaatataaataaataaataaatgaacctggactcccaacttacactgtatataaaaaaatctatttcaggtagattttaattttaaaattaaatgtaaaaggaagaacaaaaaatttcgaatgtaacacagaataccttcaaaattctgaaacagaaaaaaattccttaaataagatatagaaaatattagctgcaagactaaatttaagtatattaaaatcaggcattctaggctgggcacagtggctcacgcctgtaatgccagcactttgagaggtcgagatgggcagatcacgaggtcaggagatcgagaccatcctgactaacatggtgaaaccccatctctactaaaatacaaaaaattagccaggcatggtggcgggtgcctatagtcccagctactcaggaggctgaggcagtagaatggtgtgaacctgggaggcagagcttgcagtgagccgagattgtgccattgcactccagcctgggtgacagagcaagactctgtctccaagataaataaataaataaataaaaagtaaaataaaattaggcattctaaccaccaaattcaccattaaatgggtaaaacagcaagccacagagaagaaatatttgaaccacttataactgacaatggacttgatctagaacatacaaagtcctaaaaatcattaaacaaaagcaaacaaccaaatggaaaacaagcaaagaactctagacacttcaaaagagagaatccaaatggtcaatcatacttatggaaaagtgcacaccgcacaagtcttcggggaaatacaagctaaaatgagattcaactataaatgaccagattggcaaaaatttaaaaatctgacaattctctaagtattgatgaacatgtgaaggaatgagaactctcatattgtatgtgttaagtataaattaaggtacgccctctggaaaatagttggccattacctggtatagattaagatacccacagtctatgacccaacaaattccacttctagaaaatactctaaataaaagtatatatatgcatgcaggatatatataaaagaaagtctgcaaaattgttatttgcaataaccaaggatcagaaaccattcatgcacctatcaacagaatgggcaaataaactgatttatagttagacaatggaatatcatactgaaatgaaaatcagtgaattatagctacatttcataacattaatgaatactaaaaacataatataaaactaaactacagtattttggcaggacgtggtggctcatacctatgatcccagcactttgggaggccgaggcaggtggatcaactgaggtcaggagtttgagaccagcctggccaacatagtgaaaccccatctctactaaaaatacaaaaattagccaggcatgatggcagtcatctgtaatcccagctactcgggagactgagacaagagaatcgcttgaacctaggaggcagaggttgcagtgagccaagatcgtgccactgcactccagcctacctgggctacagtgcagggctccgtctcaaaaaacaaaacaaaaccaaccaaccaaactatatatatatatatatatatatattactataaactatatatttttaaaatgcaaacttagacggtaaaactctctatctatacatttttttgagatagagtcttgctctgttgcccaggttggagtgcagtggcgcgatctaggcttactgcaaactccacctcccaggttcaagtgattctcctgtcttagcctcctgagtagctgggattacaggcgcccaccaccatgtctggctaatttttttgtattttttagtagagatcaggttttaccatgttggccaggttggtctcgaactcctgacttcaagtgatctgcccaccttggcctcccaaagtgctgggattacaggcgtgagccaccatgcctggcctagatggtaaaactctaaacaaaattatgcaattatatcatcaatcaggacactgagagtttggtgggttgctgtggttgagaaagggcatgctaagaacttctggatggcagccaacatccttgtttttgacctgagtggtaattacaaagctgtttattttctaatgttttaaaacctcattatgttttatgtactttgtcatatgtagtatacttcacaaaagaaaagttaaaaaaaataaaaaggttaatacaattgagaacaatggtcattcccaggggagggagagatcaaattgaggaaggccactggtagcttcaaaggttaccaggctgtaatgtctgatttcttaaactgagcagtggatatgctgctgtttattttattattacattttgtacatgcactttattgtattattttataggtagaatgtcaccaaaagtgcaattgataaaaaaaatttgctacactggaattcattaaaaactttcacacttcaaatgacaccatcaagaaagtaaaaagataatccataggaagggagaaagtatttgtaaatcagatagctgattattttacaaatccagaatacataaagaactcttaagaaatcttaaaatagcaaccttttttttcttttgagacagggtcttgctctgttgtgcaggctggagtgcaatggcacaatcctggctcactgcaacctccacctcccaggctcaaacaatcctcccaccttagcttcccaggtagctgggactacagtaggcacatgccaccacgcccggctattttttgtggttttggatagaaacagagttttgtcatgtcccccaggctggtctcaaactcctgagctcaagcaatcctcccacctcagtctcctaaatttctggaattacaggtgtgtgccactgtgtctgaccaatgacaaaagatttgaatagacttttctccaaaggagatatacaaaacaatgtgccaataagcacacaaaaagatgttcaacatctgtaggttgttagggaaatgcaaatcaaaactacagtgaagttccaatttacaatcactaaaggtgtcctaatcaaaaagacagataataacaagtgttgatgaggatttggagaacagaaattcttattcattgctgatgagaatgaaaaacagtacagccacattagaaaaaaaaaaagagtttagaagtctctaaaaatgttaaacatagaagtaccatatgatccagcaaatccactcttaggtatctacctaagagagatgaaaacatatgtggacacagacttgtacataaatgttcgtggcagcattattcttaacagccccaaagtggaaatgatacagctgttcatcaactgacaaatggataaacaaactttggtgtatcaatacaatggaatactatttggcaataaaaaaggaaagaagtattgatacatacacgacatggatgaacctcaaaaacttatgcttagtgaaagaatacaaacacaaaagatcatatagtaaataatttcatttatataaaatgtccagaataggcaattctatagatagaagtaggttagtcactctctagtgctggggtaggaacgactgctaataggtataaggaatcttttcagcgtattggaaatgttctaaaattagcttgtggtgatacctgcgcaactccgtaaatatactaaaaaccattaaggtatatatactcacaataggtgaattttttgatatgtaaataatcttaataaagctataaaattgtcaagtttccttaaatattactgcatttttctggaaaaaaatgtcatttaaaacttttagaacttgatcttgctctattggcaatttggttccttcctgccctgatccttctgcctttaagaggggaaaagttcaggggcatagtaaatatcaagtgttttcaaaacataaaaaagtataaatattcacagattaaaaaaaccctcaaatgactgagaatctttcttagggctgacaaagaataaaacaggtttaaaaaaataaagaaatgaactattccaaaggattataaatcatgctgctgtaaagacacatgcacacgtatgtttattgtggcactattcacaatagcaaagacttggaaccaacccaaatgtccaacaatgatagactggattaagaaaacgtggcacatatacaccatggaatactatgcagccataaaaaatgatgagttcatgtcctttgtagggacatggacgtagggacatggacgaagctggaaaccatcattctcagcaaactattgcaaggacaaaaaaccaaacaccgcatgttctcactcataggtgggaattgaacaatgagaacacatggacacaggaaggggaacatcacataccggggcctgttgtggggtggggggagggggagggatagcatttggagatatacctaatgttaaatgacgagttactgggtgcagcacaccaacatggcacatgtatacatatgtaactaacctgcatgttgtgcacatgtaccctaaaacttaaagtataaaaaaaaaaaaaaaagaaatgaactatctataatgaggcaattttccaaattctgaatgacagaatacggggctttttcccataaaccttgaggtaatcattttttaaaactgtttgggagaagacagttaatattctgggaactttaatattttcataaataaaactgagcacttttgcatcagctgatacaatcatctcatatatttaagggcatatcctagtaaatatttgtctttctagaaaaaaaaattctgtaggaggattgtttttaccgttgacgtgaggaggaaactgccaggccttgttagttgagggaccgatgtccctgcgattgccatggcaacggtctggcttatcatacttccgctctcactttcataatcatcagtggctatacaaattggtcttcctcgttgattgtgagtttctaaagaaaaataatccaaaaaaataaataaaactgtttagctgaactaattccctttcctattctccactattctttaaaagaataacttgttgacatgttatagttattagatttacttcttttggataatattttaaatatctttaacagtaactcattgctatggtaataatttatagtttacagagaacattaacttgctagtcagaagatgtaagaatataaacatttctgccttcaggtaaggaaattcattttagtgatcaaaatacttgaaagactgctcaacaatcagtctcttaaggcaaatagctggttatctttgcaacaccagcacctgtcaaagttcttaatacacattagatactcaggaaatgtttctgttttactgaactggaagctatcgggctaattgctggtttaaattccctcatttgccctaaagaaaatattgttgcaaactaaattctgtatttaagtaaattctaaatatggaaagcaagagcaataaaactctgtaggttctagttttgaagaagtaataccacttcaacttattaacctggtgttagcaataaacacaattcctgatattcaagtgaatattcatttcaattttatatatatgaatcaagtcaaaactgaggtggtaaacatctgtcaagttttcttgtattttttcagatgtatactgcatgttcacacaaacatttcctaaaatgtaggtacagaattgctataaaatcattatttttaaattcatcataagaactacttaaagcaatcttatacggaattctctcacacggtcaaaggttttctggcaatatagtttaatatttatagtttactttgatcagcacacaattcttattttcctaaaataagatcttcatccttgagatattttctaacacttttaaacattgagctttgcctttaatatttgccttaattatactaggtacctgtaaaatcatacagctgaggtacagtttccatgataataccaatcagaggtagatacaacatggccactcgagcctttatctgagggtcagagtaccgcgggtctgagtcgtgactggagagtaaattgtgtaccatattgatgactttcttatgcaatccaaacagtctatttaaaaagaagaagacaaagaagaaaaagcagtaaggccacagagattagctaacatctttaaaacaaacagtaagtcatggtattgaataaattttgttcaatttcttacctttgtcatatatttgcatgcattccattcctataaaacatttctcattttaaaataaatgtataaaaatgtaaaaaatgtgtaaaataagaattgaagaaaaggaaatgctatacaaattcacttagaagtaaatctgaatatttttacattaactccttattagtgtatttgaatataaagaaactaagactacttatagttacattttgaagctaaacaaggtaaattttaaaatgctgtaattgttatttcatcaaatcagatcttttcacatttaccaaaaataaattattccctttttcggaaagaaaaatcccctacctaatggattatgtagcccacaggctggggttgcctttgacatctctatttaaactgcacttctttactaatatacctcatttgggtccttacaacttttttagactctcaatccccctcagtttcaaatgggctaatacactaacaagggtcactttcacttaaacatttttgtctcttcttaagctgacagcactttaactatgcaaaccattctaatttaaaattcatctactccaactttaactggcccttaatgctgcatccactaagcagtttcagatctcactctctctccttaagccttttactgtcaatcacaacagaagaccttacttccaacttaggaaagaagagccattctgaatttgctctggccaggtcttttaacacaattccatctttatagctcacaaagagtctttcctttttgtctcagaaaaagtgtaccttctcacagaaaataatttcttcatatgttcaatgaaccctgtcttttttcaacagcttcaatgtctcccctcattaggttcttcccttctttcttcaaatatgcctttcctatcttgaaaatacatcatcactttaaaaagttgagattagaaaacaggtagtcttctcccagagcccttgattgtatctgccattttacaaagctgtatgtgaaatctagatggagattctttcttctttcttccagctctttaatcataaagtatacttttatagaggcttaaaacacatgaaagcaaacagctgagagatggccacacactcagactacaacatccagaaagagtctgcctgcacttggtgctttgcccgtgaggtggcaccaatgggccttgcctgcaccagctcgctcagaaacacaactgcgacaagatgatctgcctcaagggttatgctcacctgcatccctgtgccgtaactgccgcaagaagtacagccacaaaacatgctgtgcccccaaaagaaggtcaaataagacacctcccctggctcctccttctcccactgggtggcctcctgcccaagccccatggccctggggcctcaataatgtttcccttttactgactagtgggtatagggagggtcggtgggtggaaagtatacatttaaacattgtcaagaaccacatctagtgaacctatctcagatctcattctccagctccacttgacactttgtcaccttatatattctcttctcaggattttctccagtagttcccaccttccccagattcctcatcattattctcaaggcttagattctcgccaattgcttttcacgttctcctctttgactttctgtatcagcactaatgtttgccaaaggtatgccttatctctcagcagctaccatactcatactccaatctatataaactctatccacttgtcttcataaagccttttcatatgcttacattgctcaatcccattgttattaaatatatattaatacaagatctgtaatatcctattctagatgttgaagataaagacattccccatttttaagtggctcactttagcaagagagaaacacggacacaaacataataattcttcaatacttcaaataattcttcaattctttataaatgctacaattaaggaacataaatcctctcatcttctaaagaaccatgtactacaaaactaacatttaatcatagtgtactgttttgcagtcttaactttctaattacaatgaaagtttctaaagagcaaatctttcattaattatagaacatattattgccacttaaggaattattcttgattacgtagcaagcatgtggattaaaagacaaacattcctctcaaggatctctccaagacaatgctgcatataatctatatacctcccaagacagtaaaatttaaagatgagatatgagtttcttacagttaatccttcattcatcaaattaacatacattagcaagtgtccactttgtgccagacataatactaaggcactgggaatacagcactgaacaagaaagacaaggtgcctgttctcatgctctcacatgctcacattctactgggagaggacagatcataaacaagcaaatttcagataagtgccttgtagaaactaaaacagggttacatggctgagaatgattgtgacaaggacaacatggctgttatttatgagacagagtcttgctctgttgtctaggctgtggcgtgatgttggctcactgtaacctccgcctcccagcttcaagtgattctcatgcctcagcctcccgagtagctgggattagaggcaagcaccaccatgcccaagtaatttttgtatttttagtagagatggggttttactatgttggccaggctggtctcaaactcctgacctcaagtgatccacccatctcagcctcccaaagtgctgagattgtaggtgtgagccaccatgccaggcctatttatttatttaattttcttgagacagggtctcactctgtcacccaggctggaatacagtggtgtgatcattgcagccttgacctcttggacttaagtgatcctccctcctcagcctcctgagtagctgggactataggtatgcaccaccatgtacggctaattaaaaaaatttttttggtacagacagggtctcactatgttgcctaggctggtgttgaactcctggactcaagcagtcctcctgcctcagcctcgcaaagtgttgggattacaggcatgagcctctgtgcctggccaatatggctgtaatttaggttaggtggtcaatgaaaatctcactgagaagatgctgtttgaacagatacctgaagaaccacaagcaagaaatgactatgtgaacatctgagggctgttcaacattgcttcaagaggagaaaaatccaagtgcaaaggcctgaaggtgggaatgagcttggtgcattagagaaacagaaagtaggccagcatggctagatcttagtatatgaggaggaagagagtggcaggagtagacaagagccagatacacagggccttaagaacctatatatggcaactatatgcaagactatcttgcagtcatgagaggctccagccttaggataaagctgacacttctagcagaggtaagaaatgtaaagaactggaatcatgatggtatcactgagctgatgatattactgtgctaaaaacctatctttctgggggtttatccgttcggagccccccctccctctatatcaggcagccgttttcttatttctttcctctttcttgcctattaaactttctgctccttaaaaccaaaaataataaataataaataataaaaatcctatctttcttccaattttgaaatagtaaatttccttcctttaataaagccagctggaggaagaattttctatttattgtaaccaaaaacaggttcacataccaagtaaaaatattgaaaatacagattcaaatgagtgagctataccagttattttaaaaagctagtatgtttaggtaagttgtttttagagtgttttttccccaaataacagattcctttatttattttttttaatgacatcacagtcatttgtcaaatggcaaaatacaaaagtggcgccaagcaggggtggaaggcccagagtttcacccatttagtttgccctctctatactccaaagtctgcacacacactgcccaccccaatctacacagaaacccattaagcacctcttcaggaccctacagttctgtttagaacacagggtgaaaaactacttctttaaaatagattccaaacttaggaagttgccattataaaaaacacatgtctttcacttgcagatctggcctttcacaatttattcggtattgactatgcccctgacatactgctaagaacttgacatacctcctcttttattcattcaataaatatatcagcagaaccttgtaaaaacctatttaaagtatctcttttcgttcttgcatgaggctaaactgcattataaacttggattattcctactacaaaaaaaaaattttaagccattatcacccaaatgagttatggtcatactattaagatggacatacctcatatgggatgctggaccacaacacatcaagcttttttttttttgagatgaagtcttgctctatcacccaggatggagtgcagtggtgtgatcttggcttactgcaacctctgcctcccggattcaagcagttctcatgctccagcctcccgagcagctgggattacagacatgagccaccatgtgtggctaatgtttgatatttttagtagagatggagtttcaccatgtcagccaggctggtctcgaactcctgacctcaagtgatctgactgtctcagcatcccaaagtgctgggattacaggtgtgagccactgcacctggctacattaagctacttctataaattcaaatcattaggtcggtgcagtggctcacgcctgtaatcctagcatgctgggaggccgaggcgggctgatcactcgaggccaggagttgggagaccagcctggccaacatggcaaaaccccatttctactaaaattacaaaaattagccgggagtggtggcacgcgcctgtagtcccaactactcagaaggctgaggcagaagaattgcttgagcctgggaggcagaggttacagcaggctgaaatcatgccactgttgtccaccctgggtgagggtgacagagtgagacctattctcaaaaaaacaaaacaaacaaacaaacaaaaatcacatcatcagacaatatacttttctaactacatcaatttccaaacatcctttaataatgtacacaactttggaagtttttaaaacctaaagatatttgtttatagggcaatttttgaaataaaatgctacatagtatgatggcaaattataaatttttggccaggtgcagtggctcacacctgtaatcccagcactttgggaggctgaggtggtgatcacttgaggtcaggagtttgagaccagcctggacaacatggtgaaaccccatctctactacaaaaagaaaaattagctgggtgtggtgacgtgtgcctgtagtcccagctttgggaggctgaggcaggagaattgcttgaacccagaaggcagaggttgcagtgagctgagatcctgccactgcactccagcccgggtgacagagcaagactctgcctcaaacaaacacacaaaaaaagataaattttcctgacaaggaatcaaataaaagaccattttcctcaaatgacaagcatttactttacatcaaaaaatctatctactaatatgcataatttattttatatattattaagaagaaaaagaacactactaaatgaattatgatacgccaccaattttaagacaaatcccaaattcagaggtgacaaaatatgagaaaaagtctttcataaaactgattaaacagataaataatataagtgagaaacttagtgaagagggaagtagaaaaagagtgtgaaagattattctcctaatcctcaggaaatgtgagtggaatacttctgtccactgttcaaaatcaaactcatattctacaaggtaaaaactagtgtactcacccttcagcatcagggtctaaaatgacagccagctctgttaacacaagtcctgccaaataatgctgttggcggaaaggcacggataattcaaacatatttgcaatcttttggtcttgtacattcgtagaaaatccagaactctgttggaaagtgaggcagaacaagactataacagcagtgcaacaaagcatcctacagacagagcaatataagaaatgaaatactttttcccagggtagtttattttatattactaacactgaagacaaagcaacttttcagacttttgggacaggaaactatgatgagattgctttattaagttaattactttattatagaaattaatcattgaaaatttaattattttacatttcttttttcacatatactttcctacatattttcccctttattctcttagccacttttcaataccacactctgatggaaaaaagaagcaactaaatccaaatgacatagtatgcacttaccccaaagtacaagagaaatattcatagtcaaggctattggtttccagagaaattcgaaacaccagtacaattgtttttcacagaatatactatctctggaaaattaccatcattttgttgtctgagttttttttttaacatcttaatacttcaaaatattatagcattctccaagatacagtccatattcaggactcatgtggggtttcttagtgcaacaatagatttcacatttctctatggcgaaatcttctcctaataagaatataaaactcttcttagcctttcaaaaaagagtgatgtctctgttatctgaaagaatctgaaaattacatagctagctgagaaagtgggcaacaagataacagaagaaattctatgagcatttcctggctgaaagagatgttcagtaaggaattagatataaacaaatatgtttccttaagggtgttagcaaccatatttatgattaatctgtctttgtgtagctacatctttggcagaggacagggaaagaaagaaaaaggccagcctcatccattagattaagggcatgctagccagactgaagagtttgtggaaaaataggctgatccagaagatttttttacagagataaaatgaaaagttgtgggtactctttgatgttttctagtctttctagctgaagtttaaattttgttttttaaatcacgcatatgagatatcacctacagaatcctattcaggaattaaatatattgaaaacaaaattaagaagtattaagattaactaactttcactttagaaattaagagcttaaaaaaagtagcctccttgcctcaggaataatacagtagaacgagtatttcactggacaaaggaaaatataggcttctctgatactaaaaccacaaaatctcttcatctcaatttataaaagaggacatacatattaactgctacaataacactttttcatctacagagaacctactagctgttgaagtcaagtgccacccactgaaaaacccatcaattttcatctggtttcctttggggtttctggatacaagagagttaagcagggctttgtcatgcctccactgcagtttgacttctttctctgttcaattatgcttcatcccccacttcctttcacaggtattgatctctaaaacacatcttgcatttgaaactcattcttggtgtctgcttcaagagaactcaatttgtgaaaacatcttaattagtaagtttatttaggtgaattcattcacatgtgcattaagtctatgaaaggaatataaaacagtggttaagaacttgggctcggccgggagcggtggttcatgcctgtaatcccagcacttttgagaggccgaggccggcagatcaagaggtcaagagattgagaccatcctggacaaccaacatggtgaaaccccgtctctactaaaaatacaaaaattagctgggcatagtggcgcacgtctgtagtcccagctactcaggaggctgaagcaggagaatcgcttgaaccccagaggcggaagttgcagtgagccgagatcgcaccactgcactccagcctgggagaaacagcaagactctgtctcaaaaaaaaaaaaaaaaaaagaacttgggctctaaaataaagccttggttcaaaacctggctctgccactttttactcagtgacctttctgtgtttctgtttttctaacctgcaaaatgggtataataacagaacttgcctttttagagttattctgaggattaaatgacttttaatacttacaaagcactaagaactgagcctatcatacagctgttattcaataagtgttattttttccattgtttaaaactattcttcacaaaagtgactttaaatatatgtatattcacacaatttgcatacctgagatgttgcagaagaaacagaaggtgatggagatgcaggtggagtaagtaagctgcagggtaagtttaatgtaacatagtgctcatgactgcagatgattcgtagaaaatccagcctcaaggacaccagaacactgggattcggtaatgagtaaagctttgaagacaccttgtaagcaatgcataagtaagagaacaccaattgaatctattatttctttaatactaataccagaatggcaaattagaattaaagagatagtacttggtatccagtttgggttttgtggcttaagtagcagtatcacctttttccagagttactgctaaaattaaaaattttaaactatcaggtttactgtataaacatatttgactaacctaaaagccacattcttgtatttccaatatagcatcaatatttctacttctcataaaacagggaaaacgtatatcaccaaaaataacttcttattacttccttcttaaaagaaattatcaattctttttatagcactttgtgcttacctgtatttataatttgtctgttttctcagcaacatcataagctacttgaggagacatactataaactgatttaacagctttagtgtccctacagcttagctcaatgtttgacaaatataggagatcaatgcttaaagaataaagacaggacaagttctggtagcaatagtacataaagttttgggggaaaggtaaaaatgatacatatcgtgttgcaagtatttccatgtgggtgagtgcccatgcatagttttaacttttctattagaagaaataaacaataaaggcatccaatagaatattcaaaattctaaatattagactgccaaatagaattctggactattagttccctaaaactaatctgtagaccagttgtgaggtgcttcacaagcactgtgtgctcctcatccccaccaccataagtttgaacttctcaataattctgggatgggactcagaaatatgtatatttttaaagctcctttaaaaggtaattctgaaaggcttatacagtttactaccaaagtggcccagcagaaccaataactaatgttttctagaaggcagacttcactaatcagttgataaaaattttaaaacaaaatcagctatgtttggaaaagttccaggatgcttttaatttcgtaaagtcaagataatgaacatatggcaaatgggtaaacatccataattccaaactctacaatgtccagggctggattaggaggaatacccagcaaaatgcagttgctttaaaaatcactcaagatacagaagtccactcggtataaatgctccacttgcatgacatcttgagactgctttacattactactgacttgatagtatgatccagaatgaggattaaagagtcatgagtaggccagtataactcaaggaaatactggctgtactgataacagcttgccacagtccttgtgtcctgataaaacatgtgtaatttacttttgccttgctaataaaaatatgttactttggctactttttgttttaacatcagtatataaatgtgctcttaaggtctcttagctctaactttgaaaagaactaacatagtatttaaattatttgattactaattattcctaactatgcattacctgtttatagcaggactttataaggctaaaaacaaatcctctgtccataacagacaacagatcattgagaaagaatgcaaggcttgtattgagtctctcaaccatttctgtgtcctgtgaaacagaatataaaacaaaaacaaattaaagtatgatagcttaatctgagcttgaaagagagataagtggggaaaaagttatcattaccttctgaaatcgtgaaactatatcactagcaatcgtgctgacaagagctgcaatgtcatccatgaaacgttctggaaaacgacttttccttggagcctcaagtttatcattaaagtataaatggtgcaccatgctctttacctgaaaaaaagatataaattattaatttcctatgaatatatttaacaattacaacaactctaaacacttggactatttttaaaatatggcatgtaatttaatagatgactgaaatatttttagcttctcaaatattttttaaagttccctacaatgttttgtatttgcttaaaataaaataaaaaaaccaccatattactttcagaaaattatgctagctaacaataggacaaaaaaattctgtgtatgtcaacaaaaaaaaatttcaacctttaaattttttttttttttccaataaaaaaacagggtctcactctgtcacacaggctggagtacagtggcatgatcacagctcactgcagcctccaactcctgggctcatgtgatttgcctgcctcagcctcctgagtagctaggactacaggtgcacactaccatgcccagctaattttaaaaattttatagagacagggtctggctgtgttgcccaggctggtctcaaactcctggcctcaagtgtttcctctgcctcggcctctcaaaatgttgggattacaggcatgtaatctatcacatccagccaaaaaaagtttaattaaatttttccaagactcaataattttgccattccaaagctcccaaattctaagctttgaaaggttagaaaccctgtcttcactatagtgtcctcagtagctaatacacagatgatagcatatagtgggaatacaataaatatgaggactatattgtattgtatttgtactgaatattgtgcagattctttattataacactgtggtaatggtaacaaagaattttaaactttaaattcagggaaattgaagctaaagtcctaaacttaatatagagcacagccaagttttaaattgcagtcttttgactattttgtattttagaaacctgaacatatatgtaagactactaaaaaacggtgaaaattacaatttttaccttacaggagcagagatgtacatgaattacgaatttaaggtttattttctaggaaaaaaatgaattgtcacttatatatagtccctgatttattttttctgtagattattaaatctctagaagaaatgttttcttacccataatataggtaacattcaatgctgaggaccaccctatgacatactctggaagatccttttctcttttttgttgttttgttttatatttttttacatacttcttttttggaagaaaaagtttcagtgatttcagctttatagaggctgaagacgaaggtgaagaagacggtcccaagtgctgaaatgcctgagttttaattacagtcctgctacctacaagctgtgcattctaagacaagttacttaacttctctgtgccttagtaatacctaggccacagggcagtactggcatattgtgcccacttgataaatgtttgtaatgtttgttgcctttgtttacatatgtgtgtgtttacatatacaagtttatatgtacaggtgacccttgaacagcatgggtttgaactgcatgagtccacttatatgtaggttttctcccacctctgccactcctgagacagcaaaaccaacccctcctcttcagcctattcaatgtgaagacaatgaggatggagacatttatgatgatccacttccaattaatgaagagcaaatatattttaacttccttataattttcttaataacattttcttttcgctagcttattctaagaacacagtatataatatgaataacatacaaaatatgattatgttaccagtaaggcatctggtcagcagtaggctattagtagttaagttttaggtgagtcagaagttatatgcagattttgactgtgtgggggagtcggttcccctaaaccccaagttgttcaagggtcaactgttcatatatatgtatttattaattgaaatattaattcactcattttaaaagtgtcacttatttgattaagcaaaaagtacttaaaaaatttaaagagacaggatcttgctctgttatccatgcggagtgcagtggtgatcatagctgactgcagccttgaacttctgggctcaagcaagcctccctcctcagccttccaagtagatggaactacaggtttgtgccaccaggtttagctaatttaaaaaaaaatttttttggtagatatgggctcttgctatgttgcccaggctggtctcaaactcctgatctcaagtgatcctcctgcctcggccttctaaagtgctgagattacaggtgtgagccactgcacccagccagtactgttgtttttttattgattgtaactggcatttccctaagggtttactagccataacaatagcagtgggtatctataaagctctttccatctttggtataaaatctacaatactgtcattatacacttcatgtataatgactagcaaagaatgtatcacaagtttcctttgaaaatatagctagcttatgcaaccatccctgagaaaataagagttaaaatgagcctcactcttaattccacctaaactgtgttgagtgtccacagtgtttatttagagatgtaacacatgtaattttgtcttagaggcacatggaaaagcgttaagatgtgcaacagaaaaagatttctaaggtaacaaatgagctagcataaaattgttcactaagagaaaaaatattaaagaacatgctcagtttttgctcaccattaattcaaaaaagaaccaggcttgttgcaaagctgattcccgaacgctgccactgcaaacaacccactgcaaagccagctcctcgtgaaaaagctatccagaagtaaatccaaagttattatcaaagtcaaatctgctgataacataaaccaaatcataatgcaaatacaaacgaagatataatgagaataagcaaaataaggcacgtgaaccattcaatgatgcactgaagacacccattaacgaaacggctatttatgtatgtaagacagtggtatgtggaacagctgaaaaaattacatgttatcttgcagtaaaatgtaattttaaaaggacaggtagaagatagcctcctaaattgtacctgcaaacagaaactagactaaaaacttatagtacagtaatattttgtttgtatcttaagtacatttttaaacatacgcaaatacatgcatgaactttgctggtacaatttaggaaatacattttaaaatttaaactttgctatgagccattaattttcaagttttcaggtaaggtctttttaaaaaaaaatagcagaagatttctgccttataatggatatgcatacaaagcatttgcaaagtagtgtatattaatatgaaaaaggactaacaaaactgtgcataagggaagcaaatcaacatatcttactaagagtgacaatttttctaactcatcttcctttccctggagatttaaaacacaaaacagaagcagttacagaaacagaattaagagttgatacatttttttggtactaaaatttgatgatcaaatttgaattcactaaatcctaaaaatagtcaatcccaaagatataaacattatcataatgtaaaaaagtatacattgacaagatatgccccaaaaggcatcagacaagcaatgcttgttcagatatatttttaagcacaatgcaattactgtaagtatctcatactggttatgtaaagaaatcttacatctatttaattggtgaaattattttccccctctatgaattgtcttcatatgaatctacctttttagttggtaagcgtcccgttaatgtttgtaagaaacttgacgtctctgtgtgcgaagacatacgattacaacttcgatccatagcctatggagtgaagatgaatgaatgacgagataacattaacgtttgcagtggatgactttgcagctgatggattatgtacaagtttaaaacagagttttattatggtttcaaaaaccatctattttattgctcatctcattttcaccatgttaagctgctttaatgacaatgcataagtagtatcaaaatggcttctatatatttttggtctttaaaaaatgatgagtatttcagtgattatataatattcagagtgttgcaaagaatgaaacttttatctgtgtgatctatatacatgcacatatctagtaaaaatatataaaaagtaaaaacatacttctcaactggtctcagaccaaaaaagaaatcagtaactttatattaaagaaaagaaaaagtttagaataatttctttcactttttcattattatcaaaaactactattcaggtttgtcatatactaaatcaaatataaatcatttacaatattagaaatggaattaaaaattttatttaggaacaggatttccctccaaagccaacacagatgagaagtatattttgagatatcatgcagtattagctatcaagcaactagtcttaagtaagcaaaacctaattcagctaaggtataacaaatttcatactttgcaacacagtacaaattaaaatggatttttgcttctggtattgagtcttatagcacggggatcatatactgttcacattcaatttcaacttattgccagtctttctattcggtgattaggaagaaaataacaagatagtaaatgttaaatgaaaatgatacaatagttacactttaaaccaaaagcaaatagaaaactgttgggttttttcctccacgtaaaaaatttaaaaattgctattaaagacgtgctacccctaaagaagaaactgttataaaagccatcaattgcataagcagcaggcactgaaatattgatagggtgtgtaaggaagaaagaagacagagataggaaataggaaagaagaacattactggtgcaattggtggtactcatgcatagtagttggaaaatgtgctaagtaaacaaaaatacacactttttaatgattaaaaaaagcaagccactgaaatcatagtatatactaaaaagtaatgttctaaagggaaacatcagcagccaataaagaaacctctaatataaacaccacctgtgttgattctgcacttggactggggttggatccccatggggcagcttttggaccaccagtgttaacccaggaattggagcgatctaaaccctaagcatataatagaaagcagtttgaaaggaaagaaatattacatgttgcatgctataaattattcttaaagaaattcagatcttctaatgcaaacatgtttttaattagtactgttaaagcaaccaaaatttgtaggcacctatagagtattagttcatcaaaattatcttattatataacacaattttaaaaaaaatcaccaagaccattaagtatagtatttaaaggtaatttttctttatgtaaaggaatactcttgaagtaccaataactaatgttcccacagcaccacacccccaaactttctttaaagatagtacaagttagcaacaggtaatttcctctgtatctaactgaggtttaaaggaaaaaatggaagaaaaacactccattctttgttataaactttaatttcattccatctctcatcaactgaaaactactatgcagtgataccccataattctatttgagcttgctaccaccttcactctcttttagggacagacaggagaaataaagtaaaaacttaagaaaaaaatgatacctaatatttactccttcctaataatggatttggagctgcacttataataataatgggctactatttattaataaatattataaggaaaaacattatgctggggctgtttataggaattatatcttcatcatcatcttcattaatttaaaatttctttaaaacgctactaaagtatatgtccagaagttaatttatgtttatctctgtctgaaaggggttactgtgattccaggtgaaggaaacagaggcttttcttctatttcctaaaactgactgttggtcagaatcaattgagaagctttataaaattcagatcctgggctctatctctataaattcgattcagtaatttggactggggacttgagaatctaataattggaactggagcaagttgtaaaagatttttaaagaattattagggtaagaatagcaaagacaatcgaagacaagctgatgtaaacatatcaggacatgagtacagacccaaaccagaaaccaccaaaggaaagacaggtaaaagtgaagagttggaacaactgtaatcaactctgtctagatattagtgtcatttgggaagcttaacaacaacagtaactaacaaatgtgcagcgccctaccttaaaacaattaaatcagaattgctgtgagtgcggcccagacatcagtattttttaaatacttcaagagaaaattttaaaaagaaaagaaagaaaaaccgcaaccctcaagggcttaggtttcaggagaatatttcctccaccttttttcattttttcccaaatatatagagaaattgaaatggtggtaaaataatcacccatttctaatcatttttgacagtgactgtctaatatgggagttaaggttccaatccaggctctcctgcttactagctgtaaaatctaagataaattacttaatttctttttcagtttcttaactataaaataaaaatgatgagagtgtctcccttcacatggtaagaatcaaattaaataatggaagtaaattactaagttcaatgccttgaatatagtaaactctcaaaaacagctttataaaaatttcccatacatatttttcttaaaatgctttctatcaaagtaaattagacaatatcaaaatactagtaagattatgcaatcagatttgtttaaaataaaatatctgccttctcagaatcccattacaatatttcgaataaaagcaaaccaaaaggcttatgtttttcatagaagttaaaataaagttctcattagtctccaaaattatgtccaagcccaaaattatgtcttttttgtataaaagtgtaaagttcttcctaccatattcaatttttacagtcactactcatgttacaaaaataacaaaacatgagcatttgatttttgcaaaattataactgtcctcttttctctcatgaatttccacaaaaagaataagaactttgctgtactcttaaatttacttaacttactgtttaataatttcctttaaaactacaatatatgataatcgctaatatgagaataaaaaaatctctttgtgctatgaattatatttatatacacaatactgatgttctgaacagttgtaattacactagtcaaagctaactatttaaagaaaacttgtggccagttatttggcaaagcaagtaaattccataattcaggtgttataaagctaagagttatatcaaacagcccacatttaagcaaactcatcacttatatttaatataataactttatgtttaccaatttccaacaaacatggaacagattaaccaaatgtgtgcccacgtgtatgtaagtgtgaggttttttttgccaaatcccagtaacactattgatttcttcccttacatatagataagatccttgagcaaggcccatactgtatttgatgtgacatcaacacttgtgttatattacaaagattttacttcatatccacaagtcctcagcatagtgcctagcacacagtaagctctcagtgtttgagaaattaaaaaaagatgatatatgagaaagaaacgtatcagtgcaaaattccactggcatttgataaaaagcaataaagttcagacctgatgtaaccatgtatttacataactgaatgttaaaagacgattactagaattaagaaagcacagctagttttggcaatataagtatgaagaagtctcacaaatattttcacatttacattacagccactggagtaataaaagcctgttcaggttatataaatattcttaaattttaggagttctgtattttatactggggaataaaatataaccaaaactttcataaagtcaaatctctgcagacctttaaatacataattaatcccaatagtaagagggcaaacaaaagcataattctgttcttaaacaagtgatctagtcctgcggtgttaactcatactaacatttcttcattggataaatatctactgagcaccttgaataagttagacattacaggtgccttggaacaaatattccctgccacaatgaagcttacactctgttaaagggagataaacactaaaaaaaaatcaacataagaataattaattcatatgctacattaaaaggtagtaaatgtcagacaaaaaaaaaaagacaaaaaacagaataacaggattagaaggctgaggacacagccactggttatacatttaaataagataatcagagtcaacctcactgagaaggcggccttcagagtaaagacttaaaggactgagagaataagccattagaagattgtgctcagaggaatgacataatgacttaatttttgtgtgtgtcttaagtctttttttttttttttgagacagagtctagctctgttgcccaggctggagtgcaatggcgcgatcttggctcaccacaacctccgcctcctgggttcaagtgattctcctgcctcagcctcctgagtagctaggattacaggcatgcaccaccacacccagctaatttttctatttttagtagagacggggtttctccatgttggtcaggctggtctcgaactcccaacctcaggtgatccacctgcctcagcctcccaaactgctgggattatgggcgtgagccaccacgcccagccatgtcttaagtctttaaagcaacattctggttgctatgttgtgaacagagcacagggtagaagtagggaaaccatctttaaaactagtacattagttctgggagagatgatggttgctcagaccaagatggtagcaatggagatggaaagaagtgtctctacctttcatatatatccaaatctgaacaaaactatttagaaaaagcagttaagtttagaactccagagagagatctgtactggaaatataattttgggaatcattagcataacatttacgtggtatttaaagccatggaacctgataagctgaccaaggtagagtgtagagagaagacaagagaagagaaataaggacagaggcctgaaacacatccagataaagagatcagaaaaggaagaatccacaaagactgaaaaggtataatcagtaaaccaagagggaaactaacagaatgtagtaccctggaagccaaataaatgaataaatcacagaggaaaaaaaaatttaactgtgtgaaaagctgctggtaggtaaaagtaagccgagttctgaaaattaaccactggatttagcaacatgaagggtgctggtgacactaacaaggacagttttggtggaaaatgggaggaatatttgactgaagtagagatgatagaagtaaaagaactgcagatagcaagtaaagaaaattcttaaggaattctactatgaaaggtagcacagaaatagcaagtaaggtagcagttgaaatactagagaataattactataatttttatttttatttaattttgtgggtacatagtagacatatgtatttatggtttacatgaaatattttgataaagatgtatcatgtgtactaatcacatcaggatgagtggggtatccatcaccccaagcatttatcctttgtgatacaaagaatcaaattatatatacacttctagttatttttaaataactaaataataaacagtatttacctatttaattatacaaatcaccctgttgtgctatcaaatactagatcttatgcactctttctaattatttttctgtacccattaactatctccatttccctcctaacacccactgccccttcccagtctttggtaactatcattctactctccatctccatgagttcagttgttttagtttttaccttctacaaataagtgagaacatgtgaagcttgtctttctgtgcctggtttatttcacttaatatgatgatctccacttccatccttgttgcaaatgacaggatctcattcttttttatgggtgaatggtatgccattgtatatatgtaccacattttgtttatccagtcatctgttgatggacacttagattgctttcaaatgagaggaatcatttttttcaaaatgagaaaaacaatagcatgcctatatgtgaatgggaatgattcagtatttagggagaaactgatgatgtggaagagatatggaaaaactggtggagtgtagatcttgagcaggtgagaccagatgagagcttgagtgaaagaaattaatttagaaaaataaatagctcatctattcatttttaatacagaagagtattaggcagtagatagtagatggtaataggtagctagatagcatggtaaaagtttatcaaagtcttcttctgatggtttcagttgtctcaatgaaatgggagataaaatgagaaaaggaatgaggggagaggtgttaggaggtttgaggtaatgaaagaaggaattaaatcatttcctgggagaacaggaaagtgatggagatacagaaatacagtataattgcccaatagcattaagggctctcttgaggtttatttcaaatgagatcaatcaccatggtatttctcaagacatgtttagctgcacagatgctgacatggcacaggcagtcaattgggtttaactatggtttcaaggtttgggaaagataagggaactgaggtttgattataatgggagtaattttttttttttttttctgaaatagagtttcactcttgtctcacaggctggagtgcaatggtgagatctcggctccctgcaacctccgcctcccaggttcaagcgattcacctatctcagcctccagagtagctgggattacaggcatctgccgccgtgcctggctaatttttgtatttttagtagaggcgaggtttcaccatgttggccaggctggttttgaactcctgacctcaggtgatctgcccgcctcagcctcctgaagtgctgggattacaggcatgagccaccatacccagcctgatgggaataattataatgattgcccacagacattaagctggctaaggaagaagagagaacattaagggggtgagacacagtaaaaaggttggaggatcaagattagagattgcaaaggagtagataaactaagttgaggtactacaagaaaaacaggagataacagagaacaaaatacatgaaattgagattgtgaaaattaaagttattggtaatgacaagattgcaggggtgtccaatcttttggcttccctgggccatactggaagaagaattgtcttgggccacacataaaatacactaacattaatgacagctgatgaacttacaaaaaaaaaaaaaaatccctgaacaaactcataatgttttaagaaagtttacaaatttgtgctgagctgcactcaaagctgtcctgggccacatgtggcctgcaagccacaggttgaacaagtgtgatataagggaagaccatgactgaggtggagtggaaaacaagatcacctgaagaagagtttcttgaactgccaggtcaataaaataagaaaaaatgaagggtagctataaataaactttagattccttataattttgagataaaattatatacattattagtgattacaactaaactcaataggaaggtagctatcaaaaattttgcaataaaaagaaaacaacataaaaactatgtaaataatacttgattaggacaaggctgacaaattctcatcttgcaatggctttctaagaaactaccttgtatttatatatttgtatatatttttatatatattttaaaaatcattgatccatttaaagtacatcttgaaaaaaggcaaaaaatcattacatatatatataggcctctttgttctaaatcttgagtttataatctatcaaacctaaaagaaataaatagaattatgctaaatgagtcttaatgtaaatcttacaaaaattaagagacattttaaaagaaccttaaggaaatgctgtctatagcttcttttctttaggaaagtttctgaaaatccaaaaatcaaacttattctactgaagacctatgcagtatataaatatacagtatataaataatgctacgtactacctgtattacaataaaatataatcaataatgaaaacaggaataaaaaacctgagttcttttcttaaacatggaaataaatgtgtgtggggggtgggggaagcgttctcttttcgcagctgccatagtactcaggttactctgcagtatcccttataaataactctgagtatcactctttctagtttacaaaaatggaaaattgtttaatcactcttctggatattttttggagaagaggatctcatgacttgaatcaatgatgacatctctcttctacatatcagtcacagatttattttaattctatatgaaatcaatctagccatttttcacatgatggagtatcagactgacaacaataagttatatgcaactagtgattccagacaaattttagaatttttagtggagtagtttgtaagagcaagcatatttaacagaaaaataaaacagtgtttactgatagaacagaaatgtacaattccttcctaattcctaacttacatacatctcaaaattcagaatacattacaacaactggatatttctcgtttgttcacaaaacaaaaaccaaatttacagatgcatgtcttcagtttaccttactcccgatgattgatcgaacttcatcatctggtgacgtgggagtcccagatatatctggattgctattactaaggcttcgagaacgatttaaattaaggcttgcaggtctcaccgcagatctagccattgtggcataatgcactgatcctcccaaacccccaggacctagagttgtatatgaaatagcacataattaaagaaaattagtcaggaaaggatctgaaaaaaaatctctgccactttagaaaattccacaaagatcatgaattgctttggtttctaaataaaaaatatactttttttttttttttttttttgagacagagtctctctctgttgccaggctggagtgcagtggcttgatcttggctcactgcaacctctgcctcccgggttcaagcaattctcctgcctcagcctcccgagtagctgggactacaggtgcgtgccaccacgcccggctaatttttgtatttttagtagagatgaagtttcaccatgttggccaggctggtctcaatctcttgaccttgcgatccgcctgaagaggcagggtcttctaaataaaaagtattttatatatatatatatatatatatatatatatatatatatatatttttttttttttttttttttttttttttttaataggcaggtgccatttttttttttattaagaggcagcactggagtgcagcagtgagaccatagttcactataatcttggactcctggactcccacctcagcctcctgagtagctaggactacaggcacacaccaccatgcccgggtaaatttctctctcttttttttgtagagacggggtcttgctatgttgcccaggctggttttgaactcctggcctcaagcaatcctcctctcttggcctccttgaagcactgggaaatgttttttttagaaagaaagaaaataaaaacactcaagaactaatgattgctgtacaaagatactctattttacagcagtttataaaaccatatgaactataaataaaatcattatctcttcagtatttctataattgtatattacacatacaataaaaaccaaaataggaaacacacacacacagacgtgtgcgtgcgtgcgcgcacacacacacacacgcacacgcagccctttcacttcggtatagttggtatttcggacccaagatgctccagctggtgtctcttccttttttcccacctctcctactctgccccttgacagtcactagagagagtgccaatttattgctaacatctcttaaattaaaccgtgttttatttctctaccttcattactgctaacatcttttaaatgagagcatgtttcatttctctatcttcatcagtgacaatgtgaataacaaaatagtatctttatgatatacatacaaaaaactaaagataattttcagatccaaagtgataaaaaagcaaaggcggctgggcgtggtggctcacgcctataatcccagcactttgggaggccaaggcaggcggaccacgagttcaggagactgagaccatcctggctaacacagtgaaaccccgtctctactaaaaatacaaaaaattagctgggcgtggtggcaggcacctgtagtcccagctacccgagaggctgaggcaggagaatggcgtgaacccgggaagcggagcttgcagtgagccaatattgcgccattgcactccagcctgggcaacagagtgagactccatctcaaaaaaaaaaaaaaaaaaaaaaaaaaaagcaatgcctccctttttgcctgactaaaatcaagcctaacatcatcttccaacctgtcttttatttttaaaataaaacatccaggaattatagtgttaatttatcttcatctttccgaatgtcatatttgcaaatgatattaatacatacctgttgcctaattaattcatacaatctttcaggtcagcatgtaaaaaaaagatgctttgcaaaatctgtggaattctaatagtgtactgaataaaacagtaaatggaggagcactgtagatattacataatcactcacacattcatgtcctcaagtggtataattttaaaaattaacataggaaattataaaccagaatataaatgtcaattgcttttctttttgcaattaagtaaagaaataaattgggctaaaatttaaaatcaggttactattatgtctagtgttcataacgaacgtcacaattattagtcaccgttatcaatgtcaacattgccaaaagctgataaaaggcacttgccattatcattaatgtcatacagacatgtatgtgagtaggttaaatgatacgcacaacataatcattagttagttaaatgaacaaccaaaggattattcacactaagacatctcccaccgttacctccactatcaccagtggtacacaaaagacaataacaagtcgagtctccagtactcagaaaggttatattatttcactgaccacgaagagatcagaactttcctagagaacaatcttctatatcactgtaggtttcaaagggttttcaggaaactaccgagccaccacatttctcctttaatgcccaacagcactctgaatgacaaatacaagattctatttttcttgtcttttttatgtttaaaagacaggatctcactctgttgcccaggctggagtgcactggcaagatcatagctcactctggcctcaaattcctgggctcatgagatcctcccacctcagcctcctaaacagctgggattacaggggcaagcaattccttatcttaacaaggaatgataaaatgcttccagagacaaagttattttcaaagctcatttccaaaaattaactcaaccaagaactctaattcaaactaaagcaaactgtataaaaaaagatgtctaaaaatgtaacttatttatctctttaacttcagcacctagcacagtgaatggtacttagcaggtgttcaataaatgtttgcctttgaataaatggatcacagtatggactacaaaattatctcaatactgacatgaacatataatttatgaaagacagcttcatagtaaaaagaataaaatacctggtgatgatgaattagggtaagtatttggtaggcggaaaacataatgaatatatgatgcaagaaggctgtttctgccatgctggtcatgatttccttccaagtttttgtgaagtcgatttataattgatgccatggcttcaaaagatgcttgacctaggttaacttttaagaaagaagaagtatttacctttgctttaactttttttagactgtaaattccacgaagatcaacattttgtcatctttgcatactttaagtatagtgactacacagtaagtgtataaagatgattactatttgatattgacttttaattacacgttgcattagctgagccaaaaatacttttctgaacaaaatgagaactcattttactaatttaagatgaaaattatatgggtttgattagtcaaaaaagaaaacaatgctcaacggatatgttatttagtaaaacaatacaaagtacataagaaaaaagaaaatacatcgtgtgtaataccttaagaagcaatttttcattttaaagattactccaaaaatctaaatagcatataagggcatatattacttttgtttaaaaaaattaaaaatatcaataataaaagagattattgaaaataataacagtataataagaaaatagtgaataagcaacttgattggaatgagtgaatctgtaaaatgattagaaggaaaaaaaaaaaaagagggggctagaaaaacaggttgaggtaagactacagcattttaaatcccaggctaagcaatacctactcggtcactcaagtcagtatgtaacaataattttacaaaaattggagaattgtgataaattgcacactgcataaatgggtaaactgaacagccactttgagcaataggatcttagattctataatttatttaaccaagacaggaaattatgaagagataatgaggccaattaagttttcccaaaagtagaataatcagataaaatggtcatttaggaagattaatctatatatactgaactagaggggaaagagaccagagacagaaacctgagcgaagttaagcgatcctacctgtgtttctggttaatccttttcctttttcttacagtagctactccaagttacaagaatccttctcaaaactaaggtcctccttaattcctccttagcaaatcttgccttctacctcacagaagaaatgtataaagcatgaaagttctcatgtttttctttttcttttcttttttttttttttttaagagatggggtcttgctatgttgaccaggctggtctggaactcctagcttcaggcagtcctcccatcttggcctcccaaagtgctgggattatagttgtgagctaccacacctggccaaaagtcctcatctttttctacaaatttatcagaatctgaaattactttatctcctctccaaaggaagtagtgccctctcctatgtaagagtgatctatctatcacctttactcttgtctcccagaattgcttcattaattaacctcttttctccccatgtatttttctcccttctcccatttgagcatgtttagatgctgatttctctcagcacataaacatgctaaaatgtctccactcttttgccctactcaaccctgctttctcttctaacttaacttcttaaatagtagtatagcttcttgtatttattttatcatctatttgcttcttaattccctgtaatctggcttctaccttcacttagactaaaattactgatgtaatttcacgagtagacatttctcaagcatactagataagagagagagggactctggaaccagtttgaatcttggctctcaaatataaataaagcacatagcattattcctggtacacagtaaatgctatgcaagtgtttgcaattactgttattactattattttacttatataatctataacaaagaacaatgctaacctttttttccttaaaaccttcttctataatttctgtaactgtacactctgtgatctcacaatccattctctcttctccatcccattgtcacccatgttttaacaggaactcatcattttttgtatgaaattctgcaagactcctaatttgtctccctgcctgtaggttttcccacttttaagtcatctctacatagcatagccatctttttctagtcaaacttggtcatgttacttctctaattaagaccagattcttcaaaggctatttattccctacagaaaaagtcccaatttcctaaagtgtggaagacccaacttcatctcccactctccatattacctctaatcaatcctctaatttataactaattacttaaaattcctcccccaaattcattctgagttcattatgtctgtgtactatgtacatgctgtttcatgctgtttaatctccttggaataatatttacctgtcagactcctattcatctttaaatactcaacccaggaattatttctacttataaatctcccctaaaaaaactcaaataattgaatactcctctcctttgtgtcactagtcaaacataaaaattatatctggttagctgaaatttctttcaagttcaacttccctgcaggatttgggtgaaagctgttggtaaaaaaataaggagtaaaccttgaaaaacgatgggaatgaagaacacctttccttccagaattatagaaaataaaaagagaaaacagagactaagaaaatgaaggaaagaagagctacattaagcggaggatagcagatgaatgaaaatgtagagtaggtagattatacatcctgtaaaatacaacatgatttacctgtttgcctgttttcttaactagtctgtgagatgttaaagtcaggaaccatgccctgaacagtgcctatcagtgtcaggtacatagtaagtgcttaataaatatttggtaaataaataaataaatttgtttctataatttcagtatatgcctatagaacacattttataaaaacaaaataaaagttattttctggcattataaacaagtaaataacatcttccaccccaaatcaaatatagtccttatatatagcaaatagaaatcatgttttttttttttaacaaaatttagaaatgtcaagttataaatttcacgtctcatccccaaacaaaagtaaattacctatttggccagcaatgacaggaggtctaataactaaaagtatcagtttatctagcagaagatgaagaaatcggaccactggttccagctgggatgaattcagtgctgaaatactgctcttcaattcattttctaagttattttccatgattcgcatgtccccaattcggactgggaacaggtgttcatccagagcattgaccagagcaaaaaatttgtcaagataaggatcctaaaacaaagaataaacaaaagcactaagcacttataactttataaatttcccacttctaaaggaccacggaccacaaacatgtcatattacttgataacactaaaaagttcaagtaggtatacaaacattgtttccaattaaacaaatctattttcatttatcattataaaatgatcacttcaaatactattagttacttaagaaaactgatactaattaagattttttttttttagttttagtttgctttattagtttgaagttcaattattgtggcaggcatattagtaacctacttttgtccattattaatttattgtctttcagctccaaagcctttggatataaggcaaactcatcgccataccttatgatactggcgtcattcttttactggagactacctgtgtagttctaaataaaatctatatactaccaactttcttcctaaagacagcatagaggtgctgtatcttcttcttttcccctacctcactgtgcagaaaagaattaacatagtgggcttaagacagctattctttgaaagtcctgtttacaagtttggccttgggctaatcactgggaacttggatttcaggggggttcccattgacagagatggctcactgtgcctcaaacgtttgtgcaaaacaatatggtataagctgaacacctactttccttctgggaatctggaattttggtacatgttaggcaaagggtgcctacgtgacaagtaaaaaccctgggaattgagtctgtactgaacttctgtggcagacaacatttcacatatgttgtttcaacttgccccatgtgattccactgggagaggatttttggaagcttatttcttgtttcctctggacttcaccccatgagccttttccctttgtgaattctgctttccattctttcactaaaataaatcatagctctgagtatgactatatgctgagtcccgtaagtcctcctagcaaatcactgaacctgagatggctttgggaagtccctccacaccaccctttctgtgtataggttagtgaagccctgaatttcattttaaatacttgcttcttctccctgtacatattctccatggaaaatcacatttaccaatatagtttcagctatcgcatttattctgttacctccaaacccaaacttcaaactaattacaaccacctacaggacatctccatctgaagtacgtaggcacttcaaactcaacaggttcaaaaataaactcacaggcaccataactgcttccccttagcatggccccaaaagtatttctctcatgttctctatttagggtagaaattaccatccacctggactctatggcattcaaggtccttcacaatctattaccagccttctatccttatgtatcatgatttcctacacactttaaactattttcacaccaggtcacctgatggtccttagactactgtaactctgtacttgctactcatcatctgagttgtccactctccctttctctgagtagtaaatggctacttataaatgcaacatctcagtgcctagcaaaacagataactcttccctctgtacttcaaagaatttagttaatatatgtaacactgtactaattttatcatactttttacactttcccatattacactgtaaggttcttgaaggaaaagctctttcctcaacaggtaacatctctcatctcacggaacttatcatctaatgtgggaaagaaacaataaacaaatgtgtatgtatgtgtgttatatacatacacacaaacagaaagagtgacagagtcaaagcgcaacagagaagctgggcgtaggcagtaataagtgcagggtaagatgacatacagtaatgaggttgctatgttttaaagagtaaccatggaaggcctctctgaggggaagagaaactccaattcataagtcaaatgaataccaggaggaaaagcattccaggcagagaaagaggatgtataaaacctatcagaacttggtatattccaaaaataaggaatttggaacaaatgatccctaaaaactctttccatttgaaatactcaagtctatgagaaataaagtgagctgatgatggtttctcaattctaattaattctgccatgtaccagaaacttagaaaaaacatgaagtcaatgacattttgaaacaaaaatgtttgcttttgttgacattcaatgacattttgttgattctttttaaaaaaatcttctaaatattgtatgtttttaactgacatatattctcataaatctgacagcaatgacagatttatgacaggtaacaaaactgacatcacaagtattagatattacgttcaatttatttaagtgaaatttgataataaaaattattaaaactcacttgtgtatggatagacgaaacagcaacaacttcaacattaaaaacacctttgtgattatctacccatttcatgccaggtagaggaacctgtaagatattaaatataatgatcacagatgcttaagtagattatgaactctgaaaataaacaaaaattacaatatcccaatgagaaaaatattgtgaaaatatatttttattcactgtaaataaattaagaacttttatatttcattcttatttcaaaatcaagcaatgttttctacaaaagaactaaaagtctccaggagcaacaagcataaaataatgcacacaaaatttctatcttcccagagatatacccccttatatcattctaaaccttcatatatgtacatatatgtacatatatatgtacatatatttttatacacatttgtatatacttaacaccaaacattattttgaaatctgtttttcatttattacattgtgaatctcttttcatgtcaataaattcaaatttacaatatcattttaatggcctctaatatttcattttaaacatttctattatattttaattgggtcttaaaatatttgcaagcaaaagcctgttggtttaaggatccaaaaacttttttttttttttttgaaatagagtctcgctctgtcacccaggccggagtgcagtggcatgatttcagctcactgcaatctccacctcccaggttcaaaggattctcctgcctcagcctcccgaataactgggacacgcccagctaatttttgtatttttagtagagacagagtttcaccatgttggccaggctggccttgaactcttgacctcaggtgatctgcttgccttggcctcccaaggtgctgggattacaagcgtaagccaccatgccaggccgaaaacattttttcagaagtaaattgctaggaatgtcaaagttatttcataaaaaataacttttaaaagtacataaattctctctattcctcctgctaagtacagctaaaaactctgaaacctgatatataaatgaacataaagactgaaaggtagagagaaaaaagatgataggctagagatctcaggatgcaagaaacgacaaagcagcatttcctgggttttacttttgcctcacatatcctggactgagtgctagagaggatggcaacccagaaacgccaaaagaagtggagaaacaaagccccaagaaaagcctgctctctctggccaaagaaataatattccagctagttacaagggaacaaatcctggccccactctcgcctccctacactgaatggagagcctaggcagccacccttagcagcctgaaatgaggtacccctctccccaactcatgctacacacattgaggtgctatcaaagaagacagagttgagaatctgtcccttgcctggtgatagcaagcccccaaccaacagaggtgacagtggaggccatgtggagcagtaacaaggtgcccccctccctcacaaccaggaaggggtcagcaaaggcctagtggagagcttgaaattccaccttcacccagtaacgagccccctcactggatccaccctagaaagtaaaaggaggcagagtgggtaatgtggaccttcacctctacctgacagcagcacctccagcccccactgctacaacagaatatttcagtaagatctagagtcgcatggtaactataatgtcctggatgtaattaaaaattattcatcatatcaactaggaaactctcaactgaaatgagaaaagacaatcatcagacaccaatactaagatgacatagatgctagatagacccgacaaggattttaaagcaggtatcattaaaaatgtttcaaaaagcaattatgaatgtcttttaaacaaatgaaaaaagactcaccaaaacaaacaaacaaaaaaacagaaaaatacaagagatttctttcctatggttttatcattttttatcatgtatagaaaataaaaccaaataaattcaaatccccattaccaaatttcaacactaattagataagaaattcaatatctatgacaggatcaaattcacacacaacaatgttaactccgaatgtaaacgggctaaatgcctcaattaaaagacacagactggcaaactggataaagagtcaagacccatcactgtgctgtattcaggagacccacctcatggccaaaggcacacataggctcaaaataaagggatggaggaatatttaccaagcaaaaaaaaaaaaaaaaaaaaaaaaaaaaaaaaaaaaaaaaaggcaggcgttgtaatcctagtctctgataaaactgactttaaaccaacaaagatcaacagagacaaagaagggcattacataatggtaaagggatcaatgcaataacaagagctaactaacctaaatatatatgcacccaatagaagagcacccagattcataaagcaagttattagagacctacaaagacacttagactcccacacaataacggtgggagactttaacaccccactgtcaatattagatcaacaagacagaaaattaacaagggtattcaggacctgaactcagctctggaccaagcggacctaatagacatctacggaactctccacaacaaatcaacagaatatacattcttctcagcacctcatcacacttattctaaaattgaccacataatttgaagtaaaacactcctcagaaaaggcaaaagaaaggaaatcataacagtctctcagaccacagtgcaatcaaattagaactcaggattaagaaactcactcaactacatggaaactgaacaacttgctcctgaatgactactgggtaaataatgaaaggaaggcagaaatagatgttccttgaaaccaatgagaacaaagacacaacgtaccagaatctctgggacacatttaaagcagtgtggagagggaaatttatagcactaaatgaccacaagagaaagcaggaaagatctaaaattgacaccctaacatcacaattaaaagaactagagaagcaagagtaaataaagtcaaaagctagcagaagacaagaaataactaagatcagagcagaactgaaggagatagagtcatgaaaaacccttcaaaaaaatcaatgaatccaggagctggtttttggaaaagatcaacaaaatagaccacaagccagactaataaagaacaaaagagagatgaatcaaatagatgcaataaaaaacgataaaggggatatcaccactgatccaacagaaatacaaaatgccatcagggaatactataaacacctctatgcaaataaactagaaaatctagaagaaatgaataaattcctggatacatacaccctcccaagtctaaaccaggaagaagtcgaatccctgaagagaccaatattcaagttctgaaactgaggcagtaattaatagcctaccaacaaaaaaagtccaggaccagaaggattcatagctgaattctaccagaggtgcaaagaaaagctggtaccattccttctgaaactattccaaacaacagaaaaagagggactcctccctaactcattttatgaggccagcatcatcctgataccaaaacctggcagagacacaacaaaaaaagaattttcttttcaaaagaaaagaaaatatccctgatcaacatcgatgtgaaaatcctcaataaaatactggcaaaccgaatgcagcagcacaccaaaaagcttatccaccacgatcaagtcagcttcatccctgggatgcaaggttggttcaacatacgcaaataaataaacgtaatccatcacataaacagaaccaatgacaaaaaccacatgattatctcaatagatgcagagaaggccttcaacaaaattcaacaccccttcatgctaaaaactctcaataaactaggtattgatggaacatatctcaaaataataagagctatttaagacaaacccacagccaataccatactgaataggcgaaaactggaagcatcccctttgaaaactggcacaagacaaggatgccctctctcaccactcctattcaacacagtattggaagttctggctagggcaatcaggcaagagaaagaaataaaggtattcaaataggaaaagaggaagtcaaattgtctctgcagatgacatgattgtatttttagaaaaccccattgtctcagcccaaaatctccttaagctgataagcaacttcagcaaagtctcaggatacaaaatcaatgtgcaaaaatcacaagcattcctatacaccaataacaggcagagagccaaatcatgagtgaactcccattcacaattgctacaaagagaataaaatacccaggaatacaatttacaaggggtatgaaggacctcttcaaggagaactacacattactgctcaaggaaataagaaaggacacaaataaatggaaaaacattccatgctcatggataggaagaatcagtatcaggaaaatggccatactgcccaaagtaatttacagattcaatgccatccccatcaagctaccattgactttcttcagagaactggaaaaactaaacttcacatggaaccaaaaaagagcccacagagccaagacaatcataagcaaaaagaacaaagctggaggcatcacactacctgacttcaaactacactacgaggctacagtaaccaaaacagcatggtactggtaccaaaacagatatatagaccaaggaaacagaacagaggcctcagaaataacgccacacatctacaaccatatgatctttgacaaatctgacaaaaacaagcaatggggaaaggattccctatttgataaatggtgttgggaaaactggctagtcatatgcagaacactgaaactggacccttccttacaccttaaacaaaaattaactcaggatggattaaaaacttaaacataagacctaacaccataaaaatcctagaagaaaacctaggcaataccattcaggacataggcatgagcaaacacttcatgtctaaaacaccaaaagcaatggcaacaaaagccaaaattgacaaatgggatctaattaaactaaagagcttctgcacagcaaaagaaactatcatcagagtgaacaagcaacctacaaaatgggagaaaatttttgcaatctatctatctgacaaagggctaataaccagaactacaaagaacttaaataaattcacaagaaaaaaataaataatcccatcaaaaagttggcaaaggttatgaacagacacttctcaaaagaagacatttatgcagccaagagacacatgaaaaaatgctcatcatcactgatcaatagagaaatgcaaaatcaaaaccacaatgagataccatctcacaccagttagaatggcgatcattaaaaagtcagaaagcaacagatgctggacaggatgtggagaaacaggaacacttttgcactgttggtgggagtgtaaattagttcaaccattgtggaaggcagtgtggtgattcctcaaggatctagaactacaaatactatttgaccctgcaatcccattactgggtatatacccaaagaattataaattattctactataaagacacatacacacatatgtttactgcggcactattcacaagagcaaagacttggaaccaacccaaatgcccatcaatgatagactggagaaagaaaatgtggcacatatacaccatggaatactatgcagccataaaaaaggatgagttcatgtcctttgcagggacatggatgaaactggaaaccatcatactcagcaaactaactcaagaacagaaaaccaaacaccacatgttctcactcataagtgggagctgaacaatgagaacacatagacacagggaggggaacatcacacactggggcctgttggggggtggagggctaggggagggacagcactaggagaaatacctaatgtaggtgacaggtttatgggtgcaataaacctccatggcacatgtatatctatgtaacaaaactacacgttctgcacatgtaccccagaacttaaagtatcataaaaataaataaataaaaagaaattcaacatctctgaggcaaaaaataaagattctgaaacatttttgaaaaaaaaaaagccagcagagtaagttgaaacccatcaaagcaataaacactattagctctttcaatctaaaacacttgttttcagcttttaaaaatttctttaaaaataacagttctcttcagttctaaaacaagtggacctgatagatatctacagaactctccatcccaaaacaacagaatatacaatcttctcagtgtcacattgcatttagtctaaaactgatcacataattggaagtaaaacactcctcagcaaatgcaaaataactgaaataataacaaacagtctctcagaccacagagaaattaaattagaactcaaagaaactcactcaaaaccacacaactacacggaaattgcacaattgctcctgaatgactgttgggtaaataatgaaattagggcagaaatcaagaagttctttgaaaccaatgagaacaaaaagacaatgtaccagaatctctgggatgcagctaaagcagtgttaacagggaaatttatagcactaaaatgcccacattaaaaagctagaaagatttttttttttttttgagacagagtctcgctgtcacctagactggagtgcagtggcacgatctcagctcactgcaacctctgcctcctaggttcaagtgattctcctgcctcagtctcctgagtagctggcattacaggcacgtgccaccatgccaggctaattttttttttttttttaagtaaagatgagatttcaccatgttggccaggctggtctcaaactcctgacctcaagtaatccccctgccacagcattccaacgtgcttggattgcaggcgtgagccactgtgccctgcctaaaaaaaaaaaaaaaaaaaaaaagctaggaagatctcaaagtgaaatcctaacatcacaactaaaagaactagagaaccaccaccaacaacaacaaaaaacccaaagctagcagaagacaagaaataaccaagatcagagcagaagtgaaggaaacagagacacaaaaaacccttcaaaaaattaacagatccagaagctgtttttttttttgaaaaaattaataaaatagactgctagctagattaataaagaaggaaaaagagaagaatcaaatagacacaataaaaaatgataaaggggataccaccactgaccccacagaaatacaaacgaccatcagagaatgtactacaaacacctctctgcaagtaagttagaaaatctagaagaaatagataaattcctggacatatacatcctcccaagactgaaccaggaagttgaatccctgaatagaccaataacaagttctgaaaatgagggagtaataaatagcctaccaaccaaaaaagcccaggatcagatggatttacagctaaattctaccagagatacaaagagagctggtaccatttcctctaaaactattccaaacaactgcaaaggactcctccctaactcattttatgaggtcagcatcatcctgataccaaaccctggcaaagaaagaacaacgaaaaaagaaggcttcaggccaatatccctaatgaacatcaatgcaaaaatcctcaataaaatactggcaaaccaaatctggcagcacatcaaaaagcttatcaccatgatcaagtaggcttcaaccccgagatgcaaggctggttcaacacacgcaaatcaataaacgtaatccgtcacataaacagaactaaagacaaaaaccacattattacctcaataggctcagaaaaggtctttgataaaattcagtatcgcttcatgttaaaactcccaataaactaggtattgaaggaacatacctcaaaatagtaagagccatttatgaaaaacccacagccaatatcatactgaatgggcaaaagctgaaaacattccccttgaagactggcacaaaacaaggatgccctctctcaccactctcccccctcccccccccctttttttttgagacagagtctcactctgtcactcaggctagagtgcagtggtacgacctcagctcactgcaacctccacctcctgggttcaagcaattcttccacctcagcctctctagtagctgggattacaggcacatgccaccacgtctggctaatttttgtatctttagtagagacggggtttcactatgttggccaggctggtcttgaacttctgatctcaagtgatttgcctgccttggcctcctaaagtgctgggattataggcatgggccactgcgtccagccaccactcctattcaacatagtattagaagttttggccagggcaatcagacaagagaaagaaataaaggtatttaaataggatgagaagaagtcaaattgtcttggtttgcagatgacatgatcctctatctagaaaaacccactgtctcagcccaaaagcttcttaagctgataagcaacttcagcaaagtctcaggatacaaaatcaatgtgcaaaaatcacaagcattcttatacaccaacaacagacaagaaaagagtcaaatcatgaatgaactcccatttataattgctacaaagagaatgaaatacccaggaatacagctaacaagaaaagtgaaggacctcttcaaggagaactacaaaccactgctcaaggaaatcagagaggacacaaacaaatggaaaaacattccatgctcatggataggaagaatcaatatcgtgaaaatggccatactgcccaaagtaatttatacattcaatgctattcccatataaccactgtagacattcttcacagaactattttaaaaagctattttaaaattcacatggaaccaaaaaaaggcccatacagccaagacaattctaaacaaaaagaacaaacctggaggcatcacgctacccaacttcaaactatactgaaagggtacaataaccaaaacagcatggtgctagtacaaaaacagacacatagaccaatggaacagaatagagaacttagaaataagaccaaacacctacaaccatctgatcttcaacaaacctgacaaaaacaagcaatgggtgaaggattccctatttaataaatggtgctgtgagaactggctagccatatgcagaaaactgagactagaccccttccttacaccttatacaaaaattaactcaagacgattaaagacttaaatgtaaaaccccaaactatacaaaccctagaagaaaatctaggcaacaccattcaggacacaggcacaagcaaagatttcatgacaaaaacatcaaaagcaattccaacaaaagcaaaaattgacaaatgggatctaaataaactaaagagcttctgcactgcaaaagaaactatcatcagagtgaacagacaacctacacgatgggagagaaattttgcaacctatccatctgacaaaggtgtaatatccagagtctacaaggaacttaaacaaatttacaagaaaaaaacaaccccattaaacagtgggcaaaggacatgatcagaaacttctcaaaagaagacattcatgtggccaacaaacatacgaaaaaaagctcagtatcactgatcatcagataaatgcaaatcaaaaccacaatgagataccatctcacaccactcagaatggcaattattataaagtcaagaaacaacagatgctggtgaagctgtagagagataggaacacttttacactgttggtgggagggtaaattagttcaataattgtggaaaacattgtggagattcctcaaagacctagaaccagaaataccattcgaaccagcaatctcattactgggtatatacccaaaggaatagaaatcattctattataaagacacatgcatgtgtatgttcattgcagcactattcacaatagcaaagacattgaatcaacccaaatgcccatcaatgatagactggataaagaaaatgtggtacatatacaccgtggaatactacgcagcaataaaaaggaatgagatcatgttctctgcaggaacatggatggagctggaagccattatcctgaacaaactaatgcaggaacagaaaaccaaacactggatgttctcactcataagtgggagctgaacaataagaacacatggacacagggaaggaaacaatacacactggggcctgtcgttggggggagtgtggggaagggagagcatcaggaaaaatagctaatgcatgctgggcttaatacttaggtgatgggttgataggtgcggcaaatcaccatggcacatgtttacctatgtaacaaacctgcacatcctgcacatgtactccagaacttaaaaataaataaaaaataacagttctcaaagtctggtctgagaatcagcagcacaaacattatctgaaaactgttagacatgtaaatactcaagccccaacctagatcggctgtcacaaaaactcgggaaataaggtccaacaatcagtgttacaacaaaccctctaggtaatttcgattcatgctaaagtgaaaaatgtattttatcttaaaatattctaataagcaatggcaatagcaatggtgtaatagtagcaaacacttccgtagcactttccaagtgcctggcactattccaaatgctctccatgttattatatcattcaatcatcaatacaaccaattactgtaagtcttaattattctcattttacagatgaaaaaactgaggcacagaaagtgtcttagtcacctcaggctgccataacaaagtaccataaacaggtgacttaaacagcagatatttattttctcacagttctggagactgaaagtctaagatcaaggtgccagcatggtcagtttctggtgagggttctcaccctgggttgcagatggccaccttcttgcaactgggggagaggggatgtcaagctctctggtctcttcttacaagggcactaatccaattatgaaggccccacccttataaccttgtctaaacccaattcccttccaaagactccatctcaaaatgccatcacattgagggttaggcttcaacatatgattttttggggggaaacaatctgttccatagcagagagattaagaaacttgcccagggtcacacaattaagtgttggagccaggattaaagccttagaagattatgctctattgccgttcaaaagcatatagatttttaaaaaaataacaaaaatcccttcataatcgcacacctcttctgagagctaactttgctaaatttggtatataaattattcctacacaattacctacatacagagttggattgtggctatgttgttcagtaaataaaacagaattaaaaagaaacagagtgtgtatcagtagcatggaggagggaaaggttgcaaattcatgcagtgaagaaagacttctttgaggaaatgctgctgtgtctacaattttaataaagaaaaagactcagctatgtcaagatcaagaaaagaaaagagaaaattcaaagggctggaggcagaaaaaagcttggaagaagctgtcagtgcagagagaaagggatgtagtaatgattgtagacgatgatgctggagaagtggaaaagaccaaatcattcagagatttgtaggtcatgtgaaaaaatacttggattatgtctatgtgcaagaaaaagccagagaaatgttttatttgatcataagcaatagaatgaaaccacctaattttaattttaaaattgctttattttgtgagaatggatttcaaagaggtaagaactgaataatattataaagcagagaaagtgaatgaaataggaactacatatagcagaaacactaaatcttagtaaaacaatgccataagctttttgttaaattcataaaataaagtaaataatatcatattttggcatacaaatacttcattttaaaagtaattttaaaaggcttgttttcaggacactgtgaatatacttaaggctacagaaatgtacacttaaaattaaaatgataaactttatgttctatacattttttaccataatatttttatttatttatttattttgaagagacaggttcttgttcagtcacccaggctggagtgcagtggtgcaatcaaggttcactgtaaactcgaactcctgctcccacctcagccttccaaagcactgggattataggtatgagtcaccatgccaagcatttttaccataatttttaaaaatcctaattttatacagttacaaggaagaagagtatggaaaaggggaggagtcaggaagtaccttggctgtaaggaacggcattttgaagttattttgatattagacaatgccactggccacccagaaccccatgagttcaacacagaaggcatcagagtcttctacctgcccctaaatgccatgtttctaattcagcctctagattgggagtcacaaggatctttaagattcatcacacacggtactctacggaaaggagtgtgaatgctatgaagagaaccccaataaatagaacatcattaaagtttggaaggattataccactgaaaatgctatcattgttctaacaaaaaccatcaagcctgaaacaataaattcttgctggagaaaactgtgtccagaggttgtcatgactttacagactttatgacagagccaatcaagaaaatcatgaaataaattgtggatatggcaaaaaggaaaaaaaaaagtgaggggtatagatttccaaggagaaactcacaagctcatagacaccagactggaggaattaatagaagaagacttgatggagatgagtgcttttaaaccagtgccagacattgaggcagcaaacatagaagaaacagtgtcagaaaacaaactgacattatacaacatggcagaagggttattcaagactgcttttgacttcttttaaaacatggacccatctgtgctaagggcactaaaactaaaacaaacgaataaagattggcaccacatagaaatattttttttcttttttttatattgagacagagtctcactctgccgcccaggctggagtgcagtggcacaatctcggcttactgtcaacctctgcctcccgggttcaagcgattctcacgcctcagcctcacaagtagctggaattacaggtgcctgccaccacacctggctaattttttgtatttttagtagagaaggagttttgccatgttagccctgatgttcttgaactgctgacctcaggtgatctgcccacctcggcctcccaaagtgctgggattacaggcatgagccaccacacctggccagaaacactttcttaaaagagatggggtcttgctatgtttcccaggctggagggcactggctagtcaaaggcacaaccacagcaaagtgcagcctcgaactccagaactcgagtgatcctctcaagaagctgggattacaggtgtgccactgcatcctgctctggaaatatttttagaggaatgaaaaagcaaaaatgtcagacagaaattatgatgtatttctgtaaagttacaccaagtgtgcctgcttccccttccacctcttctgcctctgctacctctaagatagcaagaccaatccctactcttcctcctcctcctcagcctacccatcatgaagacaatgaggatgaaggccttgatgacgatccacttctacttagtgatagtaaatatattttctgtgccttatgattttcttaagaacattttctttcctctatatcactttaagaatatggtatataatacatttaacatacgaaatacatgctaattaactgtttatgttactggtaaggctttcagtcaacagtaagctattatattagcagttaagtttttagggagtcaaaagttatacgtggatttttcaagtgcatgctagggaggagggatgtcaccccttactgccatgttgtttaagggtcaactgtttacaaaagttttggctcttaatcaggtggcttatttcacatatcaagcagctatattatatgtctacagtcaaatccaaattatcaccatattcttgatctgtgagcatatacagtatggtagctagaagaaaatcatgagtctccctttagaaagctgaacttgcactgcaattaagtaaaaacaaatccttaacttcaacaaaaatatattttcttttaaaacatctcctttgaaacataatgctctctgacaaatggccacctttctatataacaaagtcacatgaaaaagtcatcactgaaaagatgtgtccctggaaaaatgaatgaaagattgggaggagggagagtcatatttcttactctactgtctttattcattaatctaataagtatatattgagtgtctatgatgtgccaagtactgttctaaatacttgtagacagcaatgagcaagacagacaaagttcctaccctcatagtgtttatactctatagagaataaataagcaaaaaacattttaaatacaaagtcaatgataaatgacatgaggaaaaataaagagataaagtgggagaggctgctatttagaataatcatagatgacttccttggtgaggtgatatttgagtagaggtctgagtaaaatgaagaaccaggctttgtgatagagcactgccagcagagggaagagcaaagggcctgaaatgcaaatgcacttttcgtgtgtaaggaacagcagaggctctgtgctatgtggctatcaaaagtgagtgacagagaacagtgagaaataagatcagagcaatagccttgaattgttttttaaaaataaaaatacataaaaatttatttgtgaatacattttgaattgtattctgaaaacaaatagcaccaggaaaatattcacaaaacgtattttagagtaacatttaccagcagttatattcaaaatcattaagagacactgacaaccattgtgtttctctcaagaggaactttggtttatgaacggtggctattgattcttgattgagatttttccaatatttgtgttacaagtctttcaaatcccatatgtaatcatcaaagttgccaatatctcatgtattacaggttcacagctactttgttttcattcacatgatcttcaattacaaaaagattctaaaaaattaatttaaatctgttttccttcctccagtcttttagtgaaatgttaagtctactaaaaataaaaaagaaatattcatttatttaaagaagtttctcaagttacagtatgaaaattctccaaaatgatcttttgagtttacattccatgtattattttggttttaaaatgaggatatttacatttaaaatgaaatttaaatttaaatttaaaaacaggataaaagcttttaagttttatgtaaaagaattttaaccacgggagaaaatacttttccttcattatctataaactttaagtagaagaaatggcaagagtttgcttggtaaaaacatctttatagtaaaaaacccatttcattcaatctggagaaagtcaacatgggagacactgacctcaggagacagtacagaataagcctgtggtggtttttccaatgagactggcaagcaaaactggccagtcttcaaccgtccattctgaagcattggtatccacttttaaatgaaaagaaaacaattttattttaaatatgcttgctataaaaataattacttagcatgttttaagaacttggtacaagccaaatttgtcccatatcatcaaacattaagggatttaattatacaagtaataataataataggccttcataatccctctaaagagaagtttccctaatgaaattttattaaggaggatatcaccaaaacattattattactaaccatgcaatattaaaatctagaggcaaaaagttggtcttagaaaaaagccatgaagtaaatccattttaaaactgagataatcatttcaatgtaaatagtgaaagaaataattgattgagacaggaatgatagaaacaaaaagtatgatcataaatttattttcttacagttagagcaaaactcatgtcacaaactgcaagagacaaaaataatgaatcaaatgttggcttttctcttctggctgaaagcataatttttctgacagaactgtgttataccatgacttccttcatcttaggtttatctttgcaattcaaccatagtaattttttttttctttttttttgagacaagagtctcactccatcgcccaggccagagtgcaatggcatgatcttggctcactgcaacctctgcctcccgggctcaagcaatcctcccatctcagcctccctagcagctgggatcacaggtgcacgacaccacgcctagctaatttttgtatttttggtagagatggggttatgccaagctggaaagcataattttgaaaaatactcaagggttttaatttattctccaatagtctcttttactcattttatataaaatcattatctgctgaagagtctatgaacctattatatttatactgcattgttgggtatacacctaataatcaggaccaacacccaagtgtttatacgtgttagtcaataaatcaattaattacattagttaattacattaatgggcattttcttgttataatggctcttcctaatcaatgcaacttcataactgtggggaatcagacaagaaatatttaaataacaagaaacaggccaggcgccatggctcacgcctgtaatcctagcactttgggaggccgaggcaggcagatcacttgaagccaagagtttgagaccaacttggcaaacatggtgaaaccccatctctactaaaaatacaaaaaaattagttggacatggtggcgggcacctgtaatcccagctattcaggaggctgaggcaggaaaactgcttgaacccaggaaacggaggttgcagtgagccaagatcgcgccactgcactccagcctgggagacagagactctgtctcaaaaaaaaaaaaaaaaaaaaaacccacaaatgaccagaaatatcaattatatcttaaatatcaccattattttagctctttgatctaaatattgaaccaaaaggactcactgtatatccaactggtgtttcaagaggagtattttgtttttgttgacaactaacatgataaaaagtaaaaagcaagtgatgatggtcagttaaagtagcaggaagcttaaccttgatttcttcatgaaaatcaggagaccttcatacaaaaaaaaaaaaaaatcaacagtcagtaatttgtccaaaataaataatgtatttgtatatttgaataattttaaaattttaagattcatgtttaatttttcctctagtccaaaatatttttctttatccccaatctctaaataactaaatcttacttccatataagagagctgccactgtttctgaaatttctcatcccaattttcttaatgggctgagtaatcctactatttaaaagttcattaataatcaccactttgatcctgagatctccattagattggaagctgcataaaagaggacactaaggtagggagttctctatttatgagccaattctgataaacattacataaaacatttttccttcataggagaatgctttcatattaaaactaatgtttatcatccttttgtaaaaaaatgggaaaaaaggcatctttagacaacttaatatcaaaatatcacattggaggccaggtgtagtggctcacacctgtaatcccagcactttgggaggctgtggcgtcaggatcacttggagtcaggagtttgagaccagtctgcacaacatagccagactcatctctacaaaaaatttaaaaaagtcctagctacttgggaggccgagatgagaggatcacttgagtccaggagttcaaggctgcagtgagctatgatcctgccactgcactctggcctaggtgacagagtgagaccgaaaaaaaaaaaaaaaaaaaaaagatcaagttttgctctatagactgtcttatatcaaccatctcactgttgaagaaataaaaaaagttacctaaatcctaaatatggactagaattgaccactaaaacaaacaaaaaaaaccagtaaaatcaggaaacgcccacaaactgcatttgcctcagtttagaagcgcttccagactcttaagaatacatcaaatatcttgtttgaccaaaccaatgacactttcttctcaatattcattgagaataatcccaagagggcacttttatagaaaagcacggctgctattcataacaaaaagggataaaaccttagcatcccaaccttccatattcagtgagtatctctcagaattacattcaacaaaaatgcaaccaaaccatattgctccaactatctttaaagcgaggtctgtcccaccaatcaggttttcttccttagatgttaataggtcaaatatccttctatctcaaataagcctcaaaaacattaacaggtatagacttgaacacaggaatattaagtagaacaaggcttttgataataaacaagaaagatagctaatgttagccatctgagaacttgatgacttcagtgaaaaaaaataagacactaggcatcttattaccaatcccaccaaatcaccactgaattatgagaaagttgagtttaccaacaatgtcagatggcatagtcattttaattccactaatgctgagaacaaaaataaagacctagcaataaaatgagataatttttagaaattactatcttccttatcaatatatttcttggtattcagtgttttagttcacttctgtcctaaaaatcatgtaatgtgaagacttttgttgaaaattaaatatctaagagagttattcattcaataagtaggtttaattgcccacctttggctaaacattgcattacttttgtggtggttttaaagatgaagattaaaaaaaaacttccctcaaaaactaggcaacagcaggaatataagtaagacacatatatatcaatagctatgctataaaacaggggttggcaaactatggcctatgagctaaaaatagttcactgcctggttttgtatagcctgcaaactaagaatggtttttacatttttaaatgattgggggtaaaaaagaataatatttcacaacatgtgaaaataatatgaaattcaaatttcaatgtccatgaataaagctttattggaacacagctacacccatttacttgtaacatgacttactgcctatggctgtttttgcactataatggcatagatgaatggctgcaagagagaccatataaccacaggcctaaaatatataccatccagtcctttgtagaaaatttttgccgacccctggtatacagcatatagggttatgtgcttcaaaaacagagctgaacagattacttcaagtttgagatcagggaattgtaacttaggaggtaatatttgatatggaccttgaagaatgagtaggagttcaataagtaaagggatttggtattataatagaaaaaaaaccaagaatggcccagaaacaggacagcacaggttatgtttagtaataaagcagaaaagaaatcagcaagacttaacagatgattgaatattagagaagaggaaagacaaagatgtcttaaattttgcgccagagtaactggaaaatggtggtatcattaataaaaatggagagtaagaaagacatagggtcaggacaagagtcaaggatagatatatgaacacagagaagacagcagggcatccaaatgagtatgtccagtaggccactaaaaatatatatctgtacttcagaaggaaggtattactaaaaatagagttggaaacaatccacataaatattaaagcagtagcattttcactgaatgtaactctgagagatacatgtacgattatttaagaaaacaatatattaagaatgagggttaagggcaaaacgttagtgttttgtgtggaatgccttacacttacgggaaaaagaatactacagaaaaaaaaaagaagtgttcaaagaggtagaaggaagctcaagacaaggccacaatataaagacaagaaagaagaaagttttaagaagggcaaggaaaatacatactatacaacagcaccaagaaaggactgttgtgtttttaagtatggaaacagaagcttctttttgagaataagagacagagccaatgaagcaggagactaatgctgcaagaaaccggataaatgattgacttatattctggaagaggttaaaaggatcatttgaaagcagaggtgaaaagattcacatttaacagggagtaggccatcactccccttgaaacagaaggaaaggcaaatcagtatagagaatttgagatgaagagtagagaagttgatggaccacgtcaagttggatagtcttgataaataggaatgctgagagtaaagcacatagaaaagaagcaggagctagaagaaactcctgtagctactgctaaatgaaggcaaagtgttaaaacaataagattataaaagaggccgggcgcggtggctcacgcctgtaatcccagcactttgggaggccgaggcgggcggatcacgaggtcaggagatcgagaccatcccggctaaaacggtgaaaacccgtctctactaaaaatacaaaaaattagccgggcgtagtggcgggcgcctgtagtcccagctacttgggaggctgaggcaggagaatggcgtgaacccgggaggcggagcttgcagtaagccgagatcccgccactgcactccagcctgggggacagagcgagactccgtctcaaaaaaaaaaaaaaaaaaaaaaaaaaaaaagattataaaagagctgtgggccccaaaaaaaaaaagataaaatgaattgctgtagccctatcatatgatacaataacatcaatttgtgatagtcctgattagtacaattttgtgatttttccccaacagtattcaataatccccccaaaagaaagaagaaattaaaggttatccaaagttagcaatttcccaaggaagaaaaatgacaagtcactaaatcaaagaattaatggatactggtaacatcaccaatttaactgactaatgtgttcaagcttagtaaagggtaaagttactacaaagtgtcaggtggaaataactgggaaagaccaaaggaccagcggccacaatgataatcaataacaatataataaaaatgaaaggatcagagaattcgatagaaaagatgtttggtgtacaaagtcatatttgggatgtcaatagagaatggctgtgcatccacaggttgaaaattataactctgatgtcagccttgaatttggcacatttagtgcagcaaagcatttggtaaacacactaatgtgagtgctaacaatgccactgagaagtgagtaactttgaaagaaatatttgaattcagtacctgttatgatatactacggctgtataggcttcctttgaaaattctgaacagctagatttaccaaagattacctgaaacaaataacagcatgttgaaactttgttgtagtaaatgctggatgtttcataactatgtaagaatttgtctgatttaataactatttgagaaaaatgggcaaaatcagcccaatgaagaacaatgtgcctactgacgttcatcaaaaagttcaattgcttaactataagtttcttttcaacaacagacccatctgacatttaaatatttcaaaagtttctatcaattttatttatatctactgggaaattagatacatttctttcctttttcttaaagaaggtgaagaattcacttttaaatcagatgtagcatattatttggaacttatgtaagaaatataaatagtggcataaacctactatacaaattgttggcttcaacactaaaacagcagagtcattctgaaagtcaaatataaattatatatgatatcagaaatcctattttaggtcaagctatgtatcctttgcttctaatatttccttcaagctactctacaatagaggaggagctccattcttatatttttgcatatatatatatttttaatccaccacattaaaaagaatacaatattacttttggaataagtttatagataaagtaattcagccttgtatatctgtctcttgacttctggagtaataacaggaatactgtcgttaatcagagcagctgattagataaatggctcaatgtcaaggttatagctataattcctatgtgagacagacttgcagtgttatctagccagagattaaacttttaaagtctgtatagccatctttacatatgcatgaatagatatgtgaacatgtcagacaattccatcaacacaactggtaaaacaactcaaagtttattatttatataaagagattaattggcatcatccttaattagaagggcatattagcaggtatttctgtttctttttgcaacatttcaagcaggctcttttattttaagggtatgtacaagtgtaataattatgactttcctaagatatatattatttcatcaatttacaaataccttagtatgttttcataaattgttcctgtgccagaattatgaagtttacaattttatcatgtcaatattacattatcaaaaagttatcttaggacccatttaaacagccctttttttaaaaaaggcaaacacagtatgtctatgtttatatactctttcaaatcagccatttcatacataaaaacattgtattttcatatgactaataacacacaagtaaaagaaatgcaataccttttttccctctgagaagctatcacttttcacaaaataacttgtttattttcataatatgacataaagcagacagtgttccttttttgaccatttgacatgtacttttaatcatttagcaatatggattgagcattaattatttatccaaaaatgtgacaggagtcaagatatagacatgagtaagacatcgtccctgccctcaaggagctcacaatctaatgggtgaaattaagaaatatagaatcatcaagtgataaagtcccatgaaagaagtgagaagatgctatggtagcaccaaagagggagaggtctaactgtcggtataggatgggtgcagctggggctctgtagaggaggccacatatatgataagacaaggaagagtttgttaggtaaacaataaaaaatagattattctacatatattacatttgtcgtatgctcaaattcatatggcaactcacacataggctgaccaagtatctattttcacaatctagtatcttttcatcaactatcatagtacattcattccttcagcagaaatgaactagtataaaacatgaaatgtgaattccaaatctcaaaaataaattctacaattattcaacaaatatttattcagtatgtattatatgcaataatctgaaaaaaatgccatacgagaatacaaagatgaataatttgtgctcactgttgtcaaggatatctacaaatgttgatgtaactgaggcaatagggtagatgaaaatgtatctttcccagtatgtggaaaatcagaagaacttcattaaaagatggacatggaaggataaaataagactattaacaatgcacctattcttaggtcattttcatcccactagggttctcagaggttgagaatctatagcaatagcatatttctattccatatgttactgacttcagctgagccaaaaattcactctcatgaaacttgcatttattagtgtcccacaaatcctgaatgacaatttggacagtcaagaatctctagtctggtctcaatctactatttctgatttttcttccagtgctctggttccctggcaactcaccactgtcattactgttcacaggcattccccaacttgaaatgctttcctttccctgctctccaaacacactgctattaacattttaatgacctttggtttcagcacaaaagtaccttttccatgagatgcctgttacctcagtaaggcattatctcccacctctgaatacctacctattcctttgaatccctataccaatcttctaataattagcacatagcttgattctcaacattgtctgcaaaatgtaatccctggtgagacttaaaaatactgaaacctggtccaatccccatacattatgatttaagtgagattcagcctgagcactggtagtttgaaaagcttcccaggtgaatctaatgtgcagccaagattgagaactaatgccagagtttgtcaaccaaggtaggaaaagccatacatattaaaatcacccacggagcattttcaaactataacacagcctcatataccacacatcacttcccacctccttagctggccttacattctaaagggagttgaggagaataagaatcacagacgccaaaagtacagaaaagatatctctactttgatagagttctctaggtgatctaaccctcttttgaaaatcactattttagatttatatgtattcattttatatcctctggattacaagtcttattcatctttgtatttctaggagtgcctaacatataccaagtcttcaaaaataagttagtcttcaagtaatgtcattactatctatacagaaagtaatgcagttagaaatttggtttaaaagatcacattaatttccaggttgcagttgccaaccaaagagaaagaaaaaagtctatttgaacttaatacaaaaaattagaaaagtaaaagaacatttcttaccggcatggcattgcttggatcctctccatacataaactggactttcactgttatatttctagcagaaccttgacgattggcaaaattaagactctgagggtatatgtagagaagatttctgtgaaagcaacagtatagatgatagtaaatacatatctaagaaacactatgtatcactcacaaaataccacaaaataagtgaccaaatactgaattactgatattggctagcaattatgctaagtattttcacatgtgacgttttatttactcctgagagcaatcattcaaatacacagcaataaaacatgtcccaattttgcagataaattgagattcagaaaagttaactgatttttgcatataaccaagtgagtgacaaagctgaaatcagagtaaaggtcagtcagacttcaaaactcattatcttcactctacaagaggcttctggaataaatgaatatggactgacacattattaagttaaaaaaatagttctaatattatcttagttcctccaagcacatataaataggatgacatttataaatgtggcttttgtataaatgtgattaagaatttaagaggtataatattccacattatttttcaaaaacacattacaatatgatggatataatagagttaggtagttactacaaaacaataacatcctaatttgcatttatttgaattcttgtccagctcatcatctctatcatagacaaactttaatagtccttgctgccaacacacagaagagaaataattcaagaaaagacaccaaatagctaaaaaaaaaaaaaaaaaaaaaaaagaatcaagagttactttacctgaagactagcgtttagagccaatgaacaagacgtttagtataatagaaccttgctaatcaactgctggggcaatgaaaacaggtctaaattttctgaagagtggtagggcaatatagaaattttaaatgaacataacactttgacccaacaaacacacctctaacctaaggagaaaactgtacacatgtgcaaatgattgtgttcaaagtaattcattacaacatttttgataagagaatgattacacaaaattataaagaaacacaacgtttatcagtactgagttggttaattaagataccttaataagaaggaatatcatgtatccccaaacaatgtacagccatatttattgatgtggaaagagatacctagcatgttgaatgggatatacagtgaggaagaagcaggttccagagcaggatgtatagtaacattaccctatttgtggaaaactctgtgtgggggtgtgggggaaggtagagagacagagtggataaaattatatttctaaaaactaataatgatggctgggcttgagtgtgttttagttaatagtaatggttttctttttttatactttacaattttacagtgaaaatatatgatctttacaattagaaaaagcaataaagtaattgccatgccagaggatgggaatgtctttgacaataagcacaccaactagaagtactaaaaaaagaagaagaatcagttgtgctcaaaatagtcaaaacatataaaaggcaaatacagaactgttatgactggtcagcttgctagtctaaaaaacttaagatcaaagatgactatgactgaccaaccactgaaatcatccagtaaaatttataaagaaaacatttgctgattgctccaacaaatgtcaggcattgtgttgggcactagaaaaataaataggaagattaagaagtcattccctggtcttgaggaacatagtataatgggataaaaatgcctatacacagaccacttcaaaacaacacagtgttacaagacaggcatgcaaaagccctataggaggaaaaaataggtacctagctgtctgtggggaagtcttttcatttataagatcccccatcttttctagccttgtgatttatttgttgaagaaagtgaagtttctctgtagattttccagagcctagattttactgattgcacccctgtagtgtcatttgagatgttcttctgtggtttttgtaaattgagaattgaatctagcgccttagtcatatttaggttagaatttttttcaggaagatcactttataaaggataatgtgttattttttcaggaaatgtttggttgcttccttctatgaaattagtagacgatgatcaatgcctaaatccattatttttttaatttttaaaatttatttatttttttaagagacaaggtctcactctgtcgctcaggctgaagtgcagtggtacgatcatacctcactgcagccttgaactcctggcctaaaatgatccttctgcctcagcctcctacgtagctgggactacaggcacgtgccatcacactgggctaatttttctatttttttgtagagatggagtcttactatgttgcccaggctggtcttatattcctgggctcaagtgattctcccatcttggcctcccaaaatgctgggataacaggcacaagccacagtccccagcccacctaaatccattaattaattaaggttgccaaacggtaatatcctgtcatttctttttaattttgcatctggagtacatttatgaagagtgctttccctcatctactatttgctttgccagtgaaccatcatatgagaggcaggaataaatgcttgattcttttccattacctgccagtttgcaaaataataaattggtgcactacaatcctccaaaaacgatcaattacatcttattttttagcatcatttataaactcacagatgaaacatatttgatgagtctcagtatattagagttattattcttatggatgattaacttgtcccatctttggcaaatgaaaaaaacaatgcaagctggtttttgattcaatcatagtggtctgtgacaattttctgttatgacaagacgttccagactcttatttttttttcccccgacctggagtcagtcattttaccaagaagctgtagttttcttaagaaacatttttttcaaaccacaacgtgagcattcattgtggattggtcactgtttctagacaatttaagtacaaagagttggggagaaatgcttccaacaaaaaaaaaaaagtatccagacttcatactgatatttccaactcaaattcaggactataaggtttttacttaatcttttctgtcttgtatctgtacatcatttttcccaagctgagagttattctcaaggacaccaactatgaaagaattaaaagtatatcatttaatggcgtgaacccggtaggcggagcttgcagtgagccgagatcgcgccactgcactccagcctgggtgacagagcaagactccatctaaaaaaaaaaaaaaaaaaaaagtatatcatttaattactcatctgtgttgttctaagaatggcatcttaagaaatcccaagattctacgttcagacagagacagacaagtctgcaaagaagaccgaaagggcacccatacagaagacagaaaaccaccagagtacaatgacatggaaaccaaaggaagaaaatataagaaaaatgaaataattaaatatttagtgctactcaagagccaagttaggcaagtactgaaaaaattcaacgggatttagcaaaatgaaagtcactgataatctcaggctgcaaacagataaaagtagggtcaggaataaaaaggaggtaagaaattcttaaaagtagctgtgaagggaaaaaagataatgcaataattggagacagactatgggaattttggaagtcttttaaaataagaaaggtttgatcttgatcacatccttgtgaaaataatttagttaagacagagtctgcatatactagaacaagaatgtaagattcctgaggcgatggtgggaaagaacagaatccaaagcacatggtaatatattaacctgaagtatgtctataattcctcattgcaatgtttattgagtatccagtgtgataggtactgagaatagagataaaagatgaagtccttagcttcatagaactcgtggtctagaggggaaatcagacaagcaaataatgataataatgtagtatgataaatgctgtgaacacagaatcacactgcagccagacaaggacctgggattaaagaatctgctcacaaagcacatgaacagacacttctgaaaagaagacacacatgcagccaacaagcatatgaaaaaaacctcaacatcactgatcatgagagaaatgcaattcaaaaccacaataagataccatctcacaccagtcagaatggctattatcaaaaagtaaaaaaggaataacagatgctggtgaggttgtggagaaaagggaacacttatacactgttggtgggagtcttagtttaaccactgtagaaagcagtatggcgattcctcaaagagcaaaaagcaaaactaccattcgacccagcaatcccattactgtgtatatacccggaggaatataaatcatgctactataaagacatatgcacatgaatgttcactgcagcactattcacaatagcaaaagacatggaatcaacctaaaagcccatcaatgacagactggataaagaaatcaagtaaatgtggtacatatacacagggaataccatgcagccataaaaaagaacaagatcatcatgtcttgcaaaaacatggatggagctgggaaccactatccttagcaaactaatgcaggaagagaaaaccaaatactgcatgttctcacttagaagttgtagctaaatgataagaacttatgaacacaaagaaggaaaaaacagacacaggggtctacctgagaagggagggtggaggagagagaggagcagaaaagataactattgggtactgggcttaatacctgagtgatgaaataatctgtacaactaacccctgtaacacgagtttacctaataaaccttcacatgtccccaaacctaaaagtttaaaaaaagtattaatctacattaaaaaataaaaaataataaaagaaaagaaaaactcaaaaaaatctgctcacaaatgtcaatgagaaatttccaaatgaaatagacaagcaaaacatacagaaaaacaaacatgccatgcatgcttccctctaccaccccccactcccaaatctccacatttggattactactatctttgctttgcgggcatggacatgactggctacttcccatctttcaaatacaggaaagcctcaactttacccttcccccatcacaccactttgttacttcattcagaactcttatagaatctataattatcttgttcatttatgtattacttcttatttttatatctcctctaatacagccaaaatacatgagggcagggaccttatctatttgtataactgctctattaccagtcccttaaatagtgcctcatatttaatgaataaatgaatgaatagtacagacagcattagaaaatttagttacttaacacttctaggagtttagattccaggttaaatagaaattgaacactatctataaactacgtttgatttccaatataagcaatataattttaaactcatctctgaaggtgaaaggcatgcaattttgagttccgaatccaaattcttttccatttgactactaactccattaataaattcccaaataaatctagtaagtctttacattgcatttaaaattctccttcaaagaaatttcaaatcaacaaggtaaattaatgaaaaatgttgaggtagttgacacttagcaggaaaaagatgaattcctatttcaatctctcatcaaaataaattatagatcaaaggctaaaataataaaaataaaaccacaaaaatactagaagagctttaaagagaccggattttataggtgagaaaggcatttcttagcataagccagaacatttataagatgtaatttttaaagcatctattaatacacagcaagtgataccataaacgcaggaggaagaaaatgacaaactgaaaaaatctattgtttgttatatatataacaaagaattagtatccacaatatgtaaataattcctaaaattagtcagaaagagacaaacttaaaaagagggtaacaaggaggggagcaaattatgtacataaccagatgattcgcaaagacggcaacagagatggccagcaaaacaaactagatatatacttgtctattagatttatcaacattttttgcctttttcattaaaagcatttgtaaaaggatataggaaaagaggaactctcatatactcctggcagggatgtaaattggtacaacccttttgaaggacaatctgacaaaagcaatcgtaagttacaagtcaacatctatgaatgtatatgaaaatatttatatacatacatcaccaccataaaagcattttctatacatactgtttataattagaaaattggaaacaaatgattaaaagggggctgattaaattaaggttcatctatataacaggattatgcagctattaaaaaggacgtggtaactctatagacattcataggaaaataaattttaaaatactaagatcctgaatgatatatatatcatgagctattatacataacaagatcccacttgtgttataaaaaattatgtttagtcattcaaagggtctggtatgatagacccaaaatgttaatagagtcgagatttttattttttataggtttttgaaatacctgaattttcacaataagtactttgcacattaaaaatcttagctgggcatggtggctcacgcttgtaatcccagcactctgggaggccaaggtaggcagatcacctgaggtcaggagttcgagaccagtctggccaacatggtgaaaccccgtctctactaaaaatacaaaaattagccaggcttggttgggggtgcctgtaattccagatactcgggaagctgagacaggagaatcgcttgaacccaggagggggaagttgcagtgagctgagatcacgacgctgcactccagcctgggcaacaaagagcaaaactccgtctcaaaaataaataaagaaaaaatctttacatgtccaaagatacggctgttcaactaaaaaatatatatgtataaaacttaacatgttaatagtgaacacacaaaacagtaagatagataaaattattccttcaaagctcacttaacctctggatctacactgtccaaaaagacggtctaatgagacaattgagcacttgataggtgagtggttctaactgagatatgttctcagtataaaacatacaataggatcttcctatacaacattaattaaaaaacaaactattgtagttaaaaaggaaaaaattagagatactatgtaaaaaagagccaaaataccttgtattttatttgaaagacatatctccataagattacacaacctcgtgtaggataaaggactttgctttgcttggaatttaaacaatttaggctcttaaatgtcctaaaattctctgtagctaagaaatttttatattggttcctaggaactaggaatccttaaattaggccctacatttgcttacaagtttattttccttggcataaaattttttagtttttacattactggttatatttgatcagggttctatttaaataggcacaagttcaagcaaagatcagattctgcttttagcagtgtgtactcagacaggaagtattaaaaggcaggcagaaaatcctttataaaattactactttcaatgcattttcccacgttgaaatgcttctgcagtttataattaggcaaattactttaattataatcaataatgctgttcaaattactataagaattatacagatatttataccaagagacaatatactagaaaccaagactacgtgaccattacctctactctgtcagtgttatttgtgagaaattgcacaaattttgcaaaaagtgttagtatcctactacagtaggatataatatagaaggaaataatttcataaagcctgtctttggtactagtgctcagttactttcattaactaaaaaaggggctactcttcaaattcccttctctaaaaagaatgtactatatcaaaagggggtaaacactactacgtatacattctgcacttagaaatccctatatgttgattttatcattctcttattcaataaatattgtttctacaatgtgtaaggcattactgtactaaagcattataaggaatataagttaaaaacacatacaaatcttgccaatcaacagcttatagtgtaataggggagagaagctggcccatctatattctccctcaactagcaagtggatgaaatatcagggtcaatagttataagccacaaaagctgacagcttaattaagagaagttttgaaatatgtatttcatgaccaataattacaactgtaacttttctatttaaagaaggagaaaatttgaatttcttctctagctcaacatacacttctataattccattacatgaaccagagtaaagggtaagatggaaatgaagaatattttcttacccttttgtggttctatattggacacttaaaaatcatacacaacctaatcaaaagatgtaattctttaaaaaggtacgagaccaaaattcagaaaatctagactataacaaaatttctcaatttacattatcttaatatgcaattaattttcaccagtaaaatactatagtatgggtacaaatgcattgattagttctaattacaaaaatggctaatatataatactgtgtagtgtttatgatacatcagataatgttctaagtgctctgaaaatataaacttttaatcttttatacgaccctataaaataggtgttattctcactggagagatgagaaaacaggggttcagagatgtgaagtaatttgaccaaaggtcacaaagctgaagaatatgaaatccgggattctgattcaggcagtcttattccagaatcatgctcttaaccactatggaatactgcctctactgtaactattatacccaaaacccttaatcctaagtcatcaaaaggaagagcctctattttacacaatgaagaggcatttctaagaatagaaatttagggacgagcacagtggcttactcctttaatatcagcactttgagaggctgatatgggaggttcacttgaagtcaggagttcaaggtcagcttgggcaacatagtgaaacacagtctctacaaaatatttaaaaattagctgggtgtggtggcatgcatctatagtctcagctacttgggagacagagggaggaggcttgctcgagcccaggagttcgtggctatagtgagctatgatcatgccactgcactccagcctggacaacagagcaagaccctgtctctaaaaaagaaaagaaatttggaaatggtttattttgtattaacaatttataatttacactgaaatttattatgataaaacttttccctgtgttaaaaagctattaactttatgaaaaatttcttttaggtaaggttgattatatatacccacacacatacacaggttaaaagttagtttcatgtgacataataactagcattttgagcactacctgtttgcccagcactgttctaagtgctctacatgtattattgttaaattatcataacactatgaattatgtactataattaccccagctttacagatgaggagactaatccatggggaggttaagtaacttgtccaaggccagacagctagagccggcttttggacccacaccacagtctgactccagcacccatattcttaacaatttcaccatattaatatgtcaagattaagcagttttaaaggatgctattttctcacaaatttcttaatatgaacactcaataagaataatcactaatataagcatttagtatttttttaacactaagttggaagcatagtggaacatttatttttagaaatattattaattggctgggctcacgcttgtaatcggctgggctcatgcctgtaaattttgggaggccaaggtaaaagaattgcttgagcccagtatttccagaccagcatgggcaatacattaagacatcatctttaaaaaaaaaatgttattaatctcctctttttgttaaatgtatattatcaaaattgttactaagctaacaaacttcagaaaaacttatgatgggcaagctgcttgtgacattgaaggtatttaagattcaattctagtttggtcctagatgaccacatatccattgttccttcaacgagcacatggtaaagagcctagaacacagagacacagaacacagtggagaaaagggagtgaaatgtctttaatgacacttactatatatgggattttgtgacaatatacaaggatggttaagacatataaggtgatgcaaaaaaacatattaacaattatagtgacaaaaaatgaggagcatataattatacattgatttatacagagtaccagaggaacacagcattgagagccgtaacaccacctgagggagtggagaaaggcttcagagagaaagtgttttttggaatggatcactgtttccaaaagaactaaagtacagtttgagaaatgcatacttaattcattacttttttcccctcaactttaataataaatttacccaacaaaaaagtttatttttgacttgtaaatctcttaaaatcataaaaaagtaaaattagcttttaaaaacaggtagtcaccatagcattgaatgtgtagtttataatacagcaaagttaaatacaatttcaaattacctattaagttagttgctcatttctttgatttcatttagcattgatctaactcaatgtggaagaaggttacattcgtgcaagttaacacggcttaatgattaactatgttcacctaccaaccttaccttttctgggcaaatattggtatatatagagttaagaagtctaggtctgcttccagaagaaaacagttccacgttgcttgaaattgaaaatcaagataaaaatgttcacaattaagctccttctttttattgttcctctagttatttcctccagaattgatcaagacaattcatcatttgattctctatctccagagccaaaatcaagatttgctatgttagacgatgtaaaaattttagccaatggcctccttcagttgggacatggtcttaaagactttgtccataagacgaagggccaaattaatgacatatttcaaaaactcaacatatttgatcagtctttttatgatctatcgctgcaaaccagtgaaatcaaagaagaagaaaaggaactgagaagaactacatataaactacaagtcaaaaatgaagaggtaaagaatatgtcacttgaactcaactcaaaacttgaaagcctcctagaagaaaaaattctacttcaacaaaaagtgaaatatttagaagagcaactaactaacttaattcaaaatcaacctgaaactccagaacacccagaagtaacttcacttaaagtaagtagaaaataaagagggttcatgtttatgttttcaatgtggatcttttaaaaaaaatatttctaaggcatgccatttgaaatactttgttgcattgttgaaatacttttttttccaagaaaaataatctccagaaaataaaatttcctattataatttcaagttagttttttgtttccctaatgttatatatgaaaacactgaaaatttgcattttatatgaaaattacaaatcggttaaattatacaatctagaacactatgtcattacactattgtaaattactgaaggtaagtaaaaagttaaaaaaaatttaaaactattctccagtgtttaaaacagattaaataatacagtaaatggaaaagatttattcatatgaaaatatgctgggctttttcttttaattgaagttcagaaaatcaaattttagagatagtacaatttaaataaaatgttaaggacaaaaatatgtgctatttgaaagaagcatacaaggggaaggaattgccaatattcatttttcaaatccattattagtttaaaaatttagattatgatagtgttacaggaaattaatagaaaagaaagaggaaagcaacttataaccaacctactctctatatccagacttttgtagaaaaacaagataatagcatcaaagaccttctccagaccgtggaagaccaatataaacaattaaaccaacagcatagtcaaataaaagaaatagaaaatcaggtaagtcagtattttaatggtatgtcccatctttcacacaggtctgtaaaaacactgaatcctaaaattatttacaagctttaactggatcatgagtaaaattatcacatcagcataactgttaaaattgcaggctctgaagctaataaactacctgcatttaaaccatggctctaaaactttgtgtgaccttgaataaattacttcacccctttatctctcagtttcctcacatatactacaaagataataacagaacttataggattattgtaagaaaaaaaattaattcatagcagccaatgtcatcttactaaaattcaaattagatcatgtttctctttgctcaaaaccacacaatagctttccatttcactcatattggctctttagaccaagattacccaacccttcgtcatctcactgacttcacctcctctactctagttattctgaccgctttaccagtattcaaacacatcaaacatactgccacctcaaagcctttgcccttgttgtttcctctaactggaacgctcttctgccctggtatctacgtggcccactctctgatttcccttagggtcgttatcaaacaaaaaattcccaatgaagacttacaaggtcacttaaccaaaaatcacaaccgcctggtcccatccctgaaaacttctacttccttagctacttttctcctgcacactcacctttatttaacataacataaattttagttatttatctcttctattcctgcactaaaatgtaagctctgtgaatacagggattttttccattatcttcatattttccattatttgtatatactccagaatatagaatactgtatggcacacagtaggcatttctgttgaattaataaatgtaatgtcatattcacacagaagcgtgtgctatgattattattacttggattactagaaatagtgtgcctcataattaaaggtcaacattcaacaatgtaattaatctacaatgtaaacatctggtgaagtgacagagggaagcacttgtttagaaaaaagctatgtcagaatccatgtattctaatatgcagtacaatagtttaaaaatattaataatactctcaaacagctattcaagaggattcaaaaaacataatataaactcagagaaactggtaaacaaaatcattttcaagagatataaaacaaatattattaccaatttccactaaacaaacataatgttagtagtgctgctaaaaggttttttatcaactacttttggtttccatactttccttcttatgatgttattattctaaattcttttcaattatatcttttactatgattaaatgaacctgctccccaaagcaaaatgttactatagtaatatacattgtgtctaaaaataaaaatgtgtgaagaaaccaaaacaatgaatttctgagttggaagaagagttagatcatttaactttctcatatttaaattaaaaaaacaaaactctaaaaatttaagtaactttaagatcacatagttacttagtagaaaagagtaatacccagcaagcaaactttacaatagatccttttaaataaggtcctaggaaatatcattcatgccagcatcaaaaaactaacactaataatgcaagatattatatattctgcttttcttactgtcaatgagaaaaactatcattcaataaattgcaaacccaacacacttaaataaaaataaaatgttactgctaaactaacgataaactactgaatatatagaaagtaagcaaacaaacttgccaacctgccaacatctacagatatgtttacaggtcaaaaattatcaaattatcaagaaagcctggttcaaattatgtattatgtctttatcacaggtctgaagatcagtaagacctaaaactgaaaattattaaacttaaaatctgaacagaatatcaaatatattttattcatataaataaaagaatacattacaatattctaagcaaagcagtctctacttttggccttgctctgttttccgaccaatgtctgcttttttgccttgctttatttttttatcttattaaataatgtccctgattaaatattttgagaacaggtaatctgtacaatctgaataacactgtttatctaaatatcaaacaccgttataacattatgaactgaaagacaaactgtacttctgacatccttactcagatttcccctaattgtatattcagtatcattttaaaaaacagatttatattcttttatcagctcagaaggactagtattcaagaacccacagaaatttctctatcttccaagccaagagcaccaagaactactccctttcttcagttgaatgaaataagaaatgtaaaacatgatggtaagacactttggtgggtttccttcttgaagctattattatcaaattccctattcttaggacttgttctagactaaaagatagttaagagatatccatcaaatacaatgtatcaacctaaactggatgctggggttctttttacaccctataaaagacatacctaagacaatcagagaaatacaaatatggacttgattattagataatatagaaggtttattaattttcttagatgtgatcatggtattgcagttttaaaggagaacaatctcctgtttaagagatacatgctgaaatatttacggagttaaaggtcactggactccagactggtgatagaacaagactctgtctctaaaaaataattaattttttaaaagaaaatagtttggtaagatgattcttacattcttaaataacacgccatctaagaaaaatgctttaacataaacattactgaaaaaatgctacatttgccacaacttcataaaatgtcaagtgaaatctcaagctccaaagatattattcctattactaaatctgatgtaataacattttattgattctaggcattcctgctgaatgtaccaccatttataacagaggtgaacatacaagtggcatgtatgccatcagacccagcaactctcaagtttttcatgtctactgtgatgttatatcaggtaaaacctgtctaaggagaatagacagtagttagttcaacttactcattacgtattaggaagattaacctggttatcattgttttatacatatatatatgaaatatatatgagtattcgtataaatataatacttttaccttgtttatgtatttactcaatattctccttttcctctaaaataatctgaagtgactattatcaataagtttactatgccaaaattcattaattgcctttcacttaacttttgggaccataataaataataaaatgtattgccataacattaataaactaccttacaaaaccaccaattaaaatcaaacaaacaaaaaagtgttatttacatctgtcaacataaatctactaaaaatacatgatttcattcattatattcaggtagtccatggacattaattcaacatcgaatagatggatcacaaaacttcaatgaaacgtgggagaactacaaatatggttttgggaggcttgatggtaaggggactacattcaatcattcattcacttgctaatctacaaatatttactgagaacctcttatggaccaggtattaggaaaagtagtaacgaacgagaagcagtctcagccttcatataatttattatcaaacaattacacatttgttagtaaattacacttattacaactgttattatttgaattatatttatcacaattacatgtctgttcttaaatatacttatcacaatttaattccacggcttacaatgatcataactataattattaaagacaattttgattaaatgttatgtcataagtagtaactgttacaaataagctgtgaaaagaaccactcctagcattagtcactctattctctcattaacgttttacatatcaattaattggaagttaaaaggaccaggaaactcagacatacagtatacattttaaaatttcaattatttaaatataatatatagaatgtatggcttataatgaattagttaactcaatgcaaattattctattttgattacaaatagtaaaataagcaagataaaataacagatgtttaaaatccaaaaagcacatacaaaaatccatgaatgatgtctaagtactcacttataaagtagaagacattcattattatatcaaatttttaaatgctcagtactatttgaccatttaaaaattttgtattcaaactaccagtgaaagccctacctagaaggtatactcagtgataagttttgtagctccaaatcttctaatagtgagtgtaaccccaaaataaaaggctgacaggtaagtcgagaatactcacttaattctggtaagaaagcaacccatttgtacttgtatttaccagcaatccttaaaatgaagcttcctactaactcaatagcaataagacaatagtgaatgtttaatgaaaacagtattttataaatactttaataaaaaggattgtgatgaagaacaatctatttatatttgttatttgtttttaattccaataaaaataatttttaaaattacagaaaaaagttattaagaaccatgcttttaaatttaaaatgattttttaaatttattcctgtctttttctacaaagaaagcatacattaagcaaataccaaaggccaggtttacatttgaagaaagtgacattattattactcaagtctctaggaatacttaacacatctcttgactgtatatggatgttaataaatagctgacagtaaagtttatccatataaagacttgcaaatattcctctaccaatgacgagactttaaaatatctataataatgtaacacatttcactggtgaaacatgtcttgtcatatgcattatagaaaggataatcagactttcagttatattaatatttttaacatttttgtgcacatagctatcttcaataaaattgttttaaaaggtattattttaagatacactaaaatgatcaagggattcaagactaaacaactcaattagttgcaccaataaaaaacacttaaaaaaactgtcagtgtccaacctgtacttaataactcacagatttttaaaacttttcttttcaggagaattttggttgggcctagagaagatatactccatagtgaagcaatctaattatgttttacgaattgagttggaagactggaaagacaacaaacattatattgaatattctttttacttgggaaatcacgaaaccaactatacgctacatctagttgcgattactggcaatgtccccaatgcaatcccggaaaacaaagatttggtgttttctacttgggatcacaaagcaaaaggacacttcaactgtccagagggttattcaggtatctttttctgataccaatactttattttcatatcttcaaagtatcttcccacattattagctattatctgcaatgacaacttttaaaaatccgaatcccaaataagcgttttctctctagacgaaaacctcttaactataatgaaagtgttcattctagttcaatcaggtattttacctctaatcttcctcagattttctattttttggtagtgtatagattatttatacagattatttaaaattgggacttatacagattatttaaaactgggatacatgcatctaaaacactgtaatatttataagaaaggaagataaacttacggggaaatacagtaacagtaactacatacgagtctgtacccattaaattgcatatctatctcctttaggaggctggtggtggcatgatgagtgtggagaaaacaacctaaatggtaaatataacaaaccaagagcaaaatctaagccagagaggagaagaggattatcttggaagtctcaaaatggaaggttatactctataaaatcaaccaaaatgttgatccatccaacagattcagaaagctttgaatgaactgaggcaaatttaaaaggcaataatttaaacattaacctcattccaagttaatgtggtctaataatctggtattaaatccttaagagaaagcttgagaaatagattttttttatcttaaagtcactgtctatttaagattaaacatacaatcacataaccttaaagaataccgtttacatttctcaatcaaaattcttataatactatttgttttaaattttgtgatgtgggaatcaattttagatggtcacaatctagattataatcaataggtgaacttattaaataacttttctaaataaaaaatttagagacttttattttaaaaggcatcatatgagctaatatcacaactttcccagtttaaaaaactagtactcttgttaaaactctaaacttgactaaatacagaggactggtaattgtacagttcttaaatgttgtagtattaatttcaaaactaaaaatcgtcagcacagagtatgtgtaaaaatctgtaatacaaatttttaaactgatgcttcattttgctacaaaataatttggagtaaatgtttgatatgatttatttatgaaacctaatgaagcagaattaaatactgtattaaaataagttcgctgtctttaaacaaatggagatgactactaagtcacattgactttaacatgaggtatcactataccttatttgttaaaatatatactgtatacattttatatattttaacacttaatactatgaaaacaaataattgtaaaggaatcttgtcagattacagtaagaatgaacatatttgtggcatcgagttaaagtttatatttcccctaaatatgctgtgattctaatacattcgtgtaggttttcaagtagaaataaacctcgtaacaagttactgaacgtttaaacagcctgacaagcatgtatatatgtttaaaattcaataaacaaagacccagtccctaaattatagaaatttaaattattcttgcatgtttatcgacatcacaacagatccctaaatccctaaatccctaaagattagatacaaattttttaccacagtatcacttgtcagaatttatttttaaatatgattttttaaaactgccagtaagaaattttaaattaaacccatttgttaaaggatatagtgcccaagttatatggtgacctacctttgtcaatacttagcattatgtatttcaaattatccaatatacatgtcatatatatttttatatgtcacatatataaaagatatgtatgatctatgtgaatcctaagtaaatattttgttccagaaaagtacaaaataataaaggtaaaaataatctataattttcaggaccacagactaagctgtcgaaattaacgctgatttttttagggccagaataccaaaatggctcctctcttcccccaaaattggacaatttcaaatgcaaaataattcattatttaatatatgagttgcttcctctatttggtttccttaaaaaaaaaaaaaactctcataggacatgtttcattttgttcctttcaggagtagtaaattagacgttttccccatataaagcttttttctaccagaaagatacttctggtagaagaagagaaaggagctctttatggttcacacgactgtctcctgtcctaactactttgcttaaagtgctcaaattccatcactactcacagttgtctaatctaagtctaatcccctttgatctctcagactaccttcccttttatctctctactacttaataataagaatatctttttttcaaacttgaccttcattttgctttcacaatactatactctccatggattatcccttatctgaatccatctttataaccctattcctttctcatatttagtactgtgggccaatggacaaccttcaatcatcttttctacactgaccctcagacattctatctgctctcacggactcctttatttaccatgaataaagttccaaaatctacatattcatcccaagtctctttccagttccccttcttacattgcctatttgccatttctcccttcaataccctatacttcactcaaattcaacataccaaaaataaaaggccaggcacggtggctcacacctgtaatcccaggactttgggaggctgaggcaggtggatcacctgaggtcaggagtctgaccagcctgaccaatatggtgaaaccccgtctctacctaaaatacaaaaattagccaggcgtggtggcatgtgcctacagtcccagctactcaagaggctgagacaggagaatcgcttgaacccaggaggcggaggttgcagtgagctgagatcacaccaatgcactgggtgacagaacaagactgactcaaaaaaaaataaataacaaattccccagccccttactgctactgctatccctttctacccacctttccctcctttatactctttcacaccatcttcctcacttctttatatccattaatatgaccagcatgttcccagtcacagaagcctggaacccggaagacatctctggcttttcactcaactttgtaaactacctcttttgtatcataagccaccaagttcaatacaatcttctcttgaaacgtctcttaatcttataagctttcttccccaaagactgtctttaacttcagtgctagattatataagtagtctcttctttcctcctaattttacgtccctctccctgtcaatcttccgaaaaggaatttgtaatggctgcatactgcctggacctgtgtctttcaagctcatctactgaagaagtgtaacagcagaggataatgaaaacaaatccttttattgtctggagttacaggataaaataacttactatatgcacaaatttctttcagaatcttattgggatcttagcttaaatcttagaattttactttaaaattgcatatgaattgtgttttatactttataaatctatcttcatgcctgcagtggctcacacctgtaatccaagtattttgggaggccggggcgggagtactgcttgaacccaggagtccaagatcagcctgtgcaacacggcaaaactccacctctacaaaaaatacaaaaattagctgggtgtggtggcaggtgcctgtaatcccaactacttgggaggctgaggcaggagaatcgctggagcctgggaagtcaagcctgcagcgaaccatgatcctaacactgcattctagcctgggcaacagagtgagactctgtctcaaaaaaaatcttcatataaaaatatttatttccccccaagtatttaaaaagtgatgttcctagaagatgtgtcatgtttatcctgtgaacttgcacgtcccatatagttgtgccctcacaagaatgtatactccaattagaagagtataggcctttggaacaaaatccaaaatccttccaggttttcaaaagtctctatcacctggccccaaattacctcttcagccattttttcccacaacacaaaccttctgctctcatcaaaacgatctacttttaaacatctcctctatgccttcctaatgtattccatttgtctagaatgtctccccacacatttctgattggctagattgtgccgtattttaaggtgcagatatctcaattcttccacaaatattctagtaaatggcagcttgttcatctgaaaccacacagaattactgtccatacacctcaaatggcacttagtgagaaaatacacagaatatggcaaatcataataataaaaattctgaaaaatagtactaaaagctccaaaagcatcaaagatagtcagtttacctgattttagtgaattactgaaaaatttctatatcaagagtttattttgaaccagtatgaattttactgaaaccaagtacacacatgtctcattatgaggtaatctagtgtagtataatctatttccatacactctgtcatcctggaatcagcatattttcatgcttgtatctttacttcctaatagcataactcatggaagtcaactaactcattcattaattttagaaatggtattcattaaacaacacttattgagcatctactatttgtctcctttaaaaaacatattccaaatttgtactcatatatactctaccttctgctgtaggataatcaaatttccttgtgatttttttccccatcactaacagccataaactctgcacttatgtatgtactactgagtgattatcaaacacagcagttttaaaaatgaaaagaaagtgacccaacaattggcccttttatcaaagtccaaagtattatcatggcaaatcaactagggtaaaattacttaactggtgcacagttcaaggtcatgaaagtagcactaacaatcctctattataacccttaataaaatgaggttttaatgacattttaggaaatataaaataaacttaagaattctatctaaaatacaaaggctgtttttcctaaattcatgtttagtcctaagaacagtcatacatctaataaaatgactgggtatataatttgaaagagcaataaattactaccttgaagatgtaaggttgtagctatttatcttaaaatacacagtcaaacctcagtttccacacccaatagatgggaataataatcctgtcaaatctattaatacttcatgggattgtaatcatcaagccagataatgtatttgaatagctttatgaactataaagttctaaacaaatgtatatactttttaaaaacaggttcttccgtgtcatttttcacattcctttaagtaaataatctctacaaacgcttcctaactgaacatattataattctcaggacagaagaacaaaactgcccttctcagagtttgcatctgtttctggaactttactccttcccttcacaatctaagataacactccatcaccttcagatgcaagcccctaactaaaaacttctgggtggctatgttaaaatgttaggaaatagagctcttgactcagaattcttttttttttcgagatggagtctcgctctgtcacccaggctggagtgcagtggcactgcacagtgagctgagtgatctcagctctctgcaacctccgcctcctgggttcaagtgattctcctgcctcagactcctgagtagctaggattacaggtatgtgccaccatgcctggctaatttttgtatttttagtagagacggagtttcatcatgttggtcaggctggtcccgaactcctgacctcgtgatccgccttcctcggcctcccaaagtgctaagattacaggcgtgagcccccgcgcccagccgactcagtttttatagttaaaataaactaggaccaattcgatagaataaaactcagagtggtataacaaggacaaaaccaaaatagcagagtatgtggcagtagcttgagacatctatgaactctaaaaataaaaacaaaaaccaatactttctgaagcagagaaccatacacttgaatagaaaaaaaaatgctcctgaattttcagtaacgttcagctgaaatttatacttccttaaattatgaatgtagtaaaccaaccacagcagtattaccagtatataagattttgtcattaatagaaacatacatttactattattattattattattatactttaagttctgggatacatgcgcagaacgtgcagttttgttacataggtatacacgtggtatggtggtttgctgcacccatcaacccgtcatctacattaggtatttctcctaatgctatccctcccctagccccaccccgacaggtcccagtgtgtgatgttcctttccctgtgtccatgtgttctcattgtttagctcccacttatgagtgagaacatgtggtgtttggttttctgttcctgtgttagtttgctgagaatgatggtttccagcttcatccatgtccctacaaaggacatgaactcatccttttttatggctgcatagtattccatggtgtatatgtgccacattttcttcatccagtctatcattgatgggcatttgggttggttccaagtctttgttattgtgaatagtgctgcaataaacatgtgtgcatgtgtctttatagtagaatgatttataatcctttgaatatatacccaataatgggattactgggtcaaatggtatttctagttctagttccttgaggaatcgccacactgtcttccacaatggttgaactaatttgaaacatacatatttttatatcacaactattatagacatctcaaaatattgttgatgcttattactatttagaaaatacaatagttttttaacctgaggccagatcatgttatttcattcatcaataaacacatatatcacaactttaatattttgataattttaattcaatgtaactgatttcctttgttattctatatattttatttcatgcatttaaaaacatttaaacattacagattgagtatcccttattcaaaatgcttaagaccagaagtctttcaaatttcatatttgttttggattttggaatatctttatactcacggttgagcgacctcaaatctgaaaatccaaaatgcttcaacgagatcttctttgagtatcatatgggtgcttgaaatgttttggattttggagcatttaagattttggattttcagatttgggatgctcaatatatatttcaaaaaagggtatcacaggattcacaagacgaccacaaggtaccatggtacacaaaaaaattagcagcccatgttcaaaggacctactgtcatgtaataacctagtttaagaaacatgaattacatggctctcatgtcataacatcaacagcacacatattctgactggccaagctcttccttgaaacaatattttaggaaaaaaaatttaatcagtatataataagcttattcaactactcaagaaaaaaaaactgatgatagtaaaattctaaagagatcataaaacatttcatttgttattgaggttaacttttaaaagtccttatctggccaggcatggtggttcatgcctgtaatcccagcactttggtaggctgaggtgggcggatcacctgaggtcaggagttcgagacatgcctggccaacacagtgaaatcccatctctagtaaaaatacaaaaaaaaaaaaaaaattagctgggtgtggtggcttgcacctgtagtcccacctacttgggaggctgaggcaggaaaattgcttgaacccgggaggcagaggttgcagtgaaccaagatcatgccactgtattccagacagggcatcagagcaagattctgtcacacacaaacacacaaaaaagtccttatctgttagagatacatactgaaggattttcaagtgaaatgataggatgtctaggctttgcttcaaaaatattaccaacaaaacaaaagacaggacaagtaacagataacacaaaaatgacaatgcaagttaattaatctgttctctaatgagaatatatgggcacagtgagggaacaacacagactggggacagtcagggggttgggtgcaagggagggagagcattaggacaaatagctaatacacgtggggcttaaaacctagataacagattgataggtacagcaaaccaccatggcacacgtatacctatgtaacaaatctgcacattctgcacttgtatcccggaacttaaagtaaaataaaattaaaaaaaaaattaatctgttctctttacttttaggtgtattaattttaggtgtaggtgtattaatttgttccctttacttttataattttccataataaaagtttaaaactatattcagattagatcagagaaaatagatttactaaaatttattaagagatgtatgggcatattcctaacagaccaaaatccttttgtttctcaccctgacagttaccaggtctgaaccattgtattcattcttacattcttagtaacgcaccatgtttgctagatatagtctttcaaaaatactaagtagaaaaacaaagatacaaacattcaacaggtgattacaactaaggccattactggaaatgcggctaactctaacaatcctgccaagaataccatgtgttctgtggacatacctcttaaaaactggatgtcagtaaaacacataagcatttgctcaattaatgtaccttgatctattacaactcaaatacaacagtggtgatcaagtaaaaatttggaacacaagtaacattgcatacaatctattacctaactttcagatgatttcaaatatccaataaaagatttttttcaccattgagaaagatctttatttggtttacttaatgttaacaattacactagtactttttctaaaatactgtgatagggtaagtacttccttgataaagcaagaatttgatgtaaaccccacttgtatggtgcagtaagaaacaagtcattcattttctgattgttagaaactaccatatatttgtgtatcttcatctacccctgtagagaatttgaaaagatcaggcccctcttcagttaaccctatgcaaataaatgtgaccagctgtgtgtgggaggtagggaggcgcggggaacgacagagtttgttatttaaaggtgaaaatctctagcttcaggtataacttaaataacagatttaagtctttaagaagactcaacatcttcaaaagaatattttttaaagtgtacataataaaagtaaattaaactaatatagacctctttagacagctttctctgaattatctgataacgaacataaaaatgagaagtgaaaggtgtataggaaatctgtcactttcagaatacagttctctttcctacgatttctcaactcagtcaaatgcttcaatgatgtccattcattccccctatattcatgcagtttttaattttttccctatgagaccctttacaatcctctcaagtttctcactaaaactaaatacaatatggaaatattttcttaaaacacacatgaacaatgcttaaattcctatttttttcagatataaatttgaaccccctgaacttcagctttgtcatctataaaatagggataaccacattggttctgtgcaggctgctatcagagttaatagataatggccatatataaactaaaaggagccctagtgtcaactttatcttccttttttttaacattattcactgggaaaatgtgtacacaaatatttgtatagtgaccactggtatgtattatcacaaattatgtcttatcctgaaacattcctgagaaggcaaaaagaatccaaatgagctaaaagattatcatcaccatgatccagcataaccattcagttagcaaatatttatggaactttctgtaaattattgatgatatttgtatattagctgtcagctgctgaggttgtcatacatcccttttcgtcattccaaaattatttctacctatgctaggtttctagatatgcttaaggtttttgtttttttttaaaataaactatcagttcctaaacatataagctgtccataaggccaagtttttctaacagcatcaaatagaataaacaacttttaatgatttggttttaaggtcccatggacattgatggtctaataatacaaagcaggccaatattgactctgataatctcccttttaaaataattctcttatccaattataccccagatgcctagtaccctcatgcttttcaaaccaatctctctcaagttgtatagtgcatgagtaaatgtaatctaataaagccaaaaacaataacaacttctattgagcatttaatatgtactgcattactttgtgacatgcactttacacatatttaatccccatagatttctaagatataggtacttttattatacccatgttaaaggaaggaaaaatcattcctcaattttaaatacagtaagtcctcacctaatgtcatagctactgtgacactggataatgttcttggaaactgtgactttaagagaaggactttaaggaccatgtgcagcaggttcttgaataatatcattttgttcagcattgttttgttataacattgactggaaaaaaaatggtttcgtcacatgtcatttagcttaaaaccttagtttccaagaacctattaacaattttaagtgagaacttactgtaattcctaaaaatgaaacatggttacaaaatacaggttacgagagcccatctcccaatttttcataagctacacatatagtcgtaccatttcaagtaacacaaaaattattatttctttatgtaatttggagattatttttaaaagggaatggtcaactttataatcatattttgttaaagaaactatttggcaaaacagtaacaacaggaaaaaagtcaaccaagtatagtaatcacaattctacttctgaattttcatgtagtatctaattttctctacttcactgaggatactcttatactagaaaattattaatcgctttcttaaaataatgcatcctttttgctccaacagttctcactggtacttgctactaacagagcactaggatcatttccataaactaagaaacttagccttgacattctatatcacatttaaccaatgtctgttaacaggttaaagcattttatataagttccttacaaactgtatataaggaggaataaggttatgtaaagccctaatctgaaatcaattcattttgatgaaaaacattaaagcctaaatcagtattcatattcaataaaagttaaataggagtaactctaatctttatgatgagcttagcaagttctattattctctggaaataaactgttcactcatgagagaaaaatggttattctataaacatttaatgagtccttttttaaaagcttcttgcctacaatattatttttactaataatgtctggaatgagtattaactctgtaattaatagaatgtctagatacagtccaaactaaaggcactgagatacgttaaatgatctctcaacatcattctcaaattaatatgctataattcatttttatacttgaaaaatttaactcccagaatagaaactaattatagtttttggactatcacttagccttaccaatactaaccacttcaagtgagaaagcattccaccctaaaaaccaaaagcaaacccaaataaacaaatgatcttaaacaagcactaatacatgtttacataatttccattaaactcaaaaagcaaaaccatactaacttataatttataaaatccccttaaatcatttgatgtatgaactttttatctcctccagaagaggatgttacattaaaactggatacatccttaagagaaaacaacgtgctgccttatttggcacggtatcttctcacttggtatgagtgcattactcaattcccatttaagttctgtaacatgtctggattatctatattggctctttttccattaattcacagaaaagataccctagaatccatttatatcaagtgtatcacttacatcaactgtaagacattaaaaaaaattaaacaaatataaataatggtgtagattttgaggctaatgtaagataaaagtgttctgttttaataaaaatgtagcaaacaattctctaccaatgagaaattttatttttattcaaattatatataattatgaatgctggatgtcctaacattccaaaagatgaagaacacagaaaatgaagtaagaaggcttgggttcaagtccaaacaagtctcttaattcagccttctgtcagtagagaagtggagacaataatactgccagaattatgtaatgtataagatttctatgagactgaataaactaatttaaatgaaattatattctataaagcactaaataaatgtcatcatatcaatatgtcaacacgaaatttcagaacaccagtgataaagaaaataattcaaaaagtcttagggcaaaataagacgcaaaagattagcaatcagtataatattggactactcaagggtactgcttaaagccagaagacagtagttatattttcaaagttatgatagaaaatgatatagaatttagaattttatacctggcaaaactattaatttgagagtaaaggtaaagatactgtcagacataaaagaaaatttacctcccacacatcctatttaagaaagatacgaaagctttcagtgaaatgagcaaactaaggaaaatacatgaaaaataaggactctattgcaaaaaaaaaaaaaaatgcaaagaaaatgtccaggataatggtaaataggctctaagatgacaattgtacagtaagcctaaaaagcctacaaaacttcctctgcaagggaggaaataattgattgttgatgtatttcactgtactataagaggttttacagagagttttagcactaacacatagaaaaggagccaactcatgcagtgtcttatagactgttagaaaaaattcattctttttctgtttgtaatagaagcactggagaatttcagacacaggaatgaatgatttgatttacaattttcaaagaattctctggctgcaatgttgagaagtgactgagacaggagtagaaataagatagccaaattagtaaggatagcaaaattcaagatcagagactgtctaatatggtagcctttagccccaggtggttattaagcacttgaaatgtggctcatctgaattgaaatgtgctttaactataaaatacacactagattttgaagttagcagaagagaacagaagtaaaatatctcaataattcttaacatttattacatgttgaaatgataatactttagatacactggtttcaatgacatatatgattaaaattaactttacctgtttcttttttttaatgtagcaattataaaattttaaattgcaaatgtggttcccattatatttctgtttcacagtgctgatctagatggtgacagactagaatttttaaaaggtggaagtagtaagaagtacagatcaggatatattttggaagtagagcctatgtaacttgttggctgaataaatgtgaggggtaggaaaggagagaaatcataataattccaaaaattttgtcctcaggaacttggtaaatggtggtaaaaatatactaggatggggaagtctaggatgaaatccaaatttctgttttagaatcttatacctgagctgccctactgaatatcccaacagacatgtcaagttctggtctcggcattcacaaataaagggtatatcattcataaggagtacatgcaaatggcacccccagagttatgtaatgttcagtctgaaaagttatatctgacaacgtcatgtcaagtattctctagataggatatactcaacaaatattgttgatttattagaacataatgcaggcacataaatttgattcttgtgtaatgctagattctgctactaaaaacatttgagaaaacatagtaattaggagttcaaatgttttaacctaaaggcccaggaatcaaatcccatcaccatcacactaaggtgtgatgctcagcaaaatgtttaacctctctaacccttggtttactcacctctaaaataaaagtaaaatccacctcaaataatgaggattaaataagactaaaaaagataaagcatgtaaggtaattaacattatacctgacacacagaaagccttaatacgtgaaaactattaataaaattgtgcggtaagagatagagttaagtaacaaaactacttaagatttttggagagtttattctagttatactttaatattttagaatatacagtatcttctatcagaattctccaaattaaaatctcttacctgtaagtagtgtttggaacataaacatcccttgcgggaaactctaagatttctctggtaggtctaactctactgtcagggtaaagcttcacttgaagcagctccggagttaggcaataatggggattttcaggtgcgggagaaatgtctatcttgagctgagctgcaaattatatattaaaaaacaatgtaaagacaataaaaaagtccacgttaaacatgttttttaaaggacttggatcctatttttgcaagaagtctgggaagaatattacagaaaccaaatttatattattatcatctcatgcctctaaatcatttcattttgcaaagtctcaaacttaaaaattaccgatccagacataaatgcacgtaaaataataaatgcttattaaataaatgaatgggaatgaaggaaggaagaagcaaaaatagaaaaaaaaaccagagggatctggcataggaacaagctaagtcatttcaaagattaaaagacttagttttgacttagcaaactttaagacatttttactctggaatggtttgctccaatcataatatgaatctattttttaatatttaccattctattaccattctagaaaataattttaagccatgatattattcatcacactcactttagtatagtaattccttccatcccccgctggggatatattttaagacccaacccctagtggatgcctgaaactgcagacagtacccaaccttatagatactgtttttccctatacatacatgcctacaataaagttaaatttataaattaggcaaagtaagagattaataaccctaactcataataaaacagagcaattataacaatatactataataaatgttacatgaatgtggtctctttctccctgttcctctctccaaatatcttaatattttcacatcgtggttgactacaggtaactgaaactacggaaagagaaacaataggtaagtggggactactgcactcaaagtaccaaagatgctgaatcctgcatccaaactgtcagatcacatgatagttaataaagtgaagaagactgacaggcattgggcatagaaaaatgtctgggccagataaataaaaaaaaaagatacataattataagcaatacaacatagtagtgataataatagttgcaaccatttctactcaaaatttttaaatacctgtaataggtcttagtcgccgtaagacagaagatggccttctcatatcagcaaggaatttgtagagatcttcatcacttaagcggtctccttcctgatttcaataatagaggaaaaagtatttgataaaacaaatatagccaggcacagtggctcacgcctgtaatcctagcactttgggaggctgaggcgggcggatcatatgaggtcaagagtttgaaaccagcctggccaacatggtgaaaccccgtctctactaaaaatacaaaaaaaattagccaggcatggtggcacgtgtctgtagtcccagctacatgggaggctgaggcaggagaatcacgggagatggaggttgcagtgagccaagatcacatcactgcactctagctggggtgatggagcaagactctgtctcaaaaataaaaataaataaataaataaataaagatatatatatgatgaaaaataaatttatagtttgttagtaagcatgcccttatgcctacaatgtagttagaataaaaaattaaattaaaattatgattataaatatcataccagtttatttccttttttatgctttcaaattttactaagatttaataataccactgtcttttttcttatttatagtccattatctatgcctataaagtattacaaaatactctcaaatatagaaaaccaatacaagttactggccgggtgcagtggctcacgcctgtaatcccagcactttgggaggccgaggcgggcggaccatgaggtcaggagatcgagaccatcctggccaacacagtgaaaccctgtctctactaaaaaatacaaaaaaaaattagccgggcgggatggcaggcgcctgcagtcccagctactcgggaggctgaggcaggagaatggcgtgaactcgggaggcggagcttgcagtgagctgagttcgcaccactgcactccagcctggatgacagaaaaagactccgtctcaaaaaaaaaaaaaaaaaaaaaggaaagaaaaccaatacaagttagagatagatgaaaaagagaagagaaaaataagaacacagacataaaacagaatcaaaaagcaaactaatataaaaatacttgagtctcataaatttattactttttagttcatatttgtgttttcaactttatatcacaaatttctccaatgcaaaatctgcagcactggctaaggtgaggaggagaagaaggaagaaaggaggaagagagaggaagaagagggaggaaggatttagacgagggagggagggggaggaggaataggaggaggaagaaactactgttaaggaaaatcacaactgtcctcatactaaggccagaaagaaaactccaaaaggacttcaaccaatatgaagagaccttgaaaaacacaaaacaaattacccatagccgattaacacaaatgttcaatttaatgttaatattttttcttcttacaattaaaatagctagagtttttcttttattaaagagtcagtctttagattttatcaatccaatcttcctgctttgagattttattgttttatgcatatttcatatattgttcttttatcttatttggtaatgcatatatttgaggctactttattactgtcaactcaccttgagccacaacccatttgctcttcatcattatattctaaacaaggatatagaattgatcttcttttatctcactatttagaaaaaataattcttaatttctaagtggttatagttttttattaataacttaaaaagcttttagttttattgagttatggttagaaaatctgactttacaaggtttcttcagtgacccaatataactaattattgtaaatgttctatcagttgttgaaaaagtatattcttttcttgtgcatacagaaataatataaattttttgagaccaagttgccaacacatgaaattaatttttaaatggtccttattcataatatattcagattatttctagtcttcattatttctatttcacccattaaattatattttctctttcggtacttattggtctccattctttactccctgtttccatgcctttttggtgagtgaagcacaattccctccctaggcctggccacatgccttgctttgccaataagcaaacatgatgcaaacagaggcttgaaaaacatttgcacaatttagtttgctctctctcttgaacttttgtcagagctatgagcacatgaccaagctagcctgctagaagatgacagtagaatttgagagacatgtcacagagctgagtcatttctgtcttcccagtagaagtcagcctatattagctgatctcagccaacctccaaacttgtgaatgagcctagttcactggagtagtctagctgataccctttcctctacattggttgtttactgtcctgtaccactgaaaaaaatagataacatatatctgtcaacaaatagaacaaatgtcttcaaaactattgtgtgggtttgattttttttttaaatatctatgtatttctaataattttgacttcacacattttatttatttatttattttgagacaaggcctcactttgtcacccaggctggaatacagtggcattataattgctcactgcagcctcaacctcctgggctcaagcaattctcccgtctcagcctcccaagtagctgggactacaggtatacaccaacatggccggctaatattttttatttttatagaaacaaggtcggccaggcacggcgtctcacgcctgtaatcccagcactttgggaggctgagacggacggatcacaaggttaggagatcgagaccatcttggccaacacggtgaaaccctgtctctactaaaaatacaaaaaattagccaggcatggtggcaggcgcctgtagtcccagctactcgggaggctgagacaggagaatggcatgaacccaggaggcggagcttacagtgagccgagactgtgccactgcactccagcctgggtgagagagcaagactcaaaaacaaaaacaaaaacaaaaacaaaaaacccagaaacaaggtctcaccatgttgcccaggctggtcttgaactcttaggctcaagcgaccccccagccttggcctcctaaagggctgggattacaggcatgagccgacatgcctggccaacacattttaaatctgtacataaacactaatgattactatatccctactgtagacagtaatcgctcataaactgaaaaagaaaaaactgccttctgtgtctcatttagggaaaaatctgtgccttgaattctacttaattaaaatggtaatctctttttttaacttaatttgcatttgcctgatgcataattttctagctacttaaaaatagttacaaaaatagtatatgctcatggttaaaaatttttaatacagaaccatattaaacagtttctgtactgtaaacattttccactgctccatgtttccagcaatcatttatttttaagttttcataatcattttgtgctacttcccagttatagtaacagtattcaaaacagtgtccagaacatggtgatgaatgctcaaaaaatactggttggataaatagatagggggtagatggcttattgatttatgcttataataccaatttattgataaacagcaggctgaagaaatgaaaagaaagctgtggaaataccaacagaagtggtgtagcagctgaagaagtagaaagagggggaagtaacatacctgcaaggttgtgtcactgtagcaaatctattaccccatttcctagctatatctggtctatcactttatgaaagtgcagtcttctctagactctcttttactactgtccataataaaaagaccaataccatttgagacatttatcactggctttttttcctgtgagtttctcagagcagatgcccatgaatactactgatatgtaacagtgaaggggacttcaagtagattgctatctgtctattcaaggtccattcaattgaggtctaccctcaattcttgccctctcaagttatgagatatcagtaagccaggatttcctcttcttactcagaataacatctcagaaaatggaattttgaaggaattactagcattttcccttaatccactccaaaacatgtactactccagtttgttacgctaatacaaattttctccccattcttatatggttctagtcacctagtcacttacaacaaagactttcaaaattttctgatcttgattcatgacacagaatccattttacatcaaaatctagtatatacatatacacatgtgtacactcatacaaaagggggagggggggaacgactccctaaagcaatatttaaccttactacatgcagtgcactattttttctattctactcgtgttttcttttcttttttaacctgggtgtcatctactaagctaattttcattatcattaagaatcatgactggcattggaaaaatacagatttgactcatggttaaaagtgaagggaacaggtttgcaaagagtaaaatatctttgatagagaatgtcttggatccatacattcacctctaaaaataacactgacctcattttagcacaaaatgcactcctagggcctgaaagttctatttcacatattatgaatatggtagtttaggccagaaatacttgtgtggggaagacatgtaggccacatactcattctcataaagaaaattcataaacaaccaatgtttaagaaaagttacactattaacaatttggaaataggatacaggctggacatggtggctcacacctgtaatcccagctgggaagccgaggagggtggatcatgaggtcaggagttcgagaccagcctggccaacatttagtatcctgtctctactaaaaaatacaaaaattggccaggcatggtgggtgcctgcaatcccagctactcaggaggctgaggcagggagaactgcttgaacctgggaggcggaggttgcagtgagccgagatctgtctctgcactccagcctgggcaacagagcgagactctgtctcaagaaaaaaaaacaaaaaaaaacaggatacaggtatgaaagatggattttgatgcattattagtcatggtcaacatttcaacatttaaataaatataatgctaaaataataggaacaatataaatcgtttctcattcttatagttgcttttattatttttattcttaaagtttttaagtttcttggaatcaccctcccatacatgtatagtacaatcactacctttctgaaattaaaaaaatttatgcacaaacatctccccaaaattcctacatgacagaacaatacctgcttaaaaaaatttgtcactgtgagagtagctggtcgaaagctcgtcaagttacaagcatcatctccacttgttgtcctttcaagtgatcgtctgccaacaatactagaattcctcctctctgaccaagacccttttcgttctacaaaagaattaaaaaaaaaattcattttcatagaagttaaattttgttttaaagtagctttccaaacacaaggaagaatctactaaattgaaaattacccactcagcatatcaagtatagtaggagaattttgcttttggagagattagtaagaaagtacctaaatcttctggttgtctttttacaacatcacaggtgtaaaaataagtttctaacatgcaaagatctatgggcatgaccaatgatgagccacaaagagcagctatagaggaagtatgcatttactacaaaatgtttaccacaggaaaattttagtcatcgttaatcttccctcagtcttagctctttagtttgaaagagaattgtaagataatttgtattcaaagtacttgcaagataatcctattatttaaaaccaacagaactagactgaagattaacaaggaaatagaatacttgcacaaaactataaacaaactagacctaatggacatttacactacactaaagtacactaagcaagagcagaatatacattcttgtcaagcacttagaaaatattctctaaaacagtctatatactaagccataaaacaacatacaatacattcaaagagattaaaatcatataaaaatgttctccaacaacagaagaattaaactataaatcaataacagaagaaaatttggggaattcacaaatgtatgtaagtataatagcccatttaaaaaatagctaatggaaaaagaaggaataatagaaattaggaagtatttaagatgtatgaaaatgcaagaacaacataccaaagcattgctaaagcagtgctcgggggaggatttacagctattaatgtctattttaaaaagaactatctcaaatcagtaatataacctcagacttcaacaaactacaaactacaaaagaagagaaaaaaaatccgaaaccagcagaaggctacaagaggcaactgcagagtggaaataaggaaaatagaaactataaaaaccatacagaaaaatcaattaaaccaaaaactgtttgttcaaaaagataaacccgacaaatctttagctaaaatgatgaaccaaaaaaaaaaagactcaaattactaaaatcaggaatgaaagaagagatatcatttacagactttacagagtaaaaggaataaaggaatatacagcaatactatgaacaactgtaggccaacacttagattagataccaactagataactttgatgaaatggacaaatttctagaaagattcaaagtatttatattaaaactgactcaagatgaaagaaaatgtgaatagacctaaaacaagtaaagagatcgagttagtaatgaaaaaacttaccacaaagaaaagaccaggccatgacaggttcactggtgaattcttccaaactttcaaagaataccaatccttcaaaaacccttccaaaaaaatggaaggaacacttcacaactcattctatgaggccagtattaccctgataccaaaaccagacagagtcatcaaaagaaagaaaaactacagactaatataccttatgaatatagatgcaaaaatcctgaacaaaatactagcaaacagactccaacaacacataaaaaagattacatgccatgaccaagcaagacttttcccaggaatttaaggttaatttaacatccaaaaaccacatcattcgatgcaacaccacattaaaaggatacaggacaaataattctaatagaggcagaaaaagtattttacaaaatctaacagactttcatgataaaaacacttttaaaaattagggatagaagagaacttcctcaatctaccaaaatacatctatgaaaagccaacagcaaatatcatacttgatggtgaaagactgattgcattttccctaaagtcaagaataagacaaggatatccactcttgtcatttctaaaacattgcagaagaggttctaataaagacagaaaagagaaagaaataaaaggcacccagactgaaaaagaaaagtgaactactttttatttgcagatgacacggttttgtatacagaaaatcctaaaaaatctggggaaaaaaacgaacaataacaattcgaatttagtaaacaaattcaaaaagggttcagagtataagatcaatatacaaaagccaattttatttctatacactagaaatggactttctaaagacagaattaagaaaacaattccatttaaaatattatcaagaaacgataaaatactacggtataaatttaacaagagaaggacttgtacactgaaaatgacacaacactgaaaaaaatgaaaaagatttaaataaatgaaaaaaatttcatgttcatagattcaaagatttaaaattgttaaaatggcaacaatctataaattgacttagagattcaatgtcagccctatcaaaatcccagatgcctttgtgcacaaactgacagctggtcctaaatttatatggaaataaaagaaacccaaaattgccaaaacaaatcttgaaacaggataaaagctggaagacccactcttctcaatttcaaaacttagccttcaaaggtaaagtaatttggtatagcagcggtccccaacctttctggcaccaaggactggtttcatggaaaaaaatttttccacagatggggttgtggggatcgtttcaggatgattaaagcgcattacatttatcattagagtcccataaggtgcacgtaacctagatcccctgcatgtgcagctcacaatagggttcatgctcctaccagaatctaatgccactactgatctgagaggaggcagagctcaggcgataatgctagctcagctgctgctcacctactgctctacggcccggatcctaacaggcaggacaggtacctgtccgccacctggggattaggaacccctgcagtaaagcactggcatacagatcagtggaatgggatggagagtccagaaataaatcccacatgaatggtcaattgactttcaataagggatctaagaaaattcaatgggaaaagaatagcctttttaataaatggtgctgaaacaactggatatccacataaaaagaatgaaattggactacctcacaacatacaaatattaactcaaaatggattattataaacctaaatgtaacagctgaaactataaaactcttacaagaatacatacaagtaaattttgattcatattacataatggtttcttagataaaacaccaaaagcacagtgacaaaagaaaaaaatagaaaaatgtaacttcctcaaaatttaaaacttctgtgctacgaacaataccatcaagaaaagtgaactcacagactaggagaaaatttgctatcatatattaggcaaggaatttgcatcttgaacatataaagaactcctacaactcaatgccaagaaggttaaaaccccatttaaaaaataggcatcaactattaataaataataaaaagaccaaagccattaaaaaatgagcaaaggttaaaaatacctattactccaagaaagatacacaaatagccaatacacacaaaatgatgcttaatatcgctagcttttaagaaaaggtaaatccaacctacaatgagtaccacttcacttgcactagaatgactacaatcaaagagcagataatatgttacactggtaaagatatgctgaaactggaaccttcacacactagtggaatgctagtggaatttttgaaggtgcagccaaattggaaaacagtgtggcagtccttcaaaagattaagcacagaattatcatatgacccagcaatttcactcctagctatatatctacatatctaaggaaaaaaaatgtccacacgaaagcttgtaaatgacgtttcaacactatgaaacattatgcataataaactaaaagtagaaaacccaaatcaactgataaataaatatagtatatcaatacaacagactatcatttggcaataaaaataaataataccaatacatgctacgacatggatgaacctgaaaaacattatggcaagtgaaagaagctagccacaaaagactacatattatacaagtcaatatgtatgaaatgtctggcatagacaaatctatagagacagaatatatattaaaggttgtttagggacaggttgcaagactctgggggaatgaggagtgaccactgctaatgggtacaaaagtgttccaagatggatacagaagtattctgtagcagtggttgcagaaccctgtgaatataccaagaaaacactgcacagtaagtcctcatttaacatcatggatcagttcttcaaaactgtgactttaagcaacacgttgtataacaaatcaattttaccacatgctaatcaatataagcaagagttaagtccctacagcatatttctggtcacaaaaacttaaccaaacttctaaatattcaaaacacttctaatattaaacattcaaataaatgtgcactgtacatacatttaagaaagattaataaaaataagtaggataattatttacccaattatcccagttcagggtcacaaatggccgaagcctgttccagcagcgcatgaaagaaggcagtgtatggcaaatgcacccgacagcagtaacttaagcaagccctgagaatgaccctatggtctaaaaagaatgtgtattcggagttccgagctaaggaacctgggagtggccaaacttgaagactcattccttatctatgagaataaggacatctgaacttctagcccatccagtgaaatctaggccatacatggaatcaaggccctttgttttgggttaaatgagggtttccaggtagaagttactagggggaggatgctaagtgaaaatgctacataaactgcatgctttttcaagtggctgtggttttcggtccagctcgccactctgcatgtaagttccctcagtaaaccctatgtctcattctctggctccccatctcttcttcagcctgtgatatgatgttatacttaccaaagtcaataggggtcccgcacgacaggcaggcacctgtcctggacaggacgctattccatcacaggtgcactcacacacacacacccatgttaccttacgctgctaccacttaagacatgccaattaacctcatgcacacagctttgggatttgggaggaaatgagtacccaaaactccccacacagacttggggagaacatgcaaactctacacagacagtagctccagccaggaatcaatttgtttcctcatcaacattataaaaaatcaaaaacaaaatgagatatttgaagatctcctgtattgtacaatttaaattggtgacttatatggtatgtgaattatatcttaataatggtgttaaatgagaaaaaggcaaaaaaaaagaaaaaagaaaatcctttttatgcaatattacattgcagagtctacaaatgaaacaagcttatataagaaaaaagaggccgggcatggtggctcacatctataatcccagcattttgggaggccgaggcaggcagatcacttgaggtcaggagttcgagaccagtttggccaaaatggtgaaaccccatctctactaaaaatacaaaaattagccaggcgtggtggcgcacatctgtaatctcagctactcaggaggctgaggcaggagaattgcttgaaccccggtggcaaaggttgcagtgagccaagatcgtgccactgccctccagcctaggccatagagcgaaactccatctcaaaaaaaaaagaaaaaagtaaacatttagaaatgttttgtatgaaacactcttacctccagtactgatttctacttctgtagaatctctttccaaactcccagcactgctaacaatattcattaaatggattgcagtccaagcaaaaggcatgcgatatttcccaagtctttggcaaaactgatctgcttgactcttcagtttctccagtttttctttattctgcaaaacagaactttatacattatatgattatacttgaaagaaatcagttaaaggctatttcatactacataaaggaaaaggatgagaagtctcaattctcagcagagatgagaaaaaaatctgtaccttacagagatgaagtattagtgcaatatcttaaccagtgaacaaactcaacacattctacaaatgtacgtacagagcaggtctttgaaatttctatttgtgattatgttattctggggagaagagagtaagtaccaaacatgtattatgtattccaagtattgttttaggaagtataaccatggtctagtcagcaactggtaactacaaaatattctagttataatttgttaaattttgttactctataaaagatggaagtagctgagcacatttgaaatagtccctaacatataacaaccatgagttaagagtggggaagcacgaataggccaatgataaacaagctcagagttgtaacaaaagaaggaaagtaaaaagtaaaaaggaaagtagaagaagactaaacgctggaaaaagactaacggtccaaatatttaatagtacaagcatatctggaagacatcttgaggctggctcaacttttaggctactcctgaaacaaacatcaagaggtggcctgcaaaagccaatcaacactcaagactgaaacctatactacctctctcatatactctttgcagatgggatgttgaagtatacactaatgacagtgtcctaccttgggactcagggctagaaaaagatgaaacgataactaaatgatagcactattactatctctactatacccttaaaacagttcttattttaagtatatttcaagtatacttaattctatcagtgtatgtaaatataagtaaaaagcagaataagctgctagtatatttaagagcactatgtaacagagcaaatttaatgtaaaatgacaacctggggacagccagaatactatacttaaaccattagttcagccaggtaatcaaggatcaagaaaaaaatatcatgtgctcagatctacagaaaaagctcagttcttgttatgaatcttgggaaaatagcaaaacattttctgggtttgggttgcttacccagtattcctcaagcatacttctcccagaagttccagtattaaatcttgtgttcaaagatccaaagatcacttgtattcttgtagctaacccatagtatctgaaatttgttatcaattatccaactttttttttgcttttataagtttatacacattctagcaattaggctgggtatggtggctcacatctgtaatcccagcactttgggaggctgagggaggtggatcacttgagttcaggagttcaagaccagcctgaccaacatggtaaaaccccatctctactaaaaatacaaaaattagctgggtgtggtggcacatgcctgtaatttgagctgcttgggaggctgaggcaggagaatcacttgaacccaggaagcggaggttgcagtgggccaagatcctgccactggactccagcttgggtgacagagcaagactatgtctcaaaagaaaaaaaaaatctagaaattagccatctgatggcaaaaaaaggctgtattttctttttttaaagactattatatttttactatattccttaataatctgcagtcagatggaagacaagaatacttctattttgctaggaaaagttctgtcaatatcactattttataaataaagaaaacctttaataattcaggagttaaactgaattaatttagttctctccatgaagaaaaaaatgtaaagagtcagttagttttgagatagaagagatttttaaagaataccacagcatatgaaacatatgacacaggctaggtgacaaattaaataaagaagaaaggaagataggaagtgggcaaacagaaaaaaatatagtactagtaaaattccttaatatgctttgttgcatattaaagctattaattgctattgcatataaaatgctattgggagaatagtattctcccaagttacaatagtaataatgtggcggaaatgagaagcataacattctaccttggtggcatctgcttctttgaaaatcatatatggttctgcacactctccaatgtctccttgctgtaggactttttctagctgtcaaaggcaaaaaaagttaagattaagcttttaaaagcctgaaattcaaggatggttcaatatacgaaaatcaatataacacattaacagaatgacagaaaaaaatatatgacatctcaattgctgtagaacaaacattagacaaaattcagtactctttcatggcagaaacgctcaacaaagtagtaatgcaaagaaactaccataataaaggccatatatgaaaagcccacagttaacatcatactcaatggttaaagactgaaagcttttcctctaacatcatgaacaagacaagaatgcccacattagcctcacctattaggcatagtaatggaagcccaagcctgagaactaaacaagaaaaatacgtaaagcatctgaattggaaaggaagaagtaaaattatctcgcaaatgctatgatcttttatgtagaaaactttaaagatgccacacaaaaaactgttagaactaataaatgaattcaacaaagttacaggatacaaaatctatatactagcaatgaggaatcgaaaaaggaaatttaaaaaaaaatttcatttataataccatcaaaaagagtaagatacttacaaataaacttaaccaagaaagtaaaggatctatatacactgaagactataaaacattgctgagagaagttaaattaggcacaaataaatgaaaagaaatcctgtgttcatggactgaaaagatttgatatcattaagatgtcaaaactacccaaagcaatctataagcttaatgcaatccttatcaaaatctcaatgttttttttttttttttttgcagaaatagaaaaacccatcctagaattcatagggaaattcaagagaccctgaataatcaaaacaaatttagggaaaaaagaagaaagttgaaagtctcatacttcctgatatgaaaatgtatttataaactacaataatcaaaacagatctaagatatatatataattcctattagttctgtttcactggagaattctaataaagagttcaagaaaaattaggtagcacctactgtgtatgtccaatattgtgttaaagaatatcaagatgaaaaaaatatgtaaaggtcaaatctttgcccttgaaaagtttataatactgacagacaagtatacagacactacaaaataaacaaatatatttaacattattctcacctttattacaagaaaaacatcttgggaaggataagtgatagaaaaaattgctgatcttgccagggtagtaatggcagcaggtggtacatgtggacgtaacaaccctttcatctgctcagaattaaggtcaaaataaaagttttctgaaatctaaaaaatattagtatgttaaactttaaaatatgtacattttacagtgtctatttcttaaaagaaagctgcttctgctacttacttttagaactctttcaatgaaacaataatctgttttcaattacagtaattataataagaaaacatttaatcttaataaattaaatttctattttctttttaaaaacattcatgttaaataattctcaaaaaaattacttatttatctacagatagtaggatattatactctcatgtaaagtttatatttcactgagaccaatctttacatacctaaatcaaagtaaaaaaagtaaacaagctatttggaaaacataataagcatattctaaacaaccatattccaaattcttttaattagaggtgaggggatcaaggtcaggagattgagatcatcctggccaaaatggggaaaccccatctctactaaaatacaaaaaattagccgggcatggtggcaggcgcctatagtcccagctactcgggaggctgagccaggggaatcgcttgaacctgggaggtagaggctgcagtgagccgagatcgcgccactacactccagcctggcaaaagagcaagactcaatctcaaaaaaaaaaaaaagtaacctctaataaagtatacaaagaaattatcattgagatgatggattccaaagtgacttttaaaaaaatttatgaataatatcccagcagtttcgagttagcaaataaaagttgctagagcagaattccattaaagaaatccataatatgtcttgtgttggcagcagaagccactgaaggcacttcaagtttccttttttctttttttaattttaaattgtttttagtagcaatggcggggccgggcggggggtggtctcactatgttgcccaggccggtcttgaactcctggcctcaagcaattctcccactttggcctgccaaagtgctgcaattacagatgtgagccacaagcacccggccagcacttcaagtttctactacatattagtcttagaatattaaattaagaaatgttgtaaaataaccttctgacacgcctgtaatcccagcactttgggaggccaagatgggcggatcacgaggtcagaagatcgagatcatcctggctaacacggtgaaatcccatctctactaaaaatacaaaaagttagctgggcgtagtggcgggcgcctgtagtcccagctactcgggaggctgagacaggaaaatggcgtgaacctgggaggcggagcttgcgctggtgagaatttgaaaatcatgtcaataaaaattcactgtcattgtcattcctattgttatgtactgcttgccaaaagtgattttcttatattgtcttttctatttcttaaagttgcttctgctatttgcttttaacactctttcagtgaaacaataacctgttttcaattacagtaatttataagaaaatatttaactagtcctaataagttaaatttctatttcctttttaaaaagatctatgtttaacagttctcaaaaaaaatcaatcttataaaacaaacaggtttctgaaaccaatgattatgacaaataactatggtcaaattatataatcttacctttttcttttccttgacatcatataaagccaaacttgcaaaaatgggttcaatttcaatttcaaacctttatgaagaaaaaggataaaataatttaaagataaacatgaaatacacagttggagagaaattgattccaaaactaaattatcacaatacttggcagttttctacacctgtgcctttgcctatattaaaacttcttcttgaaatacactcttctatgcatatcgttcagagtctaaatcaaccttatcttctctagttaatcctaattaatttatccagctacaaataaactcaaactacctaaaagcctaatgacatattatgtccattctgaggcactaatcactttctaacatggtcacttatatatgtagatatgttcatttttaaataagttttaaaaataaaagcctaatgttttctttttcagattataaataatatattcaatgcaaaaatcttagaaaacacatgaatattcagaggaaaacaggagcatccaaagaatcataattaacagtttaatgcctaatccatctagactttatgcataaatgcacttgccaaacaaatttttttaaacagtgtcacagtatacataatttgtagtctgcttttttaacttaacattttgtggacaaattttcacgttataaatattattcttaccatcttttttaatgctggcatagtaattcccattatatgaatacggcaaaattgtatacttaattgagatgtctaactcatttctaagaacaatgacttacatacagtaaacatctagtaaatatttgttgaatgaaataatatataatgtgaggttaactaaaactctagagtagaggttctcaatgaaggacaattttgcccccaagggaacatttggcaatacctacatacatttttggttatcgaaactacaggagtattactgtcacttagcagttagaagtcagagatatgactgaacatcctacgctgtacaggacagtccctgacaacaaagaaccatctagacaaaaaagtcaatagtgctgacattgtaataaccctgctccacattgcatggtattaaaagagaatcgaggaccttgtagaaaatacacaacatatttacattagggtgagactttaataaagggacatttacaaggatttggacaggatcttgaggaaacaactacagagtgccattccctggggctagcaaaagcaagtcattaccaaccatagacctaaaagagaacatggaagtaataaccaaaaattagaaaagatagctataccgaaggtccttcacaggaactggccttggaaagaaagaggcaacagatctaagtgactcagcagggaactctcttctaccctctaacttcctgctgatacatcccttagtaaaacccaactacaagtcaaatgaaaagagatcttggtgatcctgtccacgtgtcaacctctacaaaacctactctgcatcattttgatactgtcggtccatttattttggccaatccagtaaataagcagtatcccactggatttttaatgggaatcttttcatctattcactgaccattgggatattttcggttggcccatttttctatttattgtttgactctttcctcatgaatttgttgttctttatgcattctagaaatgagcacactgccaagtatatgtgttggaaataccttctccttctctatgatttatcttctcttgcgcctttcgatgaacgaaagttgtccattttaatgaagtaaaatgtgtcaatgttttcttctaggggtagtgctttctgtgtcatgtcaaagaaatatttttctttctataagatcataaagatatccctacattatcttctggaaactttaccattttgtccttcacatttatgtctactctctatctgtaaaaaaaattttgtgtatcatgggaggcagtggtcaagtttcctattttcatatctatatatatgaatatatattttcatgaatatatatattttttcatgaatatatattttcatgaatatatattttcatgaatatatattttttcatgaatatatattttcatgaatatatatattttttcatgaatatatattttcatgaatatatatatatagatatgaaaataggaaacttgaccactgcctcccatgatacaaattatatatatatatgagaaacacatacatagacaagacagatagacacaaagagaggaaagcaggggggagaaacagatatccaactgtcctgccaatttattgaaaggattaccctttccatactataaaaaacgtccactgttattacaaatcaaaaatgcataaacatgtaggtccttttttagctctttttttttagttgaagtaataaatgtttaatgaaataattttacataatattaacagcattcatttggcaaaatatttacatgtttgtagagtactactgtatataaagtgggaatatatcaagtacagacttttctagctctttcctctactccagtgctctagttgtctaatcatgtaccaatactataccatcttaattacatagtttcatactagtcttgatatctggttgggtttttttaaataaagttcttcaaaactgtcctgcctcttttggccctttgtattttcatataaattatagattcagctaaaaataaacaaaagcaaatcaaagtgaaatgctaatttacttattcagaaaattagaggccaaggtgggaggatcgcttgaggccaggagttcaagaccagcctaggaaacacagcaagatccaatttctaattttttaaaagaaagaaaattagtatcccaatgtgtaacttagtgcaaactttgtaatactcttttttttttttttttttttttttttgagatggagtctcgctctgtcgcccaggctggagtgcagtggctcgatctcggctcactgcaagctccacctcctgggttcacgccattctcctgcctcagcctcccgagtagctgggattacaggcgcatgccaccacacccagccaattttttgtatttttagtagagggttcactgtgttagccaggatggtcttgatctcctgacctggtgatccacctgcctcggcctcccaaagtgctgggattacaggcgtgagccaccgggcccggccaataactttataatatttttaaaccgcatttaaagatccatattattactatcatgaacaaaggatggaactctggagaaaataaactgaagaaaccaacacaaatccagtgagctctactttaagtagacaagaatttaaactgccaaaaatgtatatgtagagttttttcttttttttttttaagtatattcctcatggattcagtacacaatttgagcaactgcaaaaaaaatgaatgccacattatttttatactatcaaacataggcatgtttcaagaaatgctacttgctgagcaatactcaatggctattatgctgcaaaacaggtattttttattcactataaatgtaccactctacatactcacttatttaaaatgttgagaatacttacaacgatgaaagaaaaaaacattttttaatcaccaaaggcctaccataagacattactaataagatgtggcttatttgttaggtcttttgaaaattaagtgtgtgggctgggcacggtggctcactcctgtaatcccagcactttgggaggccgaggcaggtggatcacgagatcaagagaccgagaccatcctggccaacatggccaacatggggaaaccccgtctctactaaaaatacaaaaaattagccaggcatggtggcaggcgcctgtagtcccagctactagggaggctgaggcaggagaatcacttgaacccgggaggcggaggttgcagtgagccgagattctgccattgcactccagcctggcaacaaagcaagaccccgtctcaaaaaaaagaaagaaaaaattaagtgtgtgtgtgtgtatttgttccctttcaaagtgatttatttgattctgatcacaaaatacagggaaggagcaagggcaacgcctataacctcttggttgcacatgttcccagtctatgtgtctataaataccctttgtacaacagcaaactcatgctgtcccccatgcgttgtttcacattctagcagctacagagtatagcatatgaccaggtgggaagttaaaacagatgccctattcacaaggtagagttcccctccaaatagtgttccagctcccttgtgctactactactgaaaccaaagtagctggttgttcctactactgatcttctaaaattctttcatgaacaagtaggtcatagacaaattatgtctgcacaattcttagagtggcttaaagtaaccttatagaaaggcagtgactaaggtctgttccttgcccccagcttcctacatcccaggctgcctgtggcacctggactgcccctcctggatcccccacatcccagggcagcagtgaaagaagggcaggccaggccaagcatgaggcgtaaacagtctttattggactcagaccaggagtccatggctcttgaggacctctatgtatttgtcagttttcttctccatgttcttttggcctgtttctatagactcatgagctgtcttttcttccagtagtggatcttagctttcttctttctcttcttctccatggtggctgtcactgcctggtacttccagccaacaccatgagccaggagccccaggtaggcaaactttctcacaggcttcaggcacacaaccttgagggcagcaggaaccacagtccactttttgtcataggggagtgggatcccatcaaacatcttgaggtggtccaaagcagcctggcctcacttggtcttgtggggcagcatgcttcacatggtccaccaaaagaggtggctgggggcttggaaatggtagggtcctcagaaaggattggtgttcatctacttgcagaggaaggccaggtactttaacttgtttctgtagaaattgccagaaatgtggatgccctcgcaacacatgatcaccaccttccagcccagcagtacctgcttggccacaatggccgctgggcaacccggagatggcctcagcctcatgcaccagggccttccccctcccaactttggcagccacctgggaaaggctaaattgggtgtgttttcacatttgcttacaaacaattatagtacagtttttaacattttatcaatatgtgttgaccctctgttttgacttaaagtcaattttgtaagacgttaatattgttccctcagctttcattaggttaatatttgccattatatcgtaatatatatttttactttcaatctttctgggtgcttatgttttacatggattgcctgttctttaataaaagacatgtaactgggtttttttttaatgcaatccgataatctgtctcttaaatggatagtttagtccatttatacttattcttaagacttatatttggattcatttctagcagctttttttaattgtttactttttctttttttttttttgagacggagtcttgctctgtcacccaggctggagtgcaatggtgtgatctctactcactgaaacctccgcctcctgggttcaagcgattctcctgcctcagcctcccgagtagctgggattacagatgcatgccaacatgcccggctaattttttgtatttttagtggagatgggttttaccatgttgtccaggcttgaactcctgacctcaggtgatctgtccgcctcggcctcccaaagtgctgggattataggcgtgagccaccgtgcctggcctgttctactttttctaagtgtttttccattcttgacttctttctcttggactgacttatagttccactttcaagccagtttttctcctttgcctataatttacatttctatttttttaatggttactcaagaacttttaaagtacatagttaagttttaaaatatcaatatctttattattctcccaaacagtaagatcttagaatgtttcaaccctaatcaacccccaatttatacattgtgttattgattttgttctatcttaattattttaacctcataaactagactctattaccacaaacacaggtttatctttatgtttttcaatttctttgttcatcattcttctacctaaaatctttcttcctgaagtaattcctttagaagttacatttttagtgataaagtattgtagaaaacactaacaatttttatcagtataaaaagttatttacctcatcatttgcagatttcaaaaaaatgaatgcaaattctttgcagatcctcccattaagaaaagtctatttctccataccttgaattcaggctacccttgtgatttgttttgatcaataaatgatatgctgtaagagttttaatccaaggccacaagaggtcttacagcttccactctcctttttctgaaaacccttccaccactacatgaacaagcccaggtcagcccactggacaatgggaaaagcatagctactttcccagttgacattaagccaactgccaaatatataaaagagagactcctagaccaacctgcctgctaactaccagacatgcacaactcctttatagatcatccagtcccaaccaaattggcccagactacaagaactacccagataacccacagaattatgagaaatactgaacatttgtttttttaaaacattacatcttaaggtggtttacagtgcagcaaaaactaactgcttcaagaatgtgtttgttgaaaggtaattttactgggtatgaagtttgtggtcaacaattattttctcttaacaacactgaagataacactcaatgtcttctggcttccattgctgctgtgataaatcagctgttaggctaattgtaatttctttgcataggatctctttttctctctggccgcttttaatacagtttcttggttttgtattctccatttttactatgtttagtctggatatgaatttctttttatttattcttcctagatcctactagacatccagaattgagagttactactatgtttcataaattctgaacaattgtcagccattatctcttcaataattgttttcttcttccctaagttatttccattctagaattcaaattagactttttgttgatatcactttattttccatctatttacatctttgtgtacattttgtataaatttgttcagttttatcatcaagttcacttattcagtcttcagttttatctaatctacgttgagcccatctaaatggatttataattttaattataaaatcttgaaaaagatcaaatgaatccttttaaaaatcttcctggtcaattctgagagtctcttgttcctttataatattttaaaataattatttacttaaatatattaaaagtacttatattctaaatctgattggtagtcctcttcaggtctgcagtttgttttgccatgtttgttgatttacgactggagctgaaactttacctgtagaaatattttaaggcctatatttttaaagtgaattcctctaaaaacaattaattgatgtatgcttctgccaggtacctagggccactgcaatctagaaccactttaaactaaacttttgccttggaattttttgagccacacatatagtaggtaagcttatgacctggaattctcaagagctttctctttttattttttcctgtttcctgtctgacttttccctgccagagccgaagttgcagcaaacaaatatcactactatttctaatattactctcatgaaatctggtgttaggcatttatgcaggagcatttccatcctccttgcatgccaagctctttcccttgtagcccattaaaaccaggatgagcaacagccctaatgtaaaattagctacagaacacttactcctgggaaattatgatttcttagcatttcttggctaaattcatatcaacttgaccatgcctagaagatattcccctgaatgtataaatcactatgttactgacaaatagtcttcttaatagtagaaataatgttctcatccaggataaaggaaggctgttcttagggaacaaaatgtaagagaaatgattttcaaaaatatatcagtttctatagttagctaaagtaaagctatcatttctgactgtttctgaacttctgtgacctcaagttcttcctcactttaaacctggacttttcttatcatagacaaatcagatgtatataattattactttagaatttttaatgagagacaaacaaaagttaaatagttgtacaaaaaaatcattctatattttatttctctgagagaaataaacttgtaacttttattaatcaagaagatcataagtaaagctacaatgacacaccactttacacccactagaatggttatgataaaaaaaacagataataacaaatattggtgaaaacgtggagaaattagaatcatcctaacttgctagtggtaatgtaaaatggtgcagctgctttggaaaacagtctggataattcctccaaaagttaaacatggagttactatactaaccataattcctatcctaggtatatacccaagagaaatgaaaacacgtgtcccacaaaaacctatatacaaattatcaacttagccaaaaagtggaagcaatcattactgattaatagataaatagaatgtggcatatgcatcaatggaatatcactcagcaatgaaaaagaaatggtagtactgacacatgttacagcacaagccttaaaaacactaggaaaactaagtttaaaaaaaaaaaacaaaaaggactacatattgcatgattccatttataggaaataatcagaataagcaaatctgtagagacagaaagtaggacagtggttgcctacggatggaggagttgaggaaaagaggcacttactattaacaaatatgagatttctttttgggatgatgaaagaactctaaaatttattgcaataatagttgcacaaatctaagaatatactgaaatccactgaattgtatgcttggtgaactgggtgaattcactggtgaactgtacactgaatatacactgagtgaaccacataatacgtgaattatacctcaataaagctatttttctttttaaagtagaaacaacccaaatgctcactgactgataaatggattaacaaaaagtggtgtatccacacagtggaatattgttcagtcatacaaaaaaataaactactcggccaggcgtggtggctcacacctgtaatcccagcactttgggaggctgaggcaggcagaacacgaggtcaggagatcgagaccatcctggccaacgtggtgaaacctcatctctactaaaaatacaaaaaattagccaggcgtggtgacatgcacctgtaatcccagctactcagggggctgaggcaggagaatcgcttgaacccgggaggcggaggttgcagtaagccgagatcgcaccactgcactccagcctgggcaacatgggcaacagagtgagactccgtctcaaaaaaaaaaaaacaaaaaaaaaacccactcatatatgctataacacagatgaacgttgaaaacattatgctgtatgaagaaaccagacacaaatggccacatataattccacttacatgaaataatcagaatgggtaagctcatagagacaaaaagaaaattagtgattgtcaggtgctgaggaaaagagagaacagggagtgattactaacaggtattgttatggtatgaaatgtatcatcccccaaaattcatatgttaaagccctaacccccaatgtgactgtaattggaaataagccctttagggcttattaaggttaaatgaggtcctaagagtggggcactaattccatggaactggtatccttataagaagaggaagagataccagagacctctctctctctgtgcacacacagaagaaaagtcatgtgagaatgcagcaagcagcagccatctgcaagccagagagagatgcctcatgagaaaccaacccactggcaccctgatctttgacttctagcctctacaactctgagaaataaatttctactgtgtcagctacgcattctatggtattttgttatagcagcctgagcagactgatacaggtaaggagtttcttcctggggtaatgagtatgttctcaagttagacagtaatgacagctgtgcaactctgtgaatacataccactaacttgtatactttaaaagggttaattttatgatatataaattagatcacaataaagctgttaaaaaacaaaataagattataagtaagaactgatgttaggtgtcctgttattcaaaagattcaatgcacttaatctatctaacatgtttctgaataaatctaactaaatatacaaagccttagctttcaaggaaagaaattgccagaattatatatagacatcgtctgtccctatgagttgcttgtttcagaaagctctatgaattgaaacttttttcttaagtcagaacaaataattaaacttataatattaacatgacagcatgaaataagagaaagcactttgtaaagcagaatgtaaacataacacctcaatgatgttagcagaaatcagatctaagttttttaaagaaggaaaaaatacgtatttcaaaatcttcaaaaatcaaagcctactgtaaaatcaactctttgattttatatttgttatatggcagacttagcttcatatatatcttaggcttagaacagcaggattagcttcatacataggtttgaatgctgaatagcacttaaaatgatatacagaatttaaaagttgactttatgtttgctacacagtaggcttagcttcataaatacgttaggcttagcacagtaggctcagcttcatacatacgtttgaatgctgaatagtatttaaaatgacatgtagaacaatacttctcaaaaggacacaaatgcaactataaaatctactcagattttgttacatcactactaaaattttatcctggaaaataaaagttgtaagtaaaagaaataaatactcacttgagtgataagcattttacaagaagtctttgaccaaaatgttctttgggtatatcaggaacactaagccgttctattggttcttcctacaaattgaaaagcaacaccaaaatgaatatgcttatcatattccaactctttatctttttcagaacttactttactaatctaacacttttagtcttcacaatagaacatagagaagaatgacctatttatccacagacagaagtcatttgattataacttactcattaagaatagtaaattcactagtataaaatgtattcatttataaaaattacagctgtttcagttgctttatcctctacattttgtaatactatatatcaatcataatcccaaaagatcaattttaataatcatttgcttctttatatgcaaacatctatacctcatctggtgatggatgcaaagcaaaaagttctttgtgacggtttgatttcctttggtcatcattctgacggtctatttcttcatttggagttcgatcaagtaaattgggaagcaaagcatcaggaagtgaatttttcaagtcaaagatactacaggcccagctaccccttggggtatcatctattgacattgaacgtcttttaaggtcatcctgtcatgcaaaacattaaatataaatatattaattaataaattgacaactatttttaaataacttcttatagttatttaagaataaaagtattacttgatcatcctggtagctgttgccatctggagcttcatcagattcaaaaacttgttttggcaaacctttttgcctttctttctgtttatctaatgtattgggattaaatcctgttcccaatttatgatatctattaaagaaaaaaagttaaataaatatcaactatcaaacttaggaattttttcactttttgggcatcattatgtaataagccaagtgttttctgcattatttctttatgtaataagaatctattctagcaatttaggttaaagaaaatttatattcaatgttcctttaacccagctaaggagtagagtatgagtttccaaaagcaaatcatattttccttctttccatgccaatcatgtgtatataaattaagctgtactttcaattcagagaattggtcagtaaaaagaaaacttgggaagccagtaacttgggttaaagaataaaatgagaaatagaaaacatacactgaattaagaataatataaattttaaaaggttatatacatataaagcactgaatcttaaaatttcaagtagccaagaaattttttgctatctctcgttatctataaaagatcttaacctaaagctgcagacttgtaaaatgaaaaacagcaaaatctacaccatcactgtgtacatatatatattaacattacatatatacacagttagctaaaaacaactcttaaattaatgcaagcttctttcttaacaatccaataacaacctaatacccaagaacatcaaatatgagctgatcaaaaagcaattattgttcgtgattcaacacttcatagagccaaactgaaggaacattttagttgaagcaaaacaataatgttcacaagatggtatagttcttgttatcacccaatttatgagacagtaaagaatcacatttgatatgaattactcacatccagtcttgttgctaaagctattaaaatagcaattacatgatattaacatcactgcataatcgcaaaagaaagtattttctctgaaagaactaaagacactcaatatagtaacatgaaagttattacttagaagcaggtatcttaatctttaatggaatgtttcaagtgtcttaatttgtaaagctgcatacgtaagctgctctgataaatcagaatgctactgaattctatactaaaaaaattgacgatatgaaattcaagaaagcaaagaatgattcatgatcaatactctcttctatgtcatcctgtcctctagtctgttgctatgataaggctctaataattacccattcaaccccacacacatcaccatttttctgacttgtttcttagcattctcactctcatttacggttccagccacactgtcctctttactctttgttccttgaacatttctagcatgctttcaatatggagccttagcatgtattgctcttccctctgcctaataacattcttcccccagatatttacagggctcacttccttcaggtctctgctcaaaatcaccttatcagtaaggcttcctctgattaattatataaaacagaaggtcgagcatggtggctcacacctgtaatcccaacacttggggaggctgaagtaagaggatggcttgaggccaggaattcaaggtaacagagagagaccttgtcccaagtaaataactaaatagaaaccaaaataaataataaaataaaaatatttgtccctcttcttggccctctctatccacttcatcctacttttttctccactgactcacctagatcatatttagtctatatttacctgtgttggtttattgtctattgacaatctcatctcccactagaatataaactccatgagggtagagagttggtttcgttcactgctgtatcatcagtctttagtatagtgcctggtacatataagactctcaataaacactaactgaataaataaataaatgaagtacttttgtgtccctttatcatactgtgctgaatcgtggaagaatttcatggcttccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaaagaactcaaacaaatttacaagaaaaaaacaaacaaccctatcaaaaagtgggcaaacgatatgaacagacacttctcaaaagaagacatttctgcagccaacagacacatgaaaaaatgctcatcatcactggccatcagagaaatgcaaatcaaaaccataatgagacaccatctcacaccagttagaatggcgatcattaaaaagtcaggaaacaacaggtgctggagaggatgtggagaaacaggaacacttttacagtgttggtgggactgtaaactagttcaaccactgtggaagacagtgtggcaattcctcagggatctagaactagaaatactatttgacccagccatcccattactgggtatatacccaaaggattataaatcatgctgctataaagacacatgcacacgtatgtttactgcggtgctattcacaatagcaaagacttggaaccaacccaaatgtccatcaatgatagactggattaagaaaatgtggcacatatacaccatggaatactatgcagccataaaaaaggatgagttcatgtcctttgtagggacatggatgaagctggaaaccatcattctcagcaaactattgcaaggacaaaaaaccaaacaccacatgttctcactcacaggtgagaattgaacaatgagaacatgtggagacaggaaggggaacatcacacacaggggcctgttgtggggtggggggagggggagggggagggatagcattaggagatatacctaatataaatgacgagttaatgggtgcagcacaccaacatggcacatgtatacatatgtaacaaacctgcaagttgtgcacatgtaccctagaacttaaagtataataaaaaaaaaaaaaagaaaaaaaagaaaagtttatcgcatggctcgcagacctctgtaaggggggagcccgaaaaaaaaaaaaaagaattctgtggcttcatcttatagctatttcacttttcagccatatccacaccgccattaagcccatctgctgagtctgtaatacttttttcactaatcaaaattttaatttccaaagataacgaattgatttttatatggttaaaatacctttcacatttctcatgcacattattctcatgtatgtaagtgtattctttacacttacagatcttaatctgtgttccattaactatttcctaaattattacttcttttatttgtagttggataattctatttcaagtgtattggtttgcatcaaatacttggcaattttgggttctatcttaattttttaatttgtatcccccacatctgtcttaaactactgtatctgcttaccccagcccatatccagtggttgcagggaaagggcagatcacgccaccaagcaaagtctgccagtacctagtcttctgggtatgaggaatccttcttcctccaagatgtgctcaccctgggcgctattctattagcctaagcctccacaattactgatcctaaataaataaataaataaaggcagatatctctgctgtcactgtgcacacatggtggaagaggtttcagagtaactacatatccaatatttaccaagtctccctttccattgcctgcattcactggttctgagcttaaagcactactgaagcttttgcatgtatcttctccttagattattctgtactatagttttctcttacattccaatcacacctatcttctttgtttcagagatacctcataacttctagttcaccaaaagtactccctttggtcttccacttaccagtgcatataatgtataatatctagtataatagaaaaaaataagggctttagaatctgatgcccctatattccaatcctgactactctattttttggtttgtgggatctcagagaagttacctaactactctgagcctgagccaccttatctgttaaaaccttaaatgagatgagtgcaaagtgcccaataaaatgcccagcacacagtaaacccataaatgttaattctcttatcctcttgcctaaaccaaggttaacaaccctgtgcttagaagtagcagatttccatgattctgaggtcaatatattttacaactaacctttttattaagatttctgattataggtttctaacatatatgcacagaggtaaagacttttgaattatctgactgagaaacagtattcttcagtaatgtctaaaatttggctaccagaatacttatcaaaattgtaagttcataaaaacagctcttctatataaagggcagcagactgtgcttttattaggtcacactgaaactaaaaagcatgtcagcattatcccccagagtgatatttagcacaatgtaaagcctagtgaaataagacagccatgagggcaaaacaatcagcaatggatatatcacttttgctagtgctattttgcatagattatttcatttgtgaaaactataatgccgtatcagaattctccactacttcaatcatatctccttcagaaaaatcaaataaggttaagaagattcagtatgaagacccttctccattatgcaaattagcaaatgattattgtgtaaatcagttttattatacttcttaatctgacttgctattgcacagtttattaggaaaataaattttggctagaacaaaacattattttttacaaatatttacctgattggatgtagaggtcaaagacctataaatattagttagaaacagcagagacctttcaaatagcttggtctgtaaaactgcctgttaattttaacttagctatttaagtttcactaaactggattctttttgagaaatacaaattattcatcaatatctacccaatatttcctaaaagaattagaccacaaaatcattatcatacattagtagctcttaatgatttataataatacagaaatactattttcccatgaattatattttacaaagaaagtaaaagtattacagaaatcctaaggagtaaatatctatacacaaaagttcttcttttgtttcttcagctattttgtttaaataaattttcaggtctcataaacattacgaatctgccttaatccatttagaaatcttactcaatatttgtaaatgttgtaataaacatataacttactttctgatgacaattgcccagtcttctgtataacttcttatacagtctctaacatgtggatccatttcactattttaaaaaggaaaatacatttgtaatttagacgggacagcactgatgttcattaatttggttgctacaatcgctgtttgcgtaacaggaaatgatgatgctataagaagtaggctctaaataaaataatggaaggtagcctttctatagttcctctaaagccaaaaataagtcaatgtctccttacctttcttcaggtacagctgaaacaagagttctgcagtcccgaggactataaacaacttcaatatcatctggaggaaattcaatcaaatcccgtaaaggcccagaatccacagccaaaggatgagtaatgaggtaatcttccaaatccactggatctactgcttcggtaaggggcacctttgtaaaaagttgggataagagatgggtagaaaacaagaggtgaatgtaataattttaaaacttaaggcaaataacatttttttaaataaaagcttttaatctagttctttctaaaattttcacagatattcaaccagatgcactaaagaaaacacaaagtgttacccttcttgtactccttgatgttttgggtcatactctctttaatgtccttgctgatactttgcccagaactctcacataaaaacactagtaagaattaacagttttattctactttatagtttacaaagtactcactggaaggattatttttgcttttttatatctttggatattaaaaaaaaaagtaagttgctacgtttctaaacagtgctcttactttatttcttgtttttgttgattatcctagtaaaaacatataatcagactggggtaggctaaaaaatgtccctccaaaaattctccacatcctaacacatgggccctgtacatgtcaccttatatggaaaaaaataaaaaataaaacagtctttgcagatgtaattaaggatcttaaaacgggagtattatgctggattatccaggtggtttctaaatgcaatcacatatatcctcatgaggagacagagggagattaggctatacacagagagaaaaaatttgtataaagatgaaaaagagagagatttgaatatcctggccttgaagatagagatgatgtgatcacaagtcaaggaatgccaaagccatcagaatttggaagagacaaagaactgatactccaggagaaatctgaagaaagcacagccctgccaaaaccttattttagtccagtgatactgatttcagacttttggcctctagcactgtgagagaataaatttcttttgttttaagccacccagtttgtagtactttgttacagtagccatacgaaaggaatacacaggccctattaaaactacccattaataataataaaagactggtagcattcttcagccaagtttttaaccagatactttttaataaaataccatacttcttatctagttcgaaaaagaaaaaaatattcagacaaacctataaaggatataaaacaaacatgcagttatagaccaatgaaaataagaacatgttatttctcaggatagtcatctggaataaaaacactgaaacctgcctctgtgcaggtgcacattattaatctgaaggtgctttaacctatgcttctttggactgaactttttttttcttttctttttttttttttttttgagacgggctcttcctctgtcattcaggctagagtgcaatggtgcaatttcagctcactgcaacctttgcgtcctgggctcaagggattctcccacctcagcctcccaagtagctgggattacaggcgtgagctaccatgcctcactaatttttgtgtttttttgtagagacagggtctcgccatgttgcccaggctaactttggaactcctgagctcaagcaatccgcctgcttcggcctcccgaagtgctgggattacaggtgtgagccacggcgcccagcctggacttaacattttaaagatattgagtaaaataataaataacacatcttaaacactcaaaagatagtagttatttatcattatcagtatatgccatctcatttaaacttcccccaaaccctgtaagttagatataattactatttcaattctacaaataagggcatttgtgctcaaaaaagttaaccaacatctgaaaatataatagccacaaaatggtagagcagaaatttgaaactgggttttcgagctctaaaattttttctatgattttttctctcataagccttctaccttacctatcttattaagtacaaattattctatgatgttcttaacaaagaaaaagaaagcaatccaacaggaaaagagaaatcttctttaaccattgttattagaactggatatccacatataaaaaatgaaccccaatctttgtatcacaacatatacaaaaattaaactgagatggatcacagacacaaacatacatgcttaaaactataaagctatttgaagaaaacacagcaaaatgtccttacaatttgggagtaggccaagttttcttacacatgaaaaaagaataatcataaaagaaaaatttgattccttaaaagacactgttaagaaaatgatgaacaagccacactaagagaaagtatttacaaaacatttgataaaggactagtaattagaatatatgaagaagtcctgtatctcaataattttttaaaaagccaaaccctcaaataaatgggaaaaaataaagcacataaaaaagtgctcaaacatcaaaagtcactagggggtactttcccttctggaaagatgaagtagaagtacttttctctattctttccactaagtacaacagcctagatattacatagaaaacaaacctaagaagactctgaaaggtatagagaaaaaggctggccggcagggacatcagaacccagggaatggcatgacagtgagttacttcaaaatttctttttgccttatacattccagacttagaaccagaaaagcccacaacccagaatacaccaagaagccctaggggtgggagggccggggggtggggagcctattttccccagccaaaagatcaaaaaagaagcagcctgacaaaacaaaaaacatttagactataactgcacaaaggccaagtggggagctagatttcttccctcacaaagctgtaacaaggcatcccaactctccccaccagggtagtatcagagaagcacaagtagggtgttgggattttcctatctaccgagcaataatgaatctcttactcccaaagtctcagtagagaccactaagggaatctggacatcaactcctatgaagcagcaacatggctcctctttcctttatcacttgggaactgtcagagaaggtctagtggagagtaagtacgttcaccaatgcctagtgtaacaaggtcacacacccttgggtgtcagtggtggccatgtgaggaacagtaaggagcactactacccttcccagctaaatagtgtgggctgtggtccagtagaagtgggaaccctccctcctgctcaacagtaagtaacaaggagtccttcccctccttgtgtaccaaaagaagacaagtaagaaatctgaacttctactccgtctggccaaaacaagatagcatccacctataactagagcaatatcaaagaaaaccagctaaaatatgtttaaataagacctagaaattaacaacataagacccaaaaggtccaagttccaataaaaaaatctctcatcatactaagaacgaggaaaatcttaactctaattaaaaagacaacttatagatgttaataccaagataagtgatcttagcattatatgacaaagatttcaaggcaaacatcagaaaaataattcaacagcaattgtaaacactcttaaaataaatgaaaaaccagaaactctctgtaaagaaacaaagtctcggcaaagaaacagaagatataaagaactaaatggaaattttagaactgaaaattcaacagacaaattcaatagcagaaaagaggggacagaggaggtaaaaatcagctaccttgaagaaagaaaaatagaaattatccaatctgaacagcattaaaagaaaaacagagtgaaaaatcaaaacaaaacaaaaacaaaaataaaaaacatcttcagggacaaactacactaaaatatccaatactggcatcaccagagtcctagaaagtgagaaaaaagaaggcagggctgaaatatatctgaaaaaacaatggctgaaaacttctaaatttcataaaaagacataagcctacagactcaagaagctaagcaaaccttaaacaggataaacccaaagaaatatgtaccatgacacagcaaccaaatttagacaaagaaaaaaaaaaaagaaagaaaagaaaaaagaaaggccaggtgcagtggctcacacctgtaatcctagcactttgggaggcagaggcaggcagatcacctgaggttaggagttcgagaccagcctggcgaacatggcaaaaccctgtctctactaaaaatataaaaattagccaggcatggtggcgggcacctataatcccagctactcgggaggctgcggcatgagaatcgcttgaatctgcctccaggaggcagaggttgcagtgagtcaagattgcaccactgcactccagtctgggggacagagcgagactcagtctccaaaataaaataaaataaaacaaaatcttgaaagcagtgaggagaaaacgacacattacctctaggaggaaaaaattcaacctagatttctcataaaaaatcatggcagtcaaaagaaagtggcacaacatttttcaagtgctgaaagaaaataactgaccacctggaattttagatcctgcaaatatccttgaagaatgaaggggaaggccgggcgcagtagctcatggctgtaatcccagcactttgggaggccaaggcaggtggatcgactgagctcaggagttcaaggccagcctgggaaacatggcaaaacctcaactataccaaaaatttacaaaaaattagccaggcatggtggcatgcacctgtggtcccagctactccgatggctgaggtgggagaattacttgagcctgggaggcagaggttgcagtaagctgagattgcaccactacactccaccctgggtgacagagtgagacccctgtctcaaaagagaaaaaaaaaaaaaatgaaggggaaatcaagacatactccgataaaataaaactaagagactctgtcaccagcagatctattctaaaagaatggctaaaagaaattccttaaaccaaaaggaaataataaaaggtatctggaaatataataaaaggtatctggaaatattaggaaggaaaaagaaacacagcacgagcaaaaaatataggtaaatacaatagactttccttttcctcttgacttttctaaattgtccagtatgattctaagtgtttatagaaaaatgtttaagacaattatatacaggagagggtaaagggatgtaaaaataggtaaggtttctacactttactcaaactggtaatatatcaacaccaatactgtgataagtcatggatataacacaataccttgtgcagccactaaaaaagctatacaaagagatactctccacaacactataaatcaaaatggaattctaaaaaatgtttaggtaaccccagagaagtagaaaaaaagaaaacagagagatgaaaaatagagaataaacaaaaaataaaatggtagatttaaaccctaacagagtaacaacattaaattacaaatttatacattgtattataaatgtaaatgtaaacagtaagagattagcagaaaggactttaaaatatgacctaacaatgtggtatctacaaataactcacttcaaataacacaacataggtaggttgaaaatagaagtatggaaaaagatataccaggcgacaattattcaaaagaaagctggagtggctaagttaataagggaaaacacagacttcagagcaaagaaccgtatcaaatagagagggacattaccttcattataaaaggaatgatccaagaggacatagcaatcttaaatgtgtatgtactaaataacagagttatactctgtgtatgtactaaataacagagctataaaataggtgtagcaaaaactgattgaactgaaagaagaaataagacatatcacaattatacttgcagaattcaagagatctcttttctgcagattctagaaaatcaacaaggatacagtataattcaaaagcaccatcaaccaatagatctaactgacatttatagaacactccacccgatgacaacagaatatacattctttacaaaggtcccaaaagtatacaccaagacagaccatactctgacccataaaacaaacttcaacaaatttaaaaagaactgaaatcagacagaatgtgttctctgactatagtagaatcaaactagaaagtggcaacagaaagataataggaaaatcttcaaacacttagaaattaaacatacttctgaataatccatgagttacaaaagtctgaaaaatgaaatgaaaaaatacattgaactaaatgaaaatacaacataaaatttgcagatagggaaatgtaaaccaaaagtataagtgagataccacttggtacccattagaatggctattatttttaaaatggttaataacaagtgtggacaacaatatggagaaatttgaacccttgtgcattgacggtggaaatgtaaaatgatacagttgctaggaaaaacagattggtggctcctcaaaaagcatacaataaacacagaattactctatgatctagcaattccagttctaggtatatacccaaaagaactgaaaacagtaaatcaaaaagctaattgtactctcatgttcatagcagcattattcacaatagccaaaagtttgcaaacaaccccaatgtccatcaaaattaatgaataaacaaaatgtggcatatacatataatggagtactattcagccttaaaaatgaattaaatcagccacgcatggtggctcacatctgtaatcccaacactttgggaggccaaagaggatcacttgaacccaggagttcaagaccagcctaggcaacatagtgagaccctgtctctataaaaaatacaaaaattagccaggcatgatggcatgcgcatgtagtcccaactactcaggaggctgatatgggaggatcacttgagcctggaaggtcaaggctatagtgagctatgatggtaccatggtactcagcctcgatgataaagcaagaacctgtctgaaaaaaaaaaaaaaagatacaggccacaacctgaataaacctttaaaacattctgctaagtaaaataagctagacacaaaaggacaaatactgtatgattccacttacatcaggtacacagaagaggcaaattcataaaggcaggaaagagaatatattatcaggagttgggaaggggggaaaatgggaagttattgtttaatgggtacagggtttcagtatgggataatgaaaaagttctggagataaatagtggtgatggttgtacaatactgtaaatgtacttaatgccagtgaattgtataaataaaactggttagaatggtaaattttatgttatgtatattttaccactatatctattatatatacaaatatagcatgtaagtatatattatacatatataaatatttttttaaattcaatttttttctaattcagcgttttttgcccagatattatttctagggcagtatatagctcagaatttaaaatgtcacaaataaatactcagtgaaaataatgacaaaacctgggaagtcgctacctatgactaattcaatgggttcatggattctaggtcctagtgatgtggaaggacaattggagtcagggtaccagaacaagaaggccataaagataagacgtggtgatcagagagtgggaagtgtaaaactaagattacatatgggttatagttattcataatgacaaaaatctaaggtctgattatagaaattttgagtagttaaggtgtaattcaggatgcaaaataatatcactggaagagaggcgttcaagacaccaagagcattttggaaggattatctccatgtacattgaaatcagccaaaaatccatatattctaaaatttctgcaattagcatgttactgtaattaaaagtaaactttatgttttcaaattttagtaacacaaacattatatcattataagtcgatcaaactgttatttcccagtttgttcaataacacgtaccctttcacagctaaatggaaaatgctaatatataactccaccctatcatgcttatttgctttttttagtttcccacagcattttgtaaaaatgacctctaattttaagacaaatggaggtatgtttttaattcatatttctaatataataaatattagtttttatcaaaactgaatttcctcatgccagcttctttaataagagaacatttatgtctctgacacagtactgggcttacagtaataattcaataaatataaattcatttatcttaaaggggacagataatactacaaacccaaataatttacttcggtgcttgtttctagaatagattcctaaattttcacataatgaatcaccttcagtctttaaaagttctagggccggacgcggtggctcacacctgtaatcccagcaatttgggaggccgaggaaggtggatcacaaggtcaggagttcaagaccagcctggccaatatggtaaaacctcatctctactaaaaatacaaaaattagctgggcatggtggcacatgcctgtagtcccagctactcaggaggctaaggcatgagaatcactggaacccaggaggcggaagttgcagtgagccgagaacgcgccactgcactccagcctgggcgacagagtgagactcggtctcaaaaaaagaagaaaaaaaagttctaaatgtaaaattccaggattgattaaatcctgactataaagtttcagagttggctaggaaactagcaattctataacacccccaacatcctctcccaactcagatttcaacaaaatgaggtaacaagtaaggttatgagactaatgacggaacccaattagctcttatctttccactattttttcatggcctagtcaatcatacaccaagaagagactatattttgaatacgttacttactgtggtgtgatgggatatattgccaacaatattaaggtttttgagcagttggggagaaccactatattgtccggagatctgcttcctaacttcggctgccaccgttctacaatgaagaaagcaaaaacatacgcattattgaaaaaaaaaaaaactaaactagtttaaaatggagggaagctaaatacattaaagattcatttaaagaaaaacaaaatctcagcataacaataaggctagaaattcgtaaaatattttaggaaatgcttttctagtttataattacattacaacgtcttatgttgatgtagggtacaagactgacagacaacccatatgaggttttttcttatatggcattttagggaacacactttggcctacaatagagctgcaactatagagctggctctgtagttgggagctataaaaagatgtgtatattaaaatgtatatactttaaagtatacacttaaaatgtatattaaattaaaatatatatacactttaaagtataagaattaggaataaaaaactctagagtgttttcaagctaatgatttaattcagagccctgaccatcttggtccccattagagtttccagctgagtttcaagataatctcattttcctaaaagtatctagatttaagatataatcttttctcctgcttctcttcaattcctccttccttctttcatattcaatcatttcacacacttttactgagcactgttacgagccaactacacaactggaaatgtttacacaaaaataagagttatcattctttagggcttaagatactgaattagctcaacctttttcaagtaggtgacttgaggtactttatatatttgtgttttaaaaggctaacttcctattcataattgccaaactttggaagcatcaagctatccttcaatgggtaactggataaacaaactgtgttacatctatacaatgaagtattattcaatgataaaaagaaatgagttatcaagccatgaaagacatagaggaaccttaaaagaatattgctaagtgaaagaagccaatctgtatgattccaactatattttattctgaagaaggcaaaactatggaagacagtaaaaagaccagtggttgtcaggggctagagtggggacaagaaaggaagaatgaataagtagaaatagggtgatatggtttaactgtgtccccacccaaatctcatcttgaattatagctcccataattcccatgtgttgtgggagggaccctgtgagagaaaactgaatcatggggtcagtttcccccatactgttctcatggtagtgaagaagtctcatgagatctgatggttttataaggggtttccccttttgcttggctctcattctctccagccaccatgtaagatgtccctctgctcctccttcgtcttctgccatgattgtgaggcctccccagccatgtggaactacgagtccattaaaccactttcctttatgaattacccagtcttggatatatctttattagcagcatgacaaaaaaactcctacacgggatgtttcggacaatgaaacttttagttaataacaatgtacatcaatattggctcatcaattataacaaatgtaccatactaaagcaagatgctaactggagaaatttgggagagaagagagaatgtataagaactttctatactttccattcatttttctgtaaacctaaaactgccccctcccaaaaaagtctactagtttaaaaaaaaaaaaaaaaagttaacgacaagggaggaagacaacagcaccaaagcaccaagaaaacaattagaggttagagctgaaatctggagagagaatgaaatctttgagagggagaacagattcaggagagggcaaagggcaaattatgtaatcctttgtctgaaaagacaggaacattcgcttcagtttaggactccattagggcttttatttatttatttgaaacagagtctcactgttgcccatgctggagtgcagtggcgcgatctcggctcaccaaaacctccgccttccaggttcaagcgattctcctgcctcagcctcccaagtggctggaattacaggcatgcaccaccacgcctagctaatttttttgtatttttagtagagacggggcttcgccatgttgaccaggctggtctcgaactcctcacctcaggtgagccacccaccttggtctcccaaagtgctgggattacaggcaggagccaccgtgcctagcctcattagggattttaatgaagcctatataatgtgagtattcattattatgtttagcttgaagtccttacatatcctgatcctctcatcgaagctgagatgagactatgtaaaagcctttaaaaagacacaaaacaggccaggcgcggtggctcgcgcctgtaatcccagcactttaggaggccaaggccagcagatcacgaggtcaagaaatcgggaccatcctgaacaacgtggtgaaaccccgcctctactaaaaatacaaaaattagccaggcgtggtggtgccttggctgtagtcccagctacttgggaggctgaggcaggagaatcgcttgaatccacggaggttgcggtgagccgagatcacgtcaagccgagattgcgccactgcactccagcctggtgacagagcgagactccatctcaaaaaaaaaaaaaaaaaaaaaaaaaggacacaaaataaactttctacctccctcattgctactcacctcactctaccaatctcagcactagctcagtgtttctggggctaaatcatgagtaaactgaatagtaaactgctgtatttcatcaaattcaagatatcactggccgggaacggtggctcacaccagtaaacccagcactttaggaggccgaggcgggcggatcacaaggtcatgagatcaggaccatcctggctaacatggtgaaaccctgtctctactaaaaatacaaaaaaattagccaggcgtggtggtgggcacctgtagtcccagctactcaggaggctgatgcaggagaatggtgagaacccaggaggcagagcttgcagtaagctgagattgcaccactgcactccagcctgggcgacagagtgagactctgtcacaaaaataaataaataaaaatttaaaaaatcactaattgttaagaaatgacattactccatgtacagctaataaataaaaactttgccaattaaccaccataccatcagttaattgaagatttcagatgttaaaatgtgaaatttaaaataatgaaacatagttacttcaaaaagaggcaatcttttgtttaataacagacataaaaacgataatcctcatattgcaaatatctttctacatgacattaatttccccccaaaaaagaaaatctattaatttgaaaataagttgtgataatgcaacaagaaccatttccaaactgagctatagtagccataaaaatatgtgcaacccagacaagggatgcatttacaactgggaccttctgcaaagatttcataaaatggtagtgaaggaatcttcccaaataaaaaaactctatctcttaaccatatcatgatccaaagtatgcaagaaagaaatgttaatgaataaatataagccctgataccagttaaaatcctttatcagaggttactttttccaatcagattttttcttactcctagtgatagctcagaaagaaaaacaaggcagtcttttttccttctaatgaaccattaatattaactgcaaagtagaaaaggtcaaaaattctgtagttacttatgcccctaaattataatatgaaaaaaacttctatccctcccaagaaaacatgatccagtatttgacctatttatctctttatccactctctccattcctacaagctacgtatgtcaacacacattacagttttcacaaaagaaagcatccgctcaggccattcattatatgatgttggaaataactagcaaaagacccacattccgagagaaaattatgttgcatttaacctttcttctaacccactcctactttcagacaccctatctagtcatgatttccagaatgaaccaaggggtgataaggccaatctgtgcctgcctctctctagtcattcttcatgggaccagaagtaaagcctgagaaaaaatgaataaggagagttcatactaaagtcataagaaagtttagttgagctgctcctataaagtcacaaaaaaaatagctggaatgtactatgttaaataataaggtatcttggaactggcattatttgtatctgagatagaagtcagggaagaaatgaagggtaaaggatatatcagggacaaagaaaaaaaggactagctaaaaatccccaaaagaaaaggaagagagcagctgacactgcagtagtgtaactatctaagttcaaaactgatgaatgatgggttgtatcagagtgttagaactgagttggaattaacaataaagaaaacaagtgaaaccccatctctactaaaaatacaaaaattagctgggcatggtggtgcgtgcctgcagtcccagccacttgggaggctgaggcaggagaatcgcttgaacctgggaggtggagaggttgcagtgagcctagatcacgtgactgcactccagcctaggtgacacagagagactccatttcaaaaataaataaataaataggccgggcgcagtggctcacgcctgtaatcccagcactttgggagactgaggcaggcgaactgcctgaggtcaggagttcgcgaccagtctggccaacatggtgaaaccccgtctctacgaaaaatacaaaaaaattagccagacgtggtggcaggcacctgtaatcccagctacttgggagactgaggcaggggaattgcttgaaccagggagctggaggttgcagtgagccgagatcatgccactacactccagcctgggcaacagagcaagactccgtctcaaaaaaacaaaataaaataaataaataaataaatagaaagaaaacaacagactaaagaaaaacaacactgtaccacctagtaagtatttgtgccaaaaaatgtttaacctgaatcgaatcaaacctttacatctaacttccagtttacgggaaatacagagaacagtataatactattgcgaggaagccatcagacaaaaactagaaggcaggtcatgctatgtgccaaaatctcttacgggtcaatgtggtggataaattaacaagtaaaggcagtggactaagttttagtgtaaaaaagacttaagactaaaaggcaaagtctatttaagagggtggaaaaacagatttatgagatataaccaaatgcaacatatggttactactggatcctgatttgagcaaaccagctgtaaaatatattttgggggatgagaaatttgaacatgggcaaggtaatacataagagtcattagggtttttttaaaatgtttttactgtgtggaaagcagcatatagtaaaatgtccttgtattaatattttagagatgcaaatgatatttgtaatttagcttaaaagtcttcagttggaggcttcagcagtggctcatgcctgtaattccagcactttgggaggtccaggcaggaggatcgcttgagcccaggaatttgagaccagcctgggcaacatggcaaaactctgtctctactaaaaatacaaaaaattagccaggagtcaatagtgtctacctgtagtcctagctacttgggaggctgaggtgggaggactagctacttgggaggctgaagcaggaggacagcttgagcccaggaggtcaaggctatagtaagccttaatcgtaccactgcactccagcctgggcaataaagtgagaccttgcctcaaaaaaaaaaaaaaaaaggcttcaattattattactctgccttagtggggaaacgaacaaatcaaatatgaagtaagatggggcaaataaacttcaagaggtatgtatatcacatcctccataaagccctgcctgattctttctgttccatacaattgagtgtctaaatctgtttggacactcctccctatactttcaaagcaccctgtgcttatctgcatacattcaaggaaaaggagcttccaggagacaaattcagacaggcagcagactagccactgactgctttctcttgttgaataagaacattgccttgctaattgagtttgatttcagtagtgggaaagcccaatgtttgtaagcactctctttgatagtagcatgtaagttgaaaaggtttctatggaacagtagttatgcaacccataagtataaaagtatggtggggggaaaagagtacagtgaagtatcaagaatttggctttccgggtctgacacactacttcagaagcacctttgcaacctccttgaggaatagacaagaaaacttcacgtctgattggggtattctatgctgtctcttacttggtataaatgtcccaaaacaggttcatttctgccattcaagaaattacatgttttcaaactctagtggcatttttctatctcattgtgataaccaagcaataccaaagtcacagcacctatcaaattgttttgaaatctgtttacctatctccttacaaggaatgaagcaattaaaagtcaaaacttcatcttattgagaggtgacagcgtgctggcagtcctcagagccctcgcttgctctcggcacctcccctgcctgggctcccactttggtggcatttgaggagcccttcagtcccccactgcactgtgggagcccctttctgggctggccaaggccggagcccactccctcagcttgcagggaggtgtggagggagagacacgagcgggaaccggggctgtgtgcggcacttgcgggccagctggagttccgggtgggcgtgggcttggtgggccccgcactcggagcagccagccagccctgctggccccgggcaatgggggacttagcacccgggccagtggctgcggagggtgtactgggtcccccagcagtgccggcccaccggtgctgcgctcgatttctcgccgggccttggctgccttcccacggggcagggctcgggacctgcagcccgccatgcctgagcctctcaccccctccgtgggctcctttgcggcccgagcctccccgacgagcgccaccccctgctccacagcgcccagtcccatcaaccacccaagggctgaggaatgcgagcgcacggcgcaggactggcaggcagctccacctgcagccctggtgcgggatccactacgtgaagccagctgggctcctgagtctggtggggacgtggagagtctttatatctagctcagggattgtaaatacaccaatcagcaccctgtgtttagctcaaggtttgtgagtgcaccaatcgacactctgtatctagctgctctggtgaggacgtggagaacctttatgtctagctcaaggattgtaaatacaccaatcggcactctgtatctagctcaaggtttgtaaacacaccaatcagcaccctgtgtttagctcaaggtttgtgagtgcaccaatcgacactctgtatctagctgctctggtggggccttgtagaacctatgtgtggaaactctgtatctaactaatctgatggggacgtggagaacctttgtatctagctcagggattgtaaacgcaccaatcagcgccctgacaaaacaggccactcgactctaccaatcagcaggatgtgggtggggccagataagagaataaaagcaggctgcccgagccagcattggcaacctgcttgggtccccttccacactgtggaagctttgttctttcgctctttgcaataaatcttgctactgcccactctttgggtccacgctgcttttatgagctgtaacactccccgcgaagatctgcagcttcactcctgagcccagcgagaccacgagcccaccgggaggaacgaacaactccagacgcgctgccttaagagctgtaacactcaccgcaaaggtctgcagcttcactcctgagccagcgagaccacgaacccaccagaaggaagaaactctgaacacatctgaacatcagaagggacagactccagacgcgccaccttaagagctgtaacactcactgcgagggtccacggcttcattcttgaagtcagtgagaccaagaacccaccaattccagacacattatctctagcagagtgcccagcacatacaaagtgcttacccagtgtttacagagctaaagtgaaaaacacaggaatagaaaagaaaaattcataattccttcgccagaaaagtaattgactaagaatgcttgaatggaacaacttacgagagctccttcagggcagggaccatatcttattaatcgttatatcctcaaagtctaagacaatggggagagagagagaaatggagaaacagatataagaatttagagagaggaaaagagagagatactgaataagaatgaacttagagactacctagtactttcaaaacaccttttagagtaaaccaattcataagtgatgttggtttctaactgattaaaagggaagaaaaaagtatgccttcttatctattattgtcaaatagaaaaatatttgcaggggaaaaatagtctcagtctagttgagatcattattatcatctttgtaatctggtaaagtaaaaaaactactaccaaaacacaatactctcctattctgtatgaaacttttttaaaaacaatttttttaacaggatatataatttgtttgcttatctcaaaatagtctctaatgtgtctttagcatatctgcaaagggctggttacagaattactttcaagccctactattacataaagttactatgagaagcagaggaaataagattttccaaaatgaagacaaaaaaaaaaaaacctgatacaagaaatcttttaaataaataaataaatggcattacaaaatgcaaacttaggaagaaaaaatttcaaacttcacaaagaggtgaaaataaaaggtccatctctctgccatctccaatccccaatccccagtcttattccctagatgtaactagttaatattttcttggtatccttcaagaaatagatgtgtatctatcattacatatataagaaatccttattttttaatgtccacacatgacatcatacaataatcatttcttgataccttacattatacaatatatattagaaatctttccatattggcacataaaactaataaaactagcaacatttgtcaggcacttacaacgtgtcacatactgtgcaaagtgttacttttgttatacctcaatctttagaaaaccctatgaagtaggtactctattcaaatattgaaatttcaagagtttcacataactgataaggaatagagctaaaatttgaacataaagacctcattcttaactactaatctcctttttatctgctataaagtccctggtatggataaacaaacatatttaaccagtctccacgggtggacctttaaactatttccagtttttccaaagattatcactagaatgtaagttctatgaggcagagatttctgtctgaatcaagaattatgggtgatttttgagggctttctgtatttctaaattctctgcagcaacattattttataattaaaaaatagatatttttagatacatttcaaaaataaagtaacttgcccaagtttatgaaaggtagaggcagggtttgaattcagatccataaagctcctaaagctttccatggaagcaggtttccaaagataaaataattcttgctatagtttatattaatgatttgtctattttccaaaacccagcctttcacaggtcagttaaagatatccagtaaaaatgtctggtgtatatactaacatagtaataggaacactagaatgactaccaccattgttatgatctgtttcctatccttcatgtatggctaaataaaatgccaatctaagccattgtctttatgtcatttgtaagttagcccgtgttaaaatgtttaggaacacagaagactggatcccagtaaccactaaaggctcaagaaaactaaaacatatacacgttgatatgtgaaacaaaaccaaaaagaaacagtccttctacataatacacttaacatttaaaatatacctccttttctggtgggaaaaaggattaaaaaaaagatgtcaggtgtctcatatatcccatctgacactattttggggataacattactcaaaattatttttacattagaaagcactgtattaaggagacttggatggctctatcactgtgatcaacagcatttccatataaatctcagtttcatcaactaaaagctggtgataatactgctccctatttcatggaacatattacattataattacataaagaaaagaattcaaaaatttagcatttgtaaatattaacactgacctgaaattggcaattaaaaacagagagaaaagaaaagtatctactgcaaaaggtcaatcctcctaaaaggatataaatttatcttaaattccaccctacttcattataaaaataaacccagagctgccttacccataaacatacaaaattatatcctggtgtaaagtatacataattagttgctaaatcgtgtttattctaactcttaaatatttctcaaatccttgtccccacctttccttttttacaacatctacctacaaataacatcatacttaacagtgaaagtctgaatgcttttccctttagagcaagagaaagccaagtatgtctgctctcagttctattcaaccttgtactggaagagggagggagggaaggaaggagagaggaaggaaaagggaaggaagcaaggaagggagggggaagggggggaggtagggagggatggattaaaggcattttgattggaaaggaagaaataaaactgtctttactcacagaaaaaattatcctgtatacagaaaattctcaggaacccacaaaaaactactagaaatactaaacaagttcagcaaggttgaaggatacaagtataatatccaaaaatcaactgtatctctatatactagcaatgaacaaaccaaaaatattttttaattccattcaaaagatcaaaaataaaatatttagaaataaatttaacaaaagaggtacaagacctttacactgaaaacttcaaaatgctgaagagagaaattaaataagatctaaataaatagaccccccccaccaaccattttcatggattggaagactcaatattgttcagatggcaattctcccaaactgatcaacagattcagtgcaatctctatcaaaatcccaacaagactttgcagaaacttgcatactttatatagatattggtcctaaaatgtatatgaaaatgcaaaaaatccagaatagacaaagcaattttgaaaaaagtaaaaaattggaggacccacacttacaaatttcaaattttactttaaagcaatggtaaccagaacagcactgtactggtataaggatagacacacagagcaatgaaacagaactgagtatcaagaaatgaactcttacatttatgatcaactgattttttttgacaatggtgccaaggcaattcaattggacaaaagtattcttttcaacagtgttgcaacaattgaacacccacacactaaagataaatttagacctttatctcaaaccatgcataaaaactaacgcaaaatggaacataaaccttaatataataactaaaactatcaaatttttagcagaacatagaaaaaaattcatgacaatggattaggcaaaaagtcttagctacaacaccaaaatcctgatgcataaaagaaaaaaactgatgaactggacttcattaaaattgaaaacctttgtgcttcaaacatcacctaaaaaatgaaaggacaagccaaacaaggagacaatagttgtaaattatatatctaaagaaggacttttactcagaacacataaagaactcctacaactcaaaagcaagataaataatcccactgaaaaatgaataagaggccaggcatggtggtgcatgcatgtaatcctagcattttggcaggctgagcggggaggatcacttgagcccaggagttcaagaccagcctgggcaacatagagtctgtctctacaaaaaattagccagatgtggtggcgtgggcctatagtcccagctactcaggaggttgagctgggaagatagcttgagcccaggagttcaaagcagcagtgagctataacgcaccactgaactacagcctgggtaacagagcaagaccctgtctcaatcaatcaatcgatacaaatgagtaagagacctgaacaggtatttcaccagggcagatacgtgagtggctaataagcacataaaaaaggtcactagttggccagacgcgatggctcactccggtaatcccagcactttgggaggccgaggcgggcggatcatgaggtcaggagatcaggaccatcctggctaatgtggtgaaaccccgtctctactaaaaatacaaaaagaaattagccaggcatagtggcgggtgcctgtagtcccagctactcaggaggctgaggcaggagaatggtgtgaacccgggaagtggagcttgcaatgagccgagatcgcgccactgtactccagcctgggcgacagtgcgagactccatctcaaagaagaaaaaaaaaaggcactagtcattaggaaaacacaaatttaaatcacaatgaaataccacttcacactcaccagaatgtctataatcaaagaggacaataacaagtgttagcaagcatatggagaaattagaaccctcatacatcgctaataggaatgtaaaatggcagtcattgtggaacagtttcgcagatcctcaaaaagctaaacacaaaattacactatgacctagcaattccactcctagataggtatatacccacaagaattgaaaacaagccttcaaacaaaagttttattcctattggcactattcacaaaagccaaaaggtagaaacaacgtaaatgtccatcagctgatgaatggataaacaaaatgtgctacatacaatggaatattagtcagccataaaaggagtgaagtactgatatatgcacagatgaaccataaaaacattatgctaaatgaaagccaccagatataaaaggccacatattgcatgattctctttatgtgaaattttcagaaaaggcaaattgagagattgatacaaaaagattagttatgcccagggcttggggtcaaaatagggaatgactgcaaactggcacaaggaattttttgggtgatggaaacgttctaaaactagattgtggatgatggtttcacagctgttaatttactaaaaatcatttaattgtacacttaaaatgaatgaattttatgatacataaagtatacctcaataaagctgggtttttttttctaaggatctgggttggaactgctctgcaaagataagtggaagaaactgtttatttgtaagagaaagaatgatgatggcagaaaaaggagagctgaatgcagtcactaagaaaattttgcaccctgagactccgtaccacgatcctgtaacattagcaattatgaaaattattaaatggttgatatgaatgaaggagttagttctgttttctggtgtcacagggcaaaccaggaacagcccatgatgatgcaagcatacagatgcagaaggaaaaaatgagaatgacaaaagtcaaaaagaaaaaccaggaagacatccttgggagggctatgagttggtactaagatctaggctaaactgtaaaaagttaagggacagggaagccacagctagctagcatcaggttacactggttttccttgaatgtctttgcatttcaccagttccatttaaactgcagataggagagctgtctatactgccacatatttaagtaattatagtcatgtggaaccactataaatgactaaaccactaaaaaatgactaattttaaagaacatcagctgttttgctatgaacagtactcttatcctcattctttaggttagaaacccttctttggtaaggaactaattctgtaagatttgggtggggctaacacatctttctcccaagccatagagaagggcatgtgacccacagtggtcagactctcctatacccctaaacatagtaattggttcaaggaaggacatgtgacccagcccacaccaataactgagtccttggatcttttctgccacaactaaactgggaggatttgagcctggggctgtcaaatctcatagtggccattttgtggaaaacctatccaagatacgaagataagaggctgctgacattatccctggacccaatacactcagttacaggagtcaacactttgtgtgtgtgcaaaataatctgatctgtcacttgcaaccccagcaaataaaaaaaaaaaattcccatgtaaaaagccaccgaaaaagcagtgatatatccagagtatctgccaagggggtccaaatgatgcaaccccaaaataaaagggagttaactctgaagaaattgaattgactggaatgaagaagaaaagccccaaataaagcatcaattcttaattcttataacaggctctgttttctaggaaacccaaactaaaaggatatctacaaaaagctgtcagctatcattagaccagtgaaacacagaatgctttccctttgagatcataaataaaacaaggaaggccaggcacagaggctcatgcctgtaatcccagcattttgggaggccaaggtgggaggatcgcttgaggccaggagttctccagcctgggcaacatagcaagaccccacctctaaaataaatttaaaaattagccagacatggtggtgcacacctgtagttctagctactcaggaggctgaggtgagaggacagcttgagcccaggagttcaaggttatagtgagctatgatgacgccattgtgctccatcctggacaacagagcaagagtccacctcaaaaaagtaaataaaaactaaaaaacagaaaaataaaaatgtaagaatgttcaacattaatacaatgttgaatagcaatggtatcaatctacacagtaatacaaaataatagtctacagagcaagataaaaaatagtaagtcagttataaggattgaaaaggaagaaacaaaaaaaataatgatttccagatcatatggttgtctacacagaaaatataaaggaattcacaagtacattcagaataaacaagagtttagcaaggtatagctggatacaaaattgttatatacccaggaataaatctaacaaaagatatgcaagaacctgacagagcaaattataaaatttcattgtacaacataaagaagacctaaataaatggagaaatacactatggatcatggattggaaactcaatattataaggatgtcatttctcccctgaattaacatatagattcaatgcaatcccaatcaaattctatgagttttgggttcagggagttttgttttgtctttggtagattctaaaatttacgtggaaattcaaagggctaagagcagtcaagatttttttttaaaggtggaaggagttactctaccaaatgccaagactgattatacctaagattatttataatttgtaaaaaaaatactgtataaccagaccaatggaacaaaacagagatcccagaaaaagacccacaaataaggatatatcatctacaacagataatttcaatgtacattttaaaaataactaaaagaattggattgttacacaagataaatgcttgacatgatagataccccatttaccctgatgtgattcttacacattgatgcctgtatcaaaatatcttatgtaccccataaatacatatgcatactatgtacccacaaatattaaaattaatttttttaatctacaatagaggcggcagggcagattaatggggaaaggacaatccatttagaaaaaaattaaaatttcacaccatacacatatcaagacaaggtggaatataaacctaaataaaaagggggtaactacaaattcatgataatatggatgaatatcttaatatctcagggtaataaaatatttcttacgacccataaaccaataaccattaaaaaagactggtaagttaaactgcattaaaactgagaacatacagctttcataagattccattaaaactatgaaaaacaagccacagggtgggaaaaggtatttgctacacatataatcaataaacaactaatacacagactgtatgtaaagtactcacacaaaatcaattcctaaaaaacccaaagggaaaaaacaatggaggagggggataacagcaaaatatttaaataagcaatttacataagaagaaattcaaatcatcaataaacatacaaaacagagctcaacctcattagtaataaaatgaaaattaaaacttacaatgagatggcattgtgcatccaccagattgtggtaaaaatgaaaaagttggccatacaaagcaatggcattgatgtaaagcaacattgttgtgagactgtaaatttctacaaccactttagaaaacagtttgacactacctaataaacattgctgtagcaataaagattgccatctatgagtgaactcccattcacaattgcttcaaagagaataaaatacttaggaatccaacttacaagggatgtgaaggacctcttcaaggagaactacaaaccactgctcaacgaaataaaagaggacacaaacaaatggaagaatattccatgctcatggataggaagaatcaatatcgtgaaaatggccatactgcccaaggtaatttatagattcaatgccatccccatcaagctaccaatgactttcttcagagaattggaaaaaactactttaaagttcatgtggaaccaaaaaagggcccacattgccaagtcaatcctaagccaaaagaacaaagctggaggcatcatgctacctgacttcaaactgtactacaaggctacagtaaccaaaacagcatggtactggtaccaaaacagaaatatagaccaatggaacagaacagagccctcagaaataataccactcatctacaaccatctgatctttgacaaacctgacaaaaacaagaaatggggaaaggattccctatttaataaatggtgtcgggaaacctggctagccatatgtagaaagctgaaactggatcccttccttacaccttatacaaaactgaattcaagatggattaaagacttacatgttaaacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagacactaccatcagagtgaacaggcaacctacaaaacgggagaaaatttttgcaatctactcatctgacaaagggctaatatccagaatctacaatgaactcaaacaaatttacaagaaaaaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagacaccatctcacaccagttagaatggcgatcattaaaaagtcaggaaacaacaggtgctggagaggatgtggagaaataggaacacttttacagtgttggtgggactgtaaactaattcaaccattgtggaagacagtgtggcgattcctcaaggatatagaattagaaataccatttgacccagccatcccattactgggtatatacccaaaggattataaatcattctgctataaagacacatgcacacatatgtttactgcggcactattcacaatagcaaagacttggaaccaacccaaatgtccatcaatgatagactggatgaagaaaatgtggcacatatacaccatggaatactatgcagccataaaaaaggatgagttcatgtcctttgtagggacatggatgaagctggaaaccatcattctcagcaaactatcacaaggacagaaaaccaaacaccacatgttctcactcataggtgggaattgaacaatgagaacatttggacactggaaggggaacatcacacaccagggcctgtcgtggggtggggggaggggggagggatagcattaggagatatacctactgtaaatgacgagttaatgggtgcagcacaccaacatggcgcatgtatacatatgtaacaaacctgcacgttatgcacatgtaccgtagaacttaaagtataataaaaaataaaaaaaataaaataaaaatacaaaaaaaaaaagattgccatctatgacccagaaattgcaagggtggctataccctagagaaactcatgcatatgtatacctgaaaatttgtataggagtgttcatggaaacgtttgtaatagtaaaaaactggaaacaatccaaatgttcacctactatagaatggattgattgtggtatatttatggaatgaaatactacaaagcaatgaaaatgaatgaacttcaactactcagaatatcatgaattaatctcacaaattataattttgtgcaaagaagcaagacagcaaagcatacacacaatacgattccacccgaatgacttcaaaaagagaagaaaacattttgcttagtaatgcattcacagatggtaacattaaagaaaggaaggaaatggttatcccaaaagtcagaatggtggactggagtagtcttaagaaggggtaagatttaggaaagaaaaggaagaatgtatctaaaagaaaaaaaaaaaacagcagaacagttacagagatggaaacaagcatagcatttgtggaggtacagtgaaaacaccagactgactggaggacaatatgtaaactagagaacaagtcaacaaaaggaggaccaggtcacagttaaccttaaaatccaagcaagggtttggctttaacactgtaagaagccacttatattcttgaactgcacaatcccatgatgaaagctgtgttttagggagacttaatttgcaacacacttgaattagaggagggagggactagatcagctagtagctttctatggtcacctagaagtgaaataataaaggatgtccaacgcagcttggtggcattcatttaaacactttatgtgtcagatatccatgggatctgtgtgaagcactggaaataaaaagtcaaaaccagacctgccatcaaagagctctgaaaagcagtataaaaacagggaagggggtggagggacataagaaatgtaactttttaaaaaaacagctcatgaaatcagtgatgaagaaaagaaaaaagtcaaagtttcctagccctcaagagccctataattcaagtacacataaggtaagcacaactatatagcccaaggattgatgaggaagagaataagcaggaagtagccatgactataccacatacatgggagaaatgtgacaaggaaaggaatgtttggttggcagctgaaaatgccagaacactcaatagatctttgttttaggatgagaaagacatagtaagtcttatggtttaagggaaaggtccacaaaaagggagtagattgaagatgttagaacagggaaagttgtgggatcaagactctgagagaggtggcaagagagaatttcaaagtacaataaaataggtaagctttaggaacaagagacctttcaggctcaagggaaagatggttaagtcacctattgagagagtagtatgctaaggttaaaatgaaggactaatggtagtcccaaacttttcagtaagatgaggtagagaaacaaaattgttaaataagagaaatgacctaaggtaaacctcatctcaaatggcaagatattaagacataaagatcaactctggaatgttctagtctctctttaacactattttgcagcttaggagcaagaagcaggttagatattcagcattaagaattagtgagatgagtacaacaaaagatcagggaagtatatgtgttccgcaagataaaacaggcagcacggaagtagttggtaatatatggaactatgaattgaacaaagtagattctgtagattgaaagactgggcccatctgcccagagttaataacacatacaagactaaaaacatctgaggtgttaaataagtcgatatccaggaaatcccactcatgtaagattttccctcagaaataaagatctgatggaaacctttcattaaattatgctacttatgcagcaaaaggatacccggttaacaaaagaaggactaagaaagctggcataactttagggatagtagcagtgacactgttaggaaacctggaactaccacagaaaatattctgcagaaagaaaatatagtcaaataaaaagagtaggccaggtagctcatgcctgtaatcccagcactttgggaggccgaggtgggcagatccctttagccccggagttcgagaccagcctgggcaacatggcgaaaacccgtctctacaaaaagtgcaaaaattagccaggcacagtgcccatagtcccagctacttgggaggctgaggtgggagaatcgcttaaacctgggggcagagacttcagtgagccaagactgtaccactgcgctccagcctgggcaacagagcgagaccctatctcaagaaaaaaaaaagcataagatctgaaatcaggctgagcgaggtggcttacgcctgtaatcctagcactttgggaggccaaggcgggtgaatcacctgaggtcaggagttcgagaccagtctggccaacatggtgaaatcccgtcactactaaaaatacaaaaattagctgggcgtggtgacgaggacaggagaatcgcctgaacccggggcagtggggtggaggttgcagtgagccgattgcgccacttcactccagcctgggcgaaagagcaaaactccatcttaaaaaaaaaaaaaaaatctgaaatcagagaactaggatttgagtcccaatttaggcaaatacagttgctgtttttaggcctcaattcctcatctagaaaatgataacaacagtaagtaatatggaaatcataatagcagtggctaacatttttgaatgcttatgttcctgacacagtactactaatgcattattagaactgtattagctcacttacacatgtattaactcatttaatcctcacattaactttattgaggctgttatccccatttttctgtggtatatgcagaatttcaacctgtgcaatctgatcccagatcctatattctttagtacattttctgcctctctgggttatgaagatgagaatgcagtaaaaagtgctttaagtgtacacaaatgttcatcattactgctgagtatcaagcaacaggacaaaataatcccaacaaaatcctagacaatttgtctacagtctacattccataaatccatgggccttatcctcaaaaagcaaaggggacacacatgtacaaagacaactacttgatatggacaagatatacatgctgcttttctatggtgagctgaagtaaacagtataattagtgataataagaataaagagccttcagaaatcaccaaatcacagcctcaaaaaataactgcactaaatgcaaggggctaaaaaataactgcgacagaaacaagatcattataattctttttaaagtataggtttctgaacaatcacaaagctttgaaaagaaataaggtttcaaacagcaacaggcttttcacagagcaacaaatttcatatacgaacactaggaaaaggattatcatttccaacaaaagcctcaaaccacattataaatactgtagtaaaaaacagttgatacttactaggcacttagagcactgttctaagcactttagaggtaacaattcatttaatccccacaacaaccctacgaggttaagtcttaccatcatcctcattttctagatagggaaaacgaggcagaagtgtggtcaagtaacttggccatgtttactcaacgagtggctgtgctggggtgtcaaacccaggaacttcatctccagaatttgtgctatacttcctctaatagaaaagttaaaaagcagaacacgaattgattcagaagtattaagtattattcaatcatatttgataacaaggaagaacctttcattcacaataagcagttaataatgcattactcatagcagttctgtctttggtattccttccaagttaagtctgcacattctcactggacaatctcatcaacccccacccacccccgggctccaaatgcaatctacttgctgataactctcaaatctagatctccagcccaatctctcttctgcaccttcaacctgcaccaaaaaccaaatagatatttctctctgaatgattcatgagcccctcaaaattaacatgtccaaaactgaatcatcatctccatcccacttgcatctcccaatctcaaactcctttttcctcctgtactcccttaccccaaagactgccaccatcatccacgtggttgcccaacttaggatgtcatcccagactcctcagtccgcctcaccttgcatgtccaatcaccaatcactaccatatccacctcctgtctgtccaataagtgcacatttcttcattcacattatcttaattttataacttcttagaaagctgttcttatttgcattttgtgttgttttgcacaactgattctctttttctcttgtggtttgtcctatcccatctggtggcgaactccactaatagacatacaatttcatatccaactctctaaagtgcacttactttatcagcatgatgttttcagagataaacttctggttctaataagagaaattaaaactaggaatacatgtcaagtaataactttttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtattttttttttttagtagagacggggtttcaccttgttagccaggatggtctcgatctcctgacctcatgatccacccgcctcggcctcccaaagtgctgggattacaggcgtgagccaccgcgcccggccagtaataacattttttaatgacatcatcatcagaagtaagacctaattattttacaaaaaaaaaaaatttcctgtcatcataactccctgggagaaactaattactacaagtgtttgatgacaggtagtataggccctgtactatcctacgcacattacacaaattatgccacttaatgttcacaacaacactatgagctgggtcctattattattctcatttgccagacgaggaaacggaaatttggcccaacaacttggccaaagtcccaagctagaaaataccaatcaggatttgaacccatgtcggggtctgagagtagagcccatgctcttaaacacttgctattttgccccttcaggaaaaaaaaagtgctagaacgctggaaagaaagaaaaaaaaaagcctctgcctcgaaagcagctaggacgacaggtgcaacaccacacctggctaatttttttgcagagatggggtgggggggactcgctatgttgcccaggctggtcttgaactcctggcctcaagcgatcctcctgcctcggcctcccaaactgctgggattacaggcctgagccactgcatccggcccaaaatttttaaagaaatgtcagcaaactaaaaagactcagagccacagaactacaactgccccaaaacaaaaaaaggtaatttaatatgaatgcttcttttcttgggacatcataattcacacaaatatgattttattaaaacaaaaatgtctactgtctcatacataagtatactccacaaagaaattctacaaatattagagtcctctgtcatttaatttttatttggcgggtgggagaaaggtggcaaccaaccaccacaagtaggtgaaaggctttgaaacctccacctcaatcacttgctttacttcaagactgcaatcacttgctttacttcaagactgctaacatataaaaggatgtcagtgtataaagaacactgcctatcatccatcttctcgggtgctctgagaaacacaggcgcacagttaaattcacaggcgaactcagaacaagcttcagcctgcaatccgtcagggattcggcagctgcacaccgaaggtgcagcccgcagctctcaacttttcattctgtccacacgttttcaatcctggacgcacaagtccactttgaacctggcccgagggtgcaaagagggttcctgtcagatttctcaggaagagagagacgcgtgaaggaggggcggcctcccacccgccccgagccgccgcgcgtttctccttttgttggggtggaggagggcggaccccgcaccctctaggggccaagaggggtgggcggagagacgggagggggcgaaacgccgcggcggcccccgacgagcccgggggtgggaacacaaagaatttgggaagcggccgaccgcccttccataaacctccgcagaagtccaggcccgggccgccgaggagcaggaggaggcgggcgcgctggagtccgcggccctctccgctccctgccgaggctcagcggcgggcgcgggctgaaggccggggttcgagggcggcgcgaggcctccgctaccccctcagccaccccgaaccccttccgccccgccgcgagccaggccgcgggatcccggtgccggccccgccacacccacccgcctcctaggccaggcctgggaggactccgcggctctttctcgggcggcggcggcggcgcgccccacgccggatatttacctgctgatcttctgggcgaaggcgcggcgctcggccatggctgctgcggcgacggcgacggcggcggcggctgcggcgggccgggtgcggaccggcgggcgcgtgcctcctcgctcgtgctccctccctcgcggcctccgccagtccgggctccggacctgggaggctggggctggcggccggagccaggaacgagccctgccgtaatgttccttagaggcgcgcaacgagaaaccgctcctcccccagcgcgtcaatcccggcgggaaccccggctgcggaaggcggctgcggccggcgggagccgaggggaagaatggagcgctgaggaagcgaggcgccagccccagccgcttcgctgccgcggagcctgcacgaccgagaggtcgcggagagaagccagagacaggccagcgacctggcgaggcaagaaaataagataaccgaacgcgtagggggagcttggctttcccgaaatggaagggaaggaaatgaaaggtgggctttgccgagggggctgtgctttaaccaaagccctggatgactgggttcatgtttctgcagcaccggtctccgagctttttaaagcacttgggtttctgcttcggcctcatgaatgcagcctaactggagaaacagtggtttttcttatagagaaagagccagaaaataccttgctcctgcagcgataacaatagtaatagttgacttctggtgcttagccagccactggattaaagtttttcaagcacgagcgctttgaagtagatcgttactatcactattttagagggaaggaaattggcttggaaaagctaagtgactggccccaggtcgcacagatggtaaactcttccactgagactcaaacccagagccggttcttttctttgaggacagttgtttccgtattattaaccccttttggatctctctctgtctctcatacatacatatatatatatatatatatatatatatatatatatatatatatatatataaaatccaggtgagctctaacgttcacccccattttgatgttctgttaaataagctctgtgttgaccactgaaactgaccttgtccataatagcctataaaacagagactagcagagatttgttttcatctgttctgttgtaatcccataatgtctagaatatttggctcctaatgcatatctgttgatactgaaattatggtgacactaagaaaaatatcttggtttcttgtagtacctttcctcttaagtattgcaagaacttaaaatgtgtatttatttattgttattattatattctcagtatgtcctggtggaatatgttggatacctgttttcctctcttttaccattggaaaatctgtagcttggagccattaggtcacttgccagagtcacacactgagtcagaggtgaaagcctcaattagtcagatccataacttcctgtctagtgctgtaacttctgtggaagactgtgtatttatataacaatgctcattgcagtaacacactgcttttatttattgatttatttattttagacagaatccccctgtgttgctcaagcatggaatgcatagggcactgcagcctaaaactcctaggctcaagcaatcctcttgcctcagcctctggaggagtagctagtaccacaggctcttgccaaggcgccctccagtaacacactgttttcagatgcttgtttactaaaggaaaagatagtctattcaaagaggacagatatttggcttctacctaagtatagagcccacctaggtgttctaaaaaacacgaaggtgaactagacacagacctgctctcagaatgtttgagtccattgggaaagatgaaccaggtactcacagactgtaagtcaaggctatcactgtacctggcttttaagaccctctgtgataggaacccagacttattttgccactttcttactctgtaaccttaggcaagctacttaacttcatctctaaaaggaggaaaataattatatctacttgaaagggtgttgtgaagatttattgaattgattaatataaagttcttagaacagggcctggttcatggtaagtacgatgtgtgtcagctgttgttattattatcactgttactgtcattattcatcctatacttaagcttgtcctgggtgtttgatagtccctgaattggttgtctgctctcatactcccagccagatgttgcatgcctttatctctgttctccaaacatcttttcactactctcttagagaactggccacattttgctttgaatagttctttgtatacatgactcactagttgccaaagtgtctgaaaggactttgcatgtactctgcagcttactggaaacatttagagcaggaagaggacaagcaggatcacgctgtaagcagggtaattcagagtctggggaacactctaagcaggaagggtgaccccctacctctggggaagagctggcagtcacagaccaagtcatgttggctggtatccctgccccacagggtttcaatgtcaggaaaagatatggaacgcagcaatgggagtgacagtggaattgcttcagctgactagcatccatgctccctataccaccccctacacacacacacacacacacacacacacacacacacacacaggtgtcaatccactatacttctggggagctcactccaccaccctcagtttcaagggtcttttgacctgggcctcaccaagcaaagcagcacactcctctggcttctgtaactgatttagggataggctcatgaatcaaaccaagacaatcgggcccaaccagaattagaaattgcatttggtataccagggcactccatctaaagaaggcctacctgagaatgaagccaagcacagcagagaggagagcaaaaatattgaaaaagacaagttccttagaatatagcatgacttgagccttggactttgcagttacatgagctaaaaatgtgctggaatttttttgggggtgtggctggtttttcattaggtttgctttcattagcagttcaaagtcttacctgatacaggacttcattcagttaactaacattcattaagtactatactagaccctggaaatatagtggtaaatagcgcagtatttctgtcctcaaagagtttagggtctggtagaagagaaaagtaagtaaatagtaagttacatgctgagacaggaaaaattaaggaagctattggagtgcatataaattcttgatagcaccagttctcaaatatgaggtgttaaaaactggatggaatttaaccctgtccttagccctgttatataacctaggagaaaggctggctgcaactccgggagcatgagtagcccaattcagaattcagggcccaagctccccactgatggaaagatacaaagaaactacttgccagaagccaggaccaatttggcagagtctactcaaaacagtgagttttaggtaagaaagcctcagaacagttttcattagacataccagtgtactaagtccctcaagcagaaaacttagggatatgacagaaaaaaaaaagtaaagagaaaagaaggtgggaaaattatgagttttgcattctaccctttattgaacttgggtctacccgctttaatgtagcaccaaggaggattgtggaggggtctggtcaagggtctaaggctacagtacaaagaaatagagttttcgggtcatgatggattaagttctggctttgcaggcagaatgtgttctcttttgggatttgggggagcatagggaatggttcctttttttcaggcatgggcttttttttttttttgagacggactctcactctgtagctccagctggagtgcagtggtgcaatcttggctcactgcaagctccgcctcccgggttcacaccagtctcctgcctcagcctcccgagtagctgggactacaggtgcccgccacaatgcccggctaatttttttttatttttagtagcgatggggtttcactgtgtttgccaagatgatctcgatctcctgacctcgtgatccaccagcctcggcctcccaaagtgctgggattacaggcatgagccactgcgcccggccaggcatgggtttttatgaaacaccgctggtttcatacaataagatcaacatggagcttccttctttggaagcctctagcaaggccaaatgaatgtggcccagagaaagggagaactgaggcatgatatgtgggtttacctcaatcccaaactaaagcctaggagttggacactaaatctaagctacagatgcttttgcctgactttgtcctatgtgcttcacttcctgtcaatatctagcaagtgtaatttttgcagggggaaattaaggggtcctcaacctggccatacttaacaactaatagcacccacatttactttgttgtaatactcaccacactattgaagtattgtctgttaatctttgcaccccatcgaacttgatctcttgttcaccattgtatttccagtatctaatacactgcctggtccattataataacttagtaaatgtttttgagtgaataaatgccatgaactaaagtatttttagatcctgcctgtattcatccgttttcatactgctataaagaactgcccaagactaagtaatttgtaaaggaaaggggtttaattgactaacagttcagcatggctggggaggcctcaggaaacttacaaccatggtggaaggtgaagggggagcaaggcagcttcttcacaaagcagcaggacggagaagtgccaagcaaagggggaagagtccttataaaaccatcagatctcctgagaactcactcactatcacaaaaacagtatgggggaaaccgtccccatgattcaattacctccacctggtctcttctttgacacgtggggattatggggattacaattcaagatgagatttgggtggggacacaaagcctaaccatatcactgccttaatttatatttccccaaaaatagagcttgaggcttggatgcaggtagtttattaggaagtgatgctaagaagctggaatgaggaagtggagagagtagaacagagaagggaaagccagtaaatagtgttgttgaggtgttaccactgtgggcaatttaggctcaatcccgcctgcaacctgcgtaaagtgtggagtgcacctcagaattgtctctttgaggctcagtatttacctgatgccatctagatctcttggctgaaggcttactattggaatattaactgcccgcacacttaatactacaaaaagctaagagacatggtgtgtgtttctggtggccagctatcagtgcccctgagaattgttcaccacagctacacctaaaatcggaaaggagccatggggtgaagtacagggtaccaacagtgtctattacagatcccctgaaagtaatgcagagactacaatagggatcttgccagaatagaacgtatttgcacctcatggttctgctgctttacagaattgggaaagaccaaaaggccagaccacctgagtcaaaatggcccacaatgcaagctcagtgcctactttaaaaataggtccataatgtttttcctcaatggactattatatcagtagaaaaaaacagtttttcccatactctaacaacatgcttctgacaccagatatgtgggatttttttccccatacatcaagcaagcaatcgattctgcagcagacaccagttgagtctcctccaattccgttctggagttctggaatctacctgaagttcagttctgacactgtctacctggagttagcgtcagatcccacaggttgagggcttggtcccacaagactgccccccacatccagtgccaattgcaagccacaggttgttctaccagtgctttgactgactgtaagttggggttcccacaacccctttccttgagtttgattaatatactagagcagaacacaggggaatattaatatttaccagtttattataaaagatattacaaaggataagtagaaaagatgcatagggcaaggcatgtgggaaggagcgcagagcttccatgccttctctaggtgcaccaccctccagaaacctctacatgttcagctctctgggttttggtagaggcctcattacagaggcatgatcaactaaatcactggccactgatgatcaacttaattttcagcccctctccccttcctggaggttaggtggtagggctaaaaagtcctgtattaatccgttttcatgctgttgataaagacatacttgagactgggcaatttacagaattaagaggtttaatggacttacagttctacctggctggggaggccttacaatcacggcagaaggcaaggaggagcaagtcacgtcttacatggatggcagcaggcaaagagagagcctgtgcaaagaaactcccatttttaaaactatcagatcttctgagacctattcacaatcacaacaacagcacgggaaagacccgcccccgtgactcagtcatctcccaccaggttcctcccacaacacatgggaattatgggagctacaagatgagaattgggcagggacacagagccaaacggtatcagtcctaaacctctaatcgtcttttaccagcccccatcctgaagctacacagaagctgccagccaccagtcattttattagcatacaaaaaaattattcctttggaaatcacaaggattttatgagttttatgccaggaaatggaatgaagaccaagtatagattttacagtatccagctatatttcaaggtagtcatatttgatgaagtaaaattcttttaaaagaatttcagctaagaaatgcagactcagatgaaataattaagctaaacctgtataatccaataccgtagccacaagccacatgtggccacttaaattcattaaataaaactaaaaattgagttttcagttttattaggcatattttaagtattcagtaggccacaggtggctaagggctgccatactggacagtatacagacagaacatttccattatcatatgaagatctgttggacagcactgatccaaagatcattgctgctaaaccattagataagagccttatggggaactttaaatggttggatcaggctgataagaccagaacccactgatgaatcttaacatcaaacacacacacacccagagttaaccagtcaaacacaccagaggcactatgtgcctcatcacatgatataaagaagggagtgtaagatgatacatctatggaagatgtataggatgtatacagcatcacctatgaaacattcctggcagatatttaaagctaatgcttgttctgtttatagaaaatataggagatgaaagaacatgtcaaacaatatgcttgggttaaaattagcaaaattcaaaatacgggaaattttataggacataatgaccaagttcctttaacaaataaatttcaaggaataaaaaaatattagaagtagagtaagcatataagcaacaagaggtaaattggacataatcaaaatgtaaagtttttgtgcttcaaggacaccatcaaattgaaaagaccacccacagaatgggagaaaaatttttacaaattgtttatctaataagaaacttacatcaagaatatatataaagaactcttataagtcaataataaaaagacaacccagttttaaacttggcaaacaattggaatagacatttctctgaagaagatatgcatatgcagatggccagcacacatataaaaagatgatcaacatcagtatcgatcagggagatgcaaattaaaaccacagtgagatgccacctcacagccactagactgactagaatcataaggacagatattaataagagttgatgagggtgtggagaaattggagttctcatatacaactggtgggaatgtaatatggtgcagtcactttggaaaacattctatcaactccttaaaaggttaaacataagttactatatgacctaggaattccactcctagaaatatacccaagagaaatgaagatagatagatagatagatagatagatagatagatagatagatagatagagaaacttgtacaccaatattcataaaagcataattcataatagccaaaaagtagaaacaaccctaatgtccatcagctgatgaaaggataaataaaatgtgtatccattcaatgggattgatgtgatttggctatgtcctcacccaaaatctcatcttgaactctaatccccacatgtccaggtggaggaaatcagatcatggtggtttctcccatgctgttcttgtgatagtctcacaagagctgatggttttataaccatctggcatttcccctgcttgcactcattctctcctgctgccctgtgaagagtgccttccgccacgattgtaagtttcctgaggcttacagctatgtggaactgtgagtaaattaaacttcttttctttataaattacccagtctcaggtatttcttcatagtagcatgagaatgaactaatacaaggatattattccagaaataaaaagaaataaaatactggtacatgctgaaatatggatggactttgaaaacattatgctgattgacgtaatccagtatttattttgggagaaaatgatataaggtatgacatttgctttaaaaataacccaacatgggtttctgttgatgggtgttgaagctgggtaagagaatatggggtttcattacatcgttttttataagttgaaaaaaggccctcaaatgagtattatgtcagaagagagaagacaacttactgattagagaagaaagggttgaaagcttagctcagagaatgaatcaatcatgaagccagtctaaaaggtctaagcagccagaggttagagtaatcacacaagtagaggaactgtctggccaaaggccgtcttggaaccaatgtctatagtgccctattgtgcaccattctcattttatttcactgagctgagaactgagtgagacctgctggacattactgattatggatctgggcagagatgagcccagtgttctttaggaacagtagggcagatctgggacaagcaggtctcacacagagaaaggacagaaacatcaaagttcaaaagagttgcagtcatggaaaggttctgtcaggtgggagactgtacatgtttgtaggttatgggggaggactagaggagtgagaaaaagtgaaaatattgagagatacttttgataatcttgaaaagaaagaggtatctttcacctgcttgggagggaagaaaaggttggaaaaccacacagcattttagaggtggaaataagggaagttgagggagcttaattcagcatttcattttctcactaaatgtaatgatgtaaggctagtatattagttttttgccactgcctgaccaaaagtgatggtcccctttgttgtataatgtaaactatcaagcaatcggctatctcatatccataaggcctgcccacatgaaacgggagagcctatacaggacatgtatgccagggacaggaatcttggtagaactgcctactacagccaggtaaggatgagaatcttgaatgtatgatcccacattgctggaaatggttcactccatgaactaggagataaggccttggatagggaactagggaccatattgaaaacttaccaagaaatacggagaaccaaatggggaaggtgctgaaagtcataatccctcttgaaacagagggagcaggggactgaagatgagaaaaagtggggttttagttctggctctgccacaatcttactataaagttttgagcaaatcacaaactttctgggcctctctttcttcagctataaaataaaggtgataaaattagaggattgctaaggtaaataacatttctctgttaccattatcgtatggtacttgtacaagtatagaaaaagaattgtaggatattctttttccaaatactttaaagatttgcattatttgtttggggactact

SEQ ID NO: 1246 - DNA, 25807 bp, Homo sapiens
ctgaggcctgctgcttagccattttcccttgtctctggactggggagagatgatggcacagaccctgaagggccccttgtggaccgcgttaaccgggaagatcttaagttaggagttttgcgttttttcctcttttctttatttgcatctgaatccagaggaggcatggccaggaagagaggcaggatctgcggtggggtgatgcttagattttgataccctgatcttttgtttttcagggtactggaagatgaaagagactatacaagggaccgggtcctgggggcctgagcctcctggacccggcatacccccagcttactcaagtcccaggcgggagcgtcttcgttggcccccacctcccaaaccccgactcaagtcaggtggagggtttgggccagatcctgggtcagggaccacagtgccagccagacgcctccctgtcccccgaccctcttttgatgcctcagcaagtgaagaggaggaagaagaggaggaggaggaggatgaagatgaagaggaggaagtggcagcttggaggctgcccccaagatggagtcagctgggaacctcccagcggccccgcccttcccgccccactcatcgaaaaacctgctcacagcgccgccgccgagccatgagagccttccggatgctgctctactcaaaaagcacctcgctgacattccactggaagctttgggggcgccaccggggccggcggcggggcctcgcacaccccaagaaccatctttcaccccagcaagggggtgcgacgccacaggtgccatccccctgttgtcgttttgactccccccgggggccacctccaccccggctgggtctgctaggtgctctcatggctgaggatggggtgagagggtctccaccagtgccctctgggccccccatggaggaagatggactcaggtggactccaaagtctcctctggaccctgactcgggtaaggtgggaaaggggtgtggggttgcgggggaggggttagggagggttaagagcctggagcaccaggagcctgttgccatggtgagagctgggcttaaggaaagtaggatggaagagtgccggctccagaagagctgcgaaatgtctccattaagccccactttgagcagaaagtaagcctgggagtgagcctggcagtttcccaggcagagctaggaaacagatgccctaagtaggtatcccgtggtcttgagcgcagatgagaaagggagatgtggtttacaaaaatcctgtccacacgaaatcccttgtcggcctctcagtataagaacccccgtgtatacatctccagagggtaccattcccaaagtgacgggatgggatctctcccagtagtggagtacatcatcttacagttgtgaaagaatatttccctttcggagaactccagccaaacagtttcaggctctctaggtctttattacatattctagtattcattgagcctttacaatatgctgggtactatgctgggtgtttggcatatagtggtgacaaatatcccgaagttttcatttctaaatgctaatcctttttctttcttcctgtctatgagtaggaactctctctccatccctgtagaatctcttggacatgtttatctcatgcttatggggtccccatttcttggagtgggattgacattggtggattctgcttcagtgtatccttcttgcggtcttatttgcatgcatgagtcaactgtgtgcatcccattgtgctttccccaggccagtctctcatgcccattccatttcccctgccctataggcctcctttcatgtactctgcccaacggttttgggggacaatctgggccagaaggggagcgcagcttggcaccccctgatgccagcatcctcatcagcaatgtgtgcagcatcggggaccatgtggcccaggagctttttcagggctcagatttgggcatggcagaagaggcagagaggcctggggagaaagccggccagcacagccccctgcgagaggagcatgtgacctgcgtacagagtaaggagcccttaagcaactagcctctctcccttctccgactcctagaggagagtctggaggcctcaccccctcctctctccctttccaccaggcatcttggacgaattccttcaaacgtatggcagcctcatacccctcagcactgatgaggtagtagagaagctggaggacattttccagcaggagttttccaccccttccaggtgaggcttgaaagccctccttgaaagaagggctggggccttggggatgtggagagaatactgctgccttttcttccatagggctgtagttggggaggaggaagctagagctgaaggggaggactctgcaggcaggtgccaaatccttggaagctgatgggagagtctttacctgggaccctgaaatgttctacctgagtagtcatgtttatctttctggggagtgggcctttcgcaggtcctcagaaggacccatcatgagccagaaaaaagggagtcagttagaatttgtattccagggagtagtaggtatttctgtgtgccccagctgcatcatcttttgtgtgactccacccttggcctactcaggaagggcctggtgttgcagctgatccagtcttaccagcggatgccaggcaatgccatggtgaggggcttccgagtggcttataagcggcacgtgctgaccatggatgacttggggaccttgtatggacagaactggctcaatgaccaggtgagaaagggtagagaaacaggcctgagaggggattcagggagcagggtgtctggggccctctgcatgggggagccctgtacccatgccgcaccctccatggcaagctgcctcccatcttctccccaggtgatgaacatgtatggagacctggtcatggacacagtccctgaaaaggtaggcccaaccagataggtcagtacccagaggaacttctgcagttttaagcagctttttaagctcctttcatctctttcattttacacagagagggtctctgtttcagggagagaggtggtagtggtagtgtattaatttcaaatccgtaatcttgggctctggatttatcagttgttttcctttctgccagtatttagtgtttttcgctatggccagccccaaggattgggatgggttcctattgtaactattgtaaaacaagatttaaaaaaaaaaagaaaaagaaaaaggccaccgggcatggtagctcatgcctgtaatcccagcactctgggagaccagggcgggtggatcacctgaggtcgggagttcaagaccagcctgaccaatatggagaaatcccgtctctactaaaaatacaaaattagccgggcatggtggtgcatgcctataatcccagttactcgggaggctgagggaggagaactgcttgaacccgtgaggcggaggttgcggtgagtcgagatccacgccattgcactcccgcctgggcaacaagagcggaattctgtctcaaaaaaaaaaaaaaagacaaaaaacaacttcggctgggtgcggtgactcattcctgtaatcccagcactttgggaggccaaggcgggtggatcacccgaggtcaggagttccagaccagcctggccaacatggtgaaaccctggctcaactaaaaatataaaaatacaaaaaagttagctgggcatagtggcgggtacctgtagtcccagctactcgggaggctgaggcgggagaatcgcttgaacccgggaggcggaggttgcagcgagtcgaaatcatgccactgcactccagcgtgggcgacagagcaaggccctgcctcaaataaaaaaaaaaaaaaagcctggtttgttgactcatacctataatctcaatgctctggaaggccgaggcaggcagacagacagattgaggccaggagtttgagaccaacctgggcaacatagtgagaccctgtctctaccaaaaaaaaaagaaaaaacccagaatttgtttttactgtcagtggactgaggaggggagacttagtgggagagtctgaggtcttttaattccattgagcttttttgtgtcattggcacaggtgcatttcttcaatagtttcttctatgataaactccgtaccaaagggttatgatggggtgaaaaggtggaccaaaaacgtgagttttgaattcacatccacttgtgtaatgccttgcctctaaagaatgagagtcttgttttctctgagccctttccctgaccgtgttcattcagtctttcaaagattaaacgtctcttgtgtgtgtaggcactaaggatacagtgttaaataaggaaaacttgcccttaaagttaaattgcagctagtgataagtgctgtgggcagatcaacacagagtaacgtgaggctgggcgcagtggctcacgcctgtaatccccagcactttgggaggccaacacgggcggatcacctgaggtcaggagttcgagactagcctggccaacattgagaaaccccatctctattaaaaatacaaaaattagccctgtgtgatggcaggtggcctgtaagcccagctattcctggaggcggaggcaggagaatcccatgaacctgggaggcagaggttgcagtgagccgagaccccgccattgcactccagcctgggcaacaagagcaaaactccgtctcaaaaaaaaaaaaaaatcacagtaatgtcatagcgtgggaagtgggtactttagattgggtgatctaggaaggcctctcatagctgagacgtgaatgatgagcagccagccatgcgcagacctgggaatagcaagtacacaagacccatagtgaaaaaccatggctgaggaacagagggcttgtgggggtgacctgtgtagttggcgcagagtgagcaaagggagatggatacaaaattcggtcagagagtagatcatgtaagacatgtacggtaggctgaggaggggggattttattgcgtgtatactgagaagccattgagttttaagcaggctgagaagtgccttctgttttaaactcctgtttcaatgacagattgaaaggggggcaagaatggaagcaggaacagagcacagtagtccaggtgagaaacttgaactggagtgctaaaggaagagagagagagtagttttatgtaggataaattttacgagtaaaaccagtaggactgacaggctctgtgatactgagagatacatatttggtctcctgaccaggctcctggcattcaacttctaaaatccttggaatctccagtgatgtgtgtttttgtgtgctgatgagttgattcatggctagcccctctaggtggcttcatgattagagggttggaactttcagcctcacccccaccaacttcctgggaggggaatggggccaaaggttaaggcaatcactgaggatcagtgatttaatcagtcatgcctagtagtgaagcctctaaaaaccggaaaggggccgggtgcggcggctcacgcctgtactcccggcactttgggaggctgaggcagatggatcgcaaggtcaagagattgagaccagcctggccgacctggcgaaaccctgtctctactaaaaatatgaaaattagctgggcgtggtggcgtgcgcctgtagtccccgggaggctgaggcaggagaatcgcttgaacccgggaggcagaggttgcagtgagccgagattgtgccactgcactccaccctgggtgacagagtgaaactctgtctcaaaaaagaaaaaaaaacccgagaggaggagtttggagacattctagatagctgaaggcatggaggctcccacaggatggtctccaggcctcttcccggtacctttccctgtgcatcttttcatctgtactctttgtactaccctttgttaataaactggtaaatgtgtttccatgagttctgtgagctgctctagcaaattaatcaaattcaaggagggggtcatgggaacgctgatctaaccagttggtgagaaacacagataaaacaacctggggcttaggactggcatcagaattgggggcagccttgtgagactgagccctaaacctgtgacacattatctccaggtagatagtgttggaattgaattgggggatacccagctgtgtccaccgcaaaattgcttgcttggttgttggtggagagaaagccccacaaacacttcttggtgaccacaggttacagaagtattttgtgttgtgagagtatagtaggaaagaagatttgtttttttgccgggcgcggtggctcacgcctgtaatcccagccctttgggaggctgaggcgggcggatcaccaggtcaggagatcaagaccatcctggctaacacagtgaaaccctgtctctactaaaaatacaaaaaattagccgggcgaggtggcacgtgtctgtagtccaagctacttgggaggctgaggcaggagaatggcatgaacccaggaggtggagcttgcagtgaggcaagatcacgccactgcactccagtctgggcaacagagcaagactccgtctcaaaaaaaaaaaaaagatttgttttttcctccgcaggttggatgtgggaaatgaagaaaaagaaatggaggatgatgcctaggtttttggcctatgtaacgggaaaagtgggagaggaacaggttgggggaggaaaatgaagagttcttttctcttctggtttccctgccctcccattcaaaggccaggaaatttctacagctaggcaggatgattggctccggcattccttaatttcagtcctcaaaatcaagagcttacaccctcagggatcttcttgcagtagagggaagggtggtgacgtacagtgaaaaacatgttggccttcttcatactgagtttgagtcccacttctgccatttctttctttcatgaccttgtgcaagtcacgactttccaagctgcaatttcctcatctgttaggttgaatgttgagaacttcccggtaggattgttatgagcattaactgcgtgtttactttgtgctgtgtcttgttctaagtgtattatggatagtcactagtttaatcctcatatcaaatggatgaggtgtaggtactactatttacactctctgacagataaggaaactgaggtatagaaggttattaagtaggttgcccactgtcataagccagtaaatggaggagctgtatttgaattctggcaggctccagaatcctgggcctgggttcttagctgctaagtgcttctccctttaaagtgtgaaaagcgcctgcccatcatgggttctccagtgttcgttctgatgtctcctccattgtctgaccttcctcccttaccccgaagaaccgaaacatgcagatcctgagcttgcccacaatctaggccttgggtcttctgttctttcacttggttcccttacctgtgtctctgttcctctctagaaccttcatggcaaaaggcaagacttctgtttgttgtacctgacctgtggcactatctctttaggtggacatcttcaataaggagctactgctaatccccatccacctggaggtgcattggtccctcatctctgttgatgtgaggcgacgcaccatcacctattttgactcgcagcgtaccctaaaccgccgctgccctaaggtttgagggggtaggagagagatgggcaaaatgtggggcggtgcagtggcaaggcattgcaggaagaagggtgggctttgggtctttgaggggcgacctgggcatggtgtctgccagcactgtacccaccatactgtgttcaattgagaaacttagggcatcactttcttttcccccatccacatagcatattgccaagtatctacaggcagaggcggtaaagaaagaccgactggatttccaccagggctggaaaggttacttcaaaatggtgagtttcctgagggaggggtatagggtgttggtggggacagtggtagaaggcagaaattgaagtcctacccctgggagtctccatgtgaagggcctgctttctttctcttctctagaatgtggccaggcagaataatgacagtgactgtggtgcttttgtgttgcaggtaagcagatgatggggccacctcccctagctctgaagtcagttgggttaaagggtcgggaggctgttatgcatcccctcatttggctcatagtcagttgtggagcaggaagtaatctgttttagaacaccaaaacactggcttcactggttctcttctggacttctccatcccacattgggactgggtctctagtcttgggcctctggccttcatagagctccctgctaacctccaactcagtgtattttctccatctaaaacattctatcaagtaagaacactagctttagagtcaggctgtttttgaaccccaggctgtgggaccctggctccctttggggatgttctctgaaggatggagacacatctcatatgaaatgtgtagcacaggtcctgacacggggggtttctcatggcttgctttgttaacacccagtactgcaagcatctggccctgtctcagccattcagcttcacccagcaggacatgcccaaacttcgtcggcagatctacaaggagctgtgtcactgcaaactcactgtgtgagcctcgtaccccagaccccaagcccataaatgggaagggagacatgggagtcccttcccaagaaactccagttcctttcctctcttgcctcttcccactcacttccctttggtttttcatatttaaatgtttcaatttctgtatttttttttctttgagagaatacttgttgatttctgatgtgcagggggtggctacagaaaagcccctttcttcctctgtttgcaggggagtgtggccctgtggcctgggtggagcagtcatcctcccccttccccgtgcagggagcaggaaatcagtgctgggggtggtgggcggacaataggatcactgcctgccagatcttcaaacttttatatatatatatatatatatatatatatatatatatatatatatatatatatatatatatatatatatataaaaatatataaatgccacggtcctgctctggtcaataaaggatcctttgttgatacgtaagtggtggtcttccttaaggggcttcaaattagtggatatgcttagctcagaccttccagccagtctcttgagactaaagggttcagctttccatccctggctcaggcactgccaacaccttgtcttcacccaaacaaatccccgagatgggagcagagagcaggaaggagggaaagtagataagcctcaagaataagggcatccgagagggaagctggggaactggacacaagggactggggaggggaccaaccaggattcatgatagtaccccaaagccctttacagttttcttccatccctccaccatccagccaggggaatcctcccatccctacgatatcgctgttgattccttcatccctggcacacgtccaggcagtgtcgaatccatctctgctacaggggaaaacaaataacatttgagtccagtggagaccgggagcagaagtaaagggaagtgataacccccagagcccggaagcctctggaggctgagacctcgccccccttgcgtgatagggcctacggagccacatgaccaaggcactgtcgcctccgcacgtgtgagagtgcagggccccaagatggctgccaggcctcgaggcctgactcttctatgtcacttccgtaccggcgagaaaggcgggccctccagccaatgaggctgcggggcgggccttcaccttgataggcactcgagttatccaatggtgcctgcgggccggagcgactaggaactaacgtcatgccgagttgctgagcgccggcaggcggggccggggcggccaaaccaatgcgatggccggggcggagtcgggcgctctataagttgtcgataggcgggcactccgccctagtttctaaggatcatgtctgcgagccaggattcccggtaagaaaggcatttgcaagagattgtggctgcttattttgccgcccccttccgacgggcccgccgggggtagctgagaggcccaccagggttgcgggagaaaccgaaccgggtggggggagggtccgacttggaggggcgagggggaagacccacggccgacgcggccaccaggtcgaggcggagggtagggacagcccggctagggtcaggcgtgcgaggtctgttacgaggcctcgacccgaggcggtgccatgcgcgaagccccggcgctgagtggcgagacggggtcgcgacctggcgtgggaaagaaaggtggaggcggccgccactatgtgtggcccagagccggcaggtccggttgcctccctgtgccgggggagggacggcgcgcggggttccggagcattctgacggtaccactcgcgagaggcgggggtgcctggtccttagatccagtcacttcgtcgcggctaaaacacgggtcggggagaagaaaccggccgttcagtgtgctggttttcttgacggccaggactgagcctaaccccgaggagcggccgcgtgaggcaccaggagcccacccggcgccgggcgggcgggtccattttgccgcacaagccgggctattggcaaactgcggatgggcaggtccaccttccttcgggggtgagcggcctgaggtatgggagggcgacgctacttcgcgacgggggcgggcgggatgtggattgttcatggaggggtgggagacgccgccgggtggtcgagggagcgagcacatggtggcctgaggcgttcccctcccccagtctgcttcgcttctaagtgttgtgcaatctccccctttgctagctcggcttgggctcattgtgcgcgaggccgccaccgcccgcggcctcccacatccgggcaacgcgaggggggggcttcggctggagggagtgggggagggcgcgggcgggatgacgtggggggaaggggatgtcctaccctccgatctgggaggtgaagggcgggacttccagcgcgctggtgctgcggtgggaggtgcacgcgcttgggctttaagcggctgggtcgggcccacgtggacccggcggcaagcaccacctctgggcaccgtgagcgcggcggcacgcctgccggcctgtcttcagaaagggtcacccccttatgtcgggggtggcctggcctgagccgctgcctgcatggggcaaatgcctcagttttatagaaactcctcctttgggtattttttgggagctggtgggagttggatctgggacagcagattgatggcatcatgcaggccactcctgacagagcccggctgtcaggatttctgagtgcttcggtcgggcaggggacaaaacttatgctttaaaccaacagatccagagacaatggccccgatgggatggagcccgaaggcgtcatcgaggtgagactggagaaatggaattctgtcctcccccattacaactttcagccgtatagagttagagtggcctcttgattgatttcccagatcatctagaagcagctggtttccctaaagggaggagggttgtaagctctgaggcttttgttagtaggcaccagattctgtttgctcggagactacagctcagctccaccttttccatgactcaagctttaatttctttgcatcccctagagtaactggaatgagattgttgacagctttgatgacatgaacctctcggagtcccttctccgtggcatctacgcgtatggttttgagaagccctctgccatccagcagcgagccattctaccttgtatcaagggtgagacctctcagtcccagaagacattgtggactgtccctgacctgggtagagtggcatctggttggtgatgcccatctcatatcagccagggacaaagcaactccttgttcatcccagcttggcttttgatccgtgcccatgcctggttcatgccttggacacataggtttcctttaaagaggtggtattgtagccagcttatatttgcatctacagccatgtttctagtccagcttggtgtgcaatactagatgagttaataactggtccttgtttctgatctggttcccattgtgtaactgtgttgattgggaaggtagtttgtgagccatgaaatgcttggttcattggttgcttattgacctcattaacctaggacttgaatatcccaaagggtatgctctttaccacattcaactcctaatttatttgtttaggttatgatgtgattgctcaagcccaatctgggactgggaaaacggccacatttgccatatcgattctgcagcagattgaattagatctaaaagccacccaggccttggtcctagcacccactcgagaattggctcagcaggtaagagtggcttctattccctccttcagggctgatttagggatgatgagtataatccaaggaccagagaagtcttctctgatcaccaccttgggaggaagacatgggtgccctaacactctcgagacctgctgggttaattaaaagctatttcttacccaaacgtaaccattgcttcctccacccatttcctgagtcaaatgggaaagctgttgggtgaagcctggctggctgggcaagtttgactgtgttctgaataagcaccttcactatgggctaagagatcccttggtgtgggggtgatcttacagtagtcagagcagatggacagtccttttcacccttgcttaatagccagagctgtttcatgcctggggcacacacaattctaatgctggactttttcctgggtcatgctgcaacactgatgtcagagcatgtttttaaatgttctgtggcaggggcagtgattattctgggtgtggataatgtaagaagttacagcagagctccattctaaggcacttggctctcagttttctcagagtgaacatgcctcgtagcttgggtcctatggcaggagtgcaataggacatggatatgcatcacctgttctataaaactggttgctggctgggtgtggtggctcaactcgtataatcccaacactttgggaggccaaggcaggcagatctcttgagatcaggagttggagaccagcctggccaacatagtgaaaccccgcttctactaaaaatacaaaaattagccaggcatggtggcgtgtgccttttatcccagctactcgggaagctcaggcaggagaatttaacccaggaggtggaggttgcagtgagctgagattgtgccattgcactccagcctgggcaacgagcaaagctctgtctcaaaaaaagaaaaaaaaaatggttgctgcgtgatgaggcagttggtcaaattagttttcagaaggttaagggttctaaatatctagagtaaagaaactgaattaattatctgagcggcctcattgtgaatcactgtacactcaggaaccagactgagttgaaatcctgtctttgccacctattgacagcacgatcttaagtggattttagcctctgcctgtttctcagctgaatgtgagtttaataatagtgcatgccccaaagttgttggttaggaatcaatacatgaaaaacatttaagaatggtgccgggcacagtggtaactgacatatgagcacctgcctctctctgctcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtgtgagtaattcggttctccaatcccctgggtcactttgctcttgtgcacgctttccagtctttcagcgtaagccagagtcattcccaaggatgctggtttctctctgggggaagagctgctctgtgatggagcccatgcgtgtcatctgagcctctggcttccctgccagtgcagccctggcagtgtcctacttcccagggctgttgtctgcctggcgggaaggtcctgggcaaaggatcagtctttgtactctgagagcagactacttggctcctctctgttttttatcagcgaagttggatatatctctcccacatttccctaatcatatgctatatattggctttttttttcttctctagcccccaaatacatcaagatgtttgtactggatgaagctgacgaaatgttaagccgtggattcaaggaccagatctatgacatattccaaaagctcaacagcaacacccaggtgagggcagtcttgcttgaatagctaatgattcttgaaaaatagtaagtgccaggggaaccatatactggattcttgagcctttttatgcatctgcttcagttttaggtgtggctagggaagggagcaggcctcaggaaggaaccagcactctaagactggcctttttttccactaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggtggggcccagtgcaggaggcgggcctggtagtgagttgttgggtatagcccctgactgatttttgtcccccaacctccaggagtggaagctggacacactatgtgacttgtatgaaaccctgaccatcacccaggcagtcatcttcatcaacacccggaggaaggtggactggctcaccgagaagatgcatgctcgagatttcactgtatccgccatggtgtgtttgcccgctgccagcctgttgtgggtctgcccgtcagaagtgtcctacttgaagccagggttcctggaacccaggtgcctacctggtctgctgcatatttgttttctcttccagcatggagatatggaccaaaaggaacgagacgtgattatgagggagtttcgttctggctctagcagagttttgattaccactgacctgctggtgagtagagggaactgatagcaaaggcagaagggaggatccaaggtgattccctctccaaggggacatcagtgcctctcaggaaagtagcagcttggaatagaatctggcatgcctaaggcctttggggaactgggatgcttatttcctctgccttccttggctgcccacatggatgcctaagtgtcttccctccgggatagagtgtcctccgtgcacatgctgaagagttgtctttcttgacgtaggccagaggcattgatgtgcagcaggtttctttagtcatcaactatgaccttcccaccaacagggaaaactatatccacaggtaagcgtagatctggaacactcccctaccccttcacacctggccctccctgggcttaaagctcctgatattcctcatccccttccttgttttccagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatcttgtcattttttttctttgaataaatgtcactttttgaggcaaaagaaggaaccgtgaacattttagacacccttttctttggggtaggctcttgccccaggcgccggctcttctcccaaaaaaaaaaaaaaaacactaatccatttccctaacctagtaacctccagatcccagaggctctcctcacctcagctgagctcctttgaaagtgattcaagggactatgtcactcagcctcatttgctggaccaaatctggagggagaacccctaaaacccctaagtgaggttgcccagggggttgtccccaggtggggggaagcaggggagagaaaatggtagccatttttacattgttttgtatagtatttattgattcaggaaacaaacacaaaattctgaataaaatgacttggaaactgcctgtttgggcttctcatttcttacctccccttccctctcccacctgctactgggtgcatctctgctccccccttccccagcagatggttacctttgggctgttgctttcttgtcaccatctgagttctcagacgctggaaagccatgttctcggctctgtgaatgacaatgctgactggagtgctgcccctctgtaaagggctgggtgtggatggtcacaagcccctcacatgcctcagccaagaggaagtagtacaggggtcagcccagaggtccaggggaaaggagtggaaaccgatttccccaccaagggaggggcctgtacctcagctgttcccatagctacttgccacaactgccaagcaagtttcgctgagtttgacacatggatccctgtggatcaactgccctaggactccgtttgcacccatgtgacactgttgactttgccctgatgaagcagggccaacagtcccctaacttaattacaaaaactaatgactaagagagaggtggctagagctgaggcccctgagtcaggctgtgggtgggatcatctccagtacaggaagtgagactttcatttcctcctttccaagagagggctgagggagcagggttgagcaactggtgcagacagcctagctggactttgggtgaggcggttcagccatgaggctggctgtgcttttctcgggggccctgctggggctactggcaggtaaggaggaaggaggctgaggggagggggcccctgggagggagcctgccctgggttgctaaccatctcctctctgccaaaagcccaggggacagggaatgactgtcctcacaaaaaatcagctactttgctgccatccttcacggtgacacccacggttacagagagcactggaacaaccagccacaggactaccaagagccacaaaaccaccactcacaggacaaccaccacaggcaccaccagccacggacccacgactgccactcacaaccccaccaccaccagccatggaaacgtcacagttcatccaacaagcaatagcactgccaccagccagggaccctcaactgccactcacagtcctgccaccactagtcatggaaatgccacggttcatccaacaagcaacagcactgccaccagcccaggattcaccagttctgcccacccagaaccacctccaccctctccgagtcctagcccaacctccaaggagaccattggagactacacgtggaccaatggttcccagccctgtgtccacctccaagcccagattcagattcgagtcatgtacacaacccagggtggaggagaggtaaagctaaaactgggggatgagaggggagggaggcaggactggatataggctcagagggaagaaggaagaggggacagggaaccttggccggcatcgcatgcagtcttgtgaccttccagtctttaacttccgcaggcctggggcatctctgtactgaaccccaacaaaaccaaggtccagggaagctgtgagggtgcccatccccacctgcttctctcattcccctatggacacctcagctttggattcatgcaggtatagccatgacctcagtctcacccctcactcagcctcccggcgcccctcccctcccaatcccacacgctactccttcctctgtggagagggataccacctgcgccttcctcttcgccccacaggacctccagcagaaggttgtctacctgagctacatggcggtggagtacaatgtgtccttcccccacgcagcacgtaagtaacctccttccctttctcattgctaccactagacgccagggttcctgaaaggactaagctggggccagggaggtggataggatctgacccttcctcactcctccagagtggacattctcggctcagaatgcatcccttcgagatctccaagcacccctggggcagagcttcagttgcagcaactcgagcatcattctttcaccagctgtccacctcgacctgctctccctgaggctccaggctgctcagctgccccacacaggggtctttgggcaaagtaagacctacctactccttccctcctagaatcctcccactgcactgaaaaccccttccccaggcccataagccactcatctctcttcttaaccccccaaatctcgctctcccagcttgtcatggctacagggcagctttctttccatcctctacaagactctgccagtttcccccttttatcactgctgagtcactgcggtgagctcctcaccaatctcctactccccagcatccccccattccctcctcccacctttatcccaaccagcacgtcactgcaaatacctacctgccctatccttccgccaggtttctcctgccccagtgaccggtccatcttgctgcctctcatcatcggcctgatccttcttggcctcctcgccctggtgcttattgctttctgcatcatccggagacgcccatccgcctaccaggccctctgagcatttgcttcaaaccccagggcactgagggggttggggtgtggtgggggggtacccttatttcctcgacacgcaactggctcaaagacaatgttattttccttccctttcttgaagaacaaaaagaaagccgggcatgacggctcatgcctgtaatcccagcactttgggaggctgaggcaggtggatcactggaggtcaggagtttgagaccagcctggccaacatggtgaaaccctgtctctactaaaaatacaattagccaggtgtggcggcgtaatcccagctggcctgtaatcccagctacttgggaggctgaggcagaactgcttgaacccaggaggtggaggttgcagtgagccgtcatcgcgccactaagccaagatcgcgccactgcactccagcctgggcgacagagccagactgtctcaaataaataaatatgagataatgcagtcgggagaagggagggagagaattttattaaatgtgacgaactgccccccccccccccccagcaggagagcagcaaaatttatgcaaatctttgacggggttttccttgtcctgccaggattaaaagccatgagtttcttgtcacatgcctttctatgccttccatggctgggtctcagggagccggaagcagctgctgaggagggatgaaaatgtcagtgtgtgacgatgcctcatgggttcaccccccaaagcctggcacagctggtgttgggtctgccgtgcctcccttccttcctcctcttggggccactggctgctccagttccccatccgtggcaagccggtagagccattcatccccgcagccttcttcctgaccctcgtacagtttcaaatgcagcagacagccaaagcaatgagtggggggctgtggaacttcattcccaaaggcagcgccagtggctcctgagcaatgagaatgtcctgtcctgtccaccatattcaaggccagcagaagagcccgattaaaccctcgcagcacctggcatgctcctatcccacctacaaggggttgaatcaagaaggagcagtgggtactctgacctccactgggggctcctgggaacagcatgccccccacacggggccacctgccaagcctaacttcatgcccccagtacttgagatgaggagtgtcactctcaggacagccaaggtccagattccagaaaggacctcccagatggccacagcctgcaccagcagtgagcgccagtcccacccattacagctggctacggcgcaatccctgggagccaggatgagcagcaccccccagccgtaggagccccaggaggcttccggcctccaaggcccagagactgccccacaagggcagccctcacctggcagggccccagcagccccacctctgcctgcagacatccgtgtgaccttgtagactttggaggggggccgccaaagggctgatccacagcggaatgacgcacgggtgggcaccgtgggttggcgtcccggcggtcggtaacgaagcacaacgcccccaccaggtagtccaaggtgccctttcccaagcagcgctgcagggtccactcggcctcgccgaagtctctgcccagcacgtggtgcgccctcgggccagcggggagggggcgaatcccgggactgcctcgccaggcctcggctccccggagactcttgggggtctgggccccaagggtgattcaggtgctgcccttccccgacctgggctcgcctcccccacctcctcctctgcttcactgtcccgggcccagcagttgccggcgcactcatgctccgaggcctgagccaaccggaggcgagacaagcacagggccctgcgcgcaacccggcacctaaggaggcctgcccggtgcagactctcctgctcccaccggcgcccttccctctagagacgctgagagaacgggagctagtagcgcccccacccaacgccacctcggagactccggctccttctctctcaacttcgaacaatacaaagtgtgctaggagaagacaagatggcgcccagcaggaggagcggagaaaggcaggggtgtaaatctggcttccaaactggaagcgtcaacaaaggcgtgggaggtctaaccgcgcaggcgtgcagcttcggcaagctttacaattccaacagcgcgtccaaaacgtggtccctgactgagacttattttacgccactagagtgagggtgggtagcgtcagaaagagcggggcacggggcgggccagcttcgccgcgggaaaagaacgggaggcggagtgtccgcagcgcgcacgcgcaacgaaagtcaatggcggtctggagagactggcggaagctagctttgcaatatggcggccgaggcggacggaccgcttaaacggctgctcgtgccgattcttttacctgagaaatgctacgaccaacttttcgttcagtgggacttgcttcacggtgagttttattcagcatccgatccaagtcctactcgagtgaccgtgggcccttagtccaagccttgatcggcgactaagtgacggcagtgactgccgccatgccgagctggacggaagtcacttctgagaagggcggaagtgtctcgggctccttagagggaggacaccatattagtgccagtggggaagtcaccgggtggaattacttctttgtggagtttgtgctgtagcgacaatgaaaaacgaagagtcaacttttataaaacaaaataaaaattaagtcaaatcatgccaacctttattagatcgctagcagggttaaacttaattcaaagcccctgatgaatcgggccttcattgcacccccaaaggctccgccaccctgattgctttctttccagcctccaggtttgctcatagtctgatttcggaataatttgcctcccttcctttttctgattgcgagacagctccacaagggtcaccgtcagaccgtttggggagcgtcagtctgcccctgtcagttcatggtacctctcttgagctcgtggggcactttgttttagccgcattcatgacccgtgagagtcagactcccactagaccaagttccttgaggggaaggcttcaaggctagagaagttgtggatggccagggcataaaagcaagccttgaaagggtaaggtttagtccctgagtaggggccagggacagtcagagtgttcaagaaagagtggtatggggcgggcacggtggctcacgcctgtaatcccagcactttgggaggccgaagcgggtggatcacctgaggtcaggcgttcgagaccagcctggccaatagggcgaaaccccgcctctactaaaaatacaaaaaattagccgggcgttgtggcaggcgcctgtaatcccagctactcgggaggctgaggcaggagaatcgcttaaacccgggagacagaggttacagtgagccaagatcgtgccattgcactccagcctgggcaacaagagtgaaactccgtctcaaaattaaaataagaaaaaaaaaatggtatgaagacttgtctttggagagagaagacatgtgaaatggggcacccattggcccagagaagggaaataaaggatcagagagctcttgggcatttctcagctttatatggggaagcaatggagagccgtggaggtcaagccaagtttgggtgttaatttatagggaatggaagattggatgtggggggtggtaggcatcggagaaaagctgttttggaaagtaacagtctggggcccggtgcggtagctcgagcttataatcccagcactttaaggaggctgaggcaggtggatcatctgaggtcaggagttcgagaccagcctggccaacatggtgaaaccctgtctctactaaaaacacaaaaattaaccgggcatggtggtgtgtgcctgtaattctagctacttgggaggctgagacaagagaattgcttgaacccaagaggcagaggctgcagtgggctgagattgggccactgcactccagcctgggtgacagagcaagactctgtctccaaaaaaaaaaaaaagtgtggtggtttggagcaggaaggaccaggactttctcactgccctccgcctctcctccccccaagacaatgcaagaccctggtgtgggtaagggggctcggggagagcccacaggagcttcaagccctggcctgggtttcagacatctcctgtctgcttacccttttttctctcctcagtcccctgcctcaagattctcctcagcaaaggcctggggctgggcattgtggctggctcacttctaggtatgtctcttatctttctttccagctgttgggttggggtggaggtgctgagaggccatcaactgtgtgggtgttcgttctatagctgttgtgttgcatcccaaagaatggagagtcctcagtcctacttttctcatctttcccctagtaaagctgccccaggtgtttaaaatcctgggagccaagagtgctgaagggttgagtctccagtctgtaatgctggagctagtggcattgactgggaccatggtctacagcatcactaacaacttcccattcaggtgaggggcccacccttccaccccaagggtaatacccacaactctaatggggattaaggtgaaggaggttacaaggcagcaaagtggccgggcccagtggcttgcacctgtaaccccagcactttgggaggccgaggcgggtggatcacctgaggtcaggagttcgaactggccaacatggtgaaaccccgtctctactaaaaatacaaaattagctgggtgtggtgatgggcacctgtaatcccagctacttgggaggctgaggcaggagaatcacttgaacctgggaggcagaggttgcagtgagccaagattgcgccactgcactccagcctgggcaacaagagcgaaactcagtcttaaaaaaaaaaaaaagggacaaggggctaggaaagttttaagcccttttagaaacctaatcatcaccagtggaggtgatcttgagaaggggtgagcatcccgagaatggccacgattcagaatgagccagtcccgtgtgggggctgtagagaagcgtgatcagagcatagtgtccctggatggatgggctatggaggctttccctgcctctttctaggcccgcctttcttcctcccaactcttgactctgcagctcttggggtgaagccttattcctgatgctccagacgatcaccatctgcttcctggtcatgcactacagaggacagactgtgaaaggtgctggggacttacccaagagcaggctgtgtggttcctgggaaccctgctgggaactcaggtctgggaaagccaaatgatgtggagagattgacaaggactcctgtctccccacccctaggtgtcgctttcctcgcttgctacggcctggtcctgctggtgcttctctcacctctgacgcccttgactgtagtcaccctgctccaggcctccaatgtgcctgctgtggtggtggggagggtgggtaccaggagcaagggacaagatgttgtgggggcagggtgggggggaagagtagaagatcaaagtgtgggggtgttgtacttgggggagcatgggaagagctcaggtgacagagccaaaggtctcaactcctcccctagcttctccaggcagccaccaactaccacaacgggcacacaggccagctctcagccatcacagtcttcctgctgtttgggggctccctggcccgaatcttcacttccattcaggtgagtgcaacatcttccttctagaaggcactaaaacctcgtcttacttctcccagctaagggccaaagctgccccgtgaggaacctttgtccataagggaacctttcttgagctatgctgaagggtaaccctggctctgtctcttgcaaccaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggttttcttttagtggaaacaaatggttgatggatccagatccttagaaaaggagaggatgggggtagagtctcccaagccaaaattttgacatttgagtgctttcgtaagccctgtacatgtactattaattcagtcattcagccaagcctcctcctctagcagcaatttccagctgtgtaacactatcctgggcaaatgttttaccctgtcctccagcctccctgcttcccttctggccctggaagactgagtctggacggcagagtggagggactgggaggctgtggctgcctccctccctcagcccggctgggactgtctcccggaccccagtgctggggtgggggaagggggacggagaatgactcaggcagggccccagggtggggtgaggaggttcctgctctggcaggtctaggcggaagggagtggagatggggctggttcctgctgcagtgaggggaacagatgggacaataaagactggagactcagttgaataatacaaaactgtttaatactaccaaaaatataattgtatgttgtgcggctctccctggctatcatgggaggactgcaggctgcctctgaactgtagtccaacaggagaaagggttgacagcctggggtaggggatgctgctggattaaaaaaggaggatgaggcccgtcccgtgaggtctgcgtccatgagggttagaggtgggttaggggcatgggggcaccagcaaggggagggttgtatggagtgggagagccagggggcaggtagtgggtataggtgggcagcagttccccctggagcctagggtcactctgagggagggagcacggtgagggggcttccagtttgcagtgggaagagctgcagagagaaacaagaggttagagggcacttccctgggttggaggtgagtctggccagttctgggcagacagggtagagcgtgc

SEQ ID NO: 1247 - DNA, 90898 bp, Homo sapiens
cgaatcgaacaagttcttctccgcagagctgcctgttctcatttaaaacatcttttttctttttttttttaaaccttttccacacacgtcttctgggttggactgctccctggctggggccctcttttgtttactttaatttaaaaaatagagttatcagggctacaaagcaagtaagacccagaaaacatttagccactccacaaggcatgggggtggaaggatttgacctctctacaatcttaaaagaccactgtgagtgagagagccacgagggctgaacccggtgtcagcacgtgcttctggaatgaataatcggaaggggtctccagctgggtcatgggacagatgctcatttatgatgctctgggcttgttgacctgcacttagtggagttcccaaactgctgaaaatgcataaggtagtggccgcaagatattatttaatcctagacttagtgtcatatttcttgttcagatgctatatatgctttataaagagttacagggcttttaaaaattacagagtaagcaatctttatacattccacagtataaggatccccatatttcacatgctggtgcacaggccttttgatgactgctacccctcaggtatatacatgaagacacagtgaattattggccaggagtcaagggcttgtttggctttcaaagatgtttaaaaagcaccaacaaattataaacagcctctgtggttactgaattcagtgtctaagctattattattattggagaatttgaaaacaataatgagattagtaaaaaaacactcagctttagaaatctaaggggtttttgacttaaaaaaaaaaacaccgcttatgacaacattcaaacattccttcattcaaacatgcattgcattcatacttacatgccaggtatgtgcaactcaaaaatgtctaagatacacttcctgcatttcttatagtctagtagttcagttttaatatttaccaatccactaaattgtcagctccatgaaataggaatgatgtcatgtcttgtttttgtatccccagtgcctaacacatcatagctgttcaagaaatatttgttgaattaatgagtcaatattgtatatggtctatatctcagcaatactaaggcctattaactttcctttaaggtagccaggattaaaataataatataataattatatatatatatatatatataaaaaacataatatgcacatcatacagggaactcttgggagcttctcacaattgtcccctcagtgacaagtttgagtgtctgcaatccaagatggacaataggagacttatgcttcagtgagaatttgttcagcctctaaaacattttcatcaactgtacttttttttttttttttttttttttttttttttttgagacagcgcctcgctgtgtcgcccaggctggagtgcagtggcataatcccagctgactgcaacctctgcctcctaggttcaagtgattcttatgcctcggcctcctgagtagctggaattacagtcgtgcaccaccatgcccaactaatttttgtatttttagtattgatggggtttcaccatgttggccgggctggtcttgaactcccagcctcaggtgatccacccagctcagcctcccaaagtgctgagattacaggcatgagccactgcgcccgaccctgaacttccttcttatgttatgatggcaataatgctcttagaaaataattggaaagttcatttcggttttaagttggtttgtggcaaatcaacgcagaagtcaagtgcacagaactcaagtaaatggggatgatttgttttttcccaatatggtacaataaggtagaaagatcataaacaagcagttagaagactaatgggtttggccacagtgttgccacctcaacactgtttgttgtaggacctcaaacaagttaagctgggccaatacctgaggaggaaagtgggaaagtttccttgaagcagttcattctcttcactgtatggatgaattgatacagccaaccaatggaagtaccatttactaactctttaccacatccaaagggctgagctgggtgcttcatatgttactggctttgaagaagctctaccttgcccttctaaaaaggaggaaactggggctcagatatgttgagggacttgctcaaggcacaagcgaatagaatttcaacccaataaagcaaattccaaactaagctctttgcattgcgtcagtttgctttctttctgattgttcatattcaaggctaaattgggcatcccggacaagttcaaatccagagagaatcctacggtctccctgtactcttaagtggcaaaaccaccaaaccttttaccagaacacctaacattctggtcaagaaaccaaattccatcttctctgctcttctcctttccaatccctggtagaagcatttgcaaacacaaatagttaaaggtcaccagtaagaagtagaagagggattttgcatgatccatctgtgctgggataatccggaattggccgtgaatatgttgaagggcctacacgctacatcagtaattctttttcacctgccatccacaccagcaaatgtgttattcttgtacattctttggagaagagtgttaggcatgtgtgtctgcagattgggcactcaataagtgagacagaaaagcaagcttcagatataaattttttaattcccagttaaaaccttgagaaaataagcaagtagatggtgtgtcctagctataaactggttttaagacaaatctgcttacatggagttgtcgcaaagaagcaggttagaaaacatgcattttttccacataatatatggaatgaagaaaagatcattgattttaacagccaggagatttgggatatagctgcaactttgccaccaactacttgtgtgaccttgaacgaattctttatactttctgggtcatttcttcatctgtaaaatgaaaagtttgaactaggccagtgatttttccatctttttcttaaagctgtaaaaccttttctttgtaaacaaactctcataaggaatctcaaaattcttgcacatcatatcttcaacttccaccaaggcagcctcactgaagaacaggctggagccacagtaccttagatgtatcttggttctgcaactgactactggtgtgaccttcggcaagttatttcacctctctgaacctcatgcatatgtttccacatacacaaactggggacaacaatgacagcatctacctcgtagagtgttggggagaactaacctctatgcttagatggcatggaactccatacatgctattgttattgtggatattatagctatggacagagccacacactacagcaaaagcacattaaattctgcccagttactaacttacgggggtatcaattgcttatagtgtgtcattttgcactcatcatttaaaagacttacaaataagttttctgaaccaacgttcatagttagagaagattctatatgtaaaatgatgtttatcacctgtgataaaaccagagagaaatgcaagtgtctcctgtaggtcaggataatggttattttagtggagagggcggggacacaagaaagggctcctggggtgaccggcaaagttctatttcttggcctgctgttatagagtgttctccttgtaacaattcagtaagttacacatttgttttgtgtggttttctgtacctttattttacaataaaaaggttttataaaacctttgtttcatttcataaaacaaaatcagtgagtacataagttatacttactggcttccaaaatgttaaaatttggccatgtgatgcatgtcactgtgtgttattgctttattacacttttaaaaatacttcttaaaatgtattttacaatgaaaactttgccatatctgaaagtgtttctgtggaaccacccttctagggaacactctttgaaagctgatggacctctgttaaaatgtggattccaagatgtttgttttcaaaaaaaaaaaaaaattctgaaaaacagtcttgtcctttataacttgactatcttcatgaaacactaattattttcgccttaaaaaggggacacggctttagtgtttaaccttcacttccatcattcttttccagtaagcatgaatcacaaaactcaaatgtttcctaagatctgaaacctttctctaggtccatactttatataatcctatatgtgcaaaaaacaaatgatttaagtttcctgagttaaagaggaaattggggagtaagagcttgtccacatctttaatgcttagaggagcacacacatttagccctgccatctgtacaaatggtaccagagttcaacatgcttacgattataaagaatttatgatttatgcttgctagttaaatatgcttatgatttaaacttattttctctggcaagaaataagctagtcagcaccacagcctagccagatgatgggaaatagaaacatattttaatgacatatattttaacttgctggcccttgcaaatgctactgttttttcttttcttcatgtaacaaaagaaccatcgtcttgtaggattccagagatttttttatgcattcattaacgaaaagcagttaaaagttctttaatagcagttactgcagcgaaaggatcactgaggaagaaaaggcatgcatggtcttggcttccaagaaaactgtacgttaggtgacaaggcagaggaacctatgctaatagaacaaccgagaacacattccaaaaagtgcatcaataacgactagatgataaagtacacacagaatgcatggtggcagtaatcagatgcaaatatgagagggaaacattatgaaattttaaagccttcctagtgttatgccctgctcttcaacgatttcattaaattcgctgtgttaaaattaattaggcatcacacataagatcctgaattgcttgtttctgcagggagagataggaaagtctgcagatgaatggaagaagagtttgttggtacgttttgtttgtttttaaaggaatatattagacagccagaaaggaggagtaaattcactttacttgccgaaacaggggacaactgaatctcaccagcaaattgcagcacaaaagagcaacgagagtaattgacttattctaaaacggaaccattcttaatagagggtaaagaaaaagaattaaaataagcaagatacgttttctaagagacccagatgagccctattatcaaatgtgttcaacagggaagtgtaaaaataacaacagttactccccatcagaataccagataacctactaagcgtcagactccatgctagcagcgtcacacatattagaggtgttggacagaaacttttaatatgtgttgtaataaacaaggttattctaatcaccacacacacactggaaatctaataatgattaagtgatgtggttgattaaactgcatgaaatttttaaactggaggatgaaaatgacatttctatactataagaacctcaatacagaatgagaattagtagcaacagattacaaaagatctcaaaataaagttctacaaactaacacttaaacaaaccctgtgaactactaccctgaaaaatgaagaagcacaaattcatagcaatatagtcccaaattagaaaattgcaaaacagtctaaacatttgcactaaacacataaatcactaccttttcaagtaagaaaagtatagtctagtcttaccttattgctgcaaaaggctggaataaaaaatactgacttatagaagcaactttcacatgtatctgaacatcaaacacaacacacaatataaaatcaaaaataactagaacagaaaagttttcagtctgaccttaaaaatactgagcaaatcactagatgaagccagatcaaaaggaagggcattacaccagcttgtagccagatgtgaaagggtccccaactgcacagggcacagatggtataaaataggggggtgggggcacaagcagatccaaaacataatcaaacaaacctggttcaacttacacaggtaagactattctaaagaattaataactttcaatgtaagattttaaatttgggacaaataatgttagctgtctcaagctaaagtatgctcactagtttaaattttgaaattcttttatataatcattgaaataaattctccatgagaatatattcaaagtcatggtgacttgttttaaatgaatactgaaaagacagtgttaaaacttaaaaacaaaaacaatggttgtaagccacattatctgattaaagtctgagaactttggggagaatttaatgtatatccacagcatcaatacctctatttgaaaacagaaacactgtaagtttattaaaatgttcaaagtcctttaatattcaccattcatcatgtaatgtaaagtgctaaaattaaaattttcaccctaagccttcattaaaagttgcttatttgtatgtgaaaagatgagaggtagcataaattttctatagaaaactcagaaacactcaatttacttcatgttcagttctataatgcaaagttgacactttaatagatccgaaataaacatctgttccaaaataaaagttcaagaaaaattatctgacttcgatattagaaattgaaattttcataaagaaatcttgcatttcactaaatgagttggtaacttttttcaggcagcaaccaaaacaaaaacatttaacacagattccttcaatctcatgatttctgaaggacacaaaagcatagaatatccaaaagctattgtattggatattctaataaggtacactcaagacacacatatacaatggaactctgaatttcagtagcaatgatgaacaaaaaaatactgactttgcaatgacttttgcttatcactcacatcgtttagggaatacttatttgatttttttgacatttctatgtattaaaggatctctccagtttagtaacagctttgctaagctacgttttgaaagtgacaattaattttagtggaaattcattcccaggctactttgatagtcatttgaacagttttgtgttattttacatgcaattttatagctctataacgttcatttaatcttgttcaatgatgctgaaccccagatgccataagacattatagaaaagtagttactgcacatatggagtaactacttttctgaacactaatttcttttctcttaacagactgaaatggtatttagaaaagagaaaaaccaccactctgtattaaaggctttatattatggacttccagggatgggctcccatgactgctgtggtcccagccataaagttcttattcacgagcatcatctactcaagtctcagtattaatggttttctccagccttcataagattgttggtatcatacattggaatcaggtcacctgacagagcttagggttgggaggctttcctcatttgtcatatgtgggagttggataaaatcaggggttctccaagagcgatctgagcaccatcagcattagaatcactagggcacttgttaaaaatgcagatatcctcccagatttctagtgctggggtcaagaaatgtgaataataagtaagtatctgagtgattttgctgcatgctaaggggtgagaagcactggtagatgatctcaaaggtcccttccactctaaaattctaagagtccctgaatgttcttttaaaaatggatttatgtcagcaacatgaaagaatttctagaacacaagacagtgacttttggcctgagtgggccaatctgaataagtattcttagatttggatgtatatgtaaaaataatagaaaataaaatcagaacagtataatctgacatgaaaggaatctatttgggatttcttcttgggagaagtagaggggcaacccactctaattgctataaatgaccacaggttcaaagggacttttcgttgcctctcagtccctattttttcccacttcaccctctgactcctcccagctgttgagatccaggctttttacaatcctgagtcaccaaactcttgagtaattttaactgatctcaatatattcttttcagaagtgaacaattcacaggcagtcctctactttcacttgtaatgagtaaaatctcacagaaacatacaatgtaggaaaggtgaagggtagaattacatttttaaaaggaagttccatattcagagtgctaaaaaaaatcaactcctaattttctctctttgggcataatatttgatgaaatattttccatatctcctatatgtgagtttattttattctttttcttcccaatcacttataaggccaatgagagcctaggatttgagatattttaagcacatctggagcgatctagctttgacacatttttattaggtgcatgaaaactaaatgtcttattgccaagtatcatttttacattttctcgtcaaatttttataaaagcttaagagcaaaatgcagtaggatcttaaaaaaattctacaaacatagctggataaattctgctgctgagccagaactgttggctggaaggcagcgccaccatgcgatcgttccaaaggctgtcagttttgtctaaagacacaagctgggatcctctaagagttgggcaactaatagcaaaagcccacttcctgtcataggaaggttattttcaaactccaaaccccagcaccacttctgtctctgagagggagagggagagaaggaggagctgtttacaaacaggatgtctgattacggagttacaccagtggccagattggatcagatatttaatgcttgattagggtggctagtgggcaggttaaggctggcagattctgagtactctccatttaaggacgcctgcaccgggatacaacttgccgacttcaatacccagctctgtggctggctagccctacgtctttaacaagggacaagttcggccaaggctcagttggtggattgtatattatgtctataggacccaattatacctaaagtttctaagctataaagtcttgtgactgtgtgcatggtgtagacatgggctaaactcaagaagaggggtgagaaagagtcatcttaatctttaatttaaagtttattagagttgtggtttccttttcatgtttttgcttcataaagtgtaccacgaatctaacagcaatattatattaaatgtacatgtttgcagtaaattacaccctcatttaagaaatgtggaaaagttggggggaaagaggaaatcttaaaactgagttaagtcagcagttcagcaagtgcttacgaaagacagtcaaaatataggcaagttactttaaatgggtattatttgtccttactttcccaatgtaggcaagtgcctgtgatataacaatttagggaataatgggagaataaaaagcatattagtttcaatcagatttcctggcatatatcacagaccctaaggaattacaaagacaaaaaagcaagctctttggtttctgcatggttctttgcagactacaaggctgcccctgcaagcacttggatgaaaagaccgggattctactggaagtttgcactttccccacatcagccaagatgggtaaactgccttaacacaaaagtcacatgccccacaaaatatttccttctatctcaaaacagtattagcttctttaatctaagaaggtaatgagaggtttttaaactgattaaatcagcttagttcatacaaagtctattatgattaaatattcaattaaaacaatttccaaaccaaaatctgacaaaatcctctctgaaagtaatttagatgataggtttttaacattaggcaaattaaatccttctcacagttggtattttctaaagggtcagaaacagttgcagaagttcactggggcaaaaatctactttgtgtgctagtcatgttccatgatcataaacagaaactagaaatattaacgtgagcctaacattcctatttatttttacttcaaaggctacatacatgcaaaagttgaacatgtcatcacaaatgctttaaataaagttcaaaaaataaaaatacttcaaaatccatttacttatggaaatatacatgacaattagagtgaagtcaattatatccttttttcaatcagaaaaatacttatattataaaaaagttttaattcatgtccagaataattttttaaaattcttgagtcataattttaaaacaagttgaatgttagtacaatgtttggagaaacaagtcctaggcttttgctaactggatctgatattcttatacttcattttgaaatcactaaggaaactcaagtttagggaaaaaaaaaaagcattttaagaaacctatgatggtaagtattatggctgaggtggttactaaccaagtgaagggcacaacttccataagcagataatgttcaaagtcctttaaaatgtttgaatggagaattttatctacaaacacatagtggaggcttaaagtagcctcaagtctctctgctggtcaacactgcaagaggaattaaaaatcccaggtacagtgaagttctgagtgcactgcccttttgaaaaatgtgtgagcaggcactagctcccgtgactccaaagccgactgggggaagtgtcttcagatggccctgccctttatcaggcaaaagcagccaaaggcttggcaaagtcaggagagggaaatcagcgtattctgagctagtctccatggtccagaggatgaccatttccttctaataaaaccaatatttctttggtagcataatacaatatatatcaacaatcccaataattcatatgagcagaatgcactcaaagttcaactttgtaaatgttcacatgcatcctggaaatgagatttaacttcctgcacctacatgaaaaagggtggggacagctgcccaggctggaggactactgatgatgagaaatgacacacaatgtgagcagggaaagggatcatttaacaaaatgtgttagcgttgactgggaaagaaagccctaagtgggtaaacacacccgaactttgcaaggagcttaattcaaacaattaaaatatcaccttctctttaaatcagaaacatcaggtttcctattggaagaaatcccttgctaccactctaagcctttggttgaaaaggccaaattaaaattcgggttagaaatgtttccacagagggtccaaagacttagagcttgatttatatcctgatactgaattgtgattatagttttcatgttatgcaatccaactattattttccttttatcactaaaaaaaaatgttttaaaaaggaaaattaaagatttgtgtgctgtcagtgcaaaatcacattaagtatggtttttcttttccctgggacagaaaaaaacaatgcccagctcacagtacataggaatgtgtcacaacaaataatcagaagacagatttctccaagctagtgttcctccttgtacagtgtggtattcaaaagcagtattgtcacgattatgcatattctcattaactaggtacagcagagctacttaaagggaaacccatttcttgtgcctcaatgaaaggggagtgtagaaaacaataattaggctgaataaggaattttaaacggcaaaaaaaaaaaaaaatcagagtgaaaagaacagagaatttagaaagccaaaaaaaaagttttttgtgtgtgttttttttaaaaagcaagtaatgtgacggtagaaacccacacaatctccccccaccccacctgccactttgagtcctaattgcccatctgcaaggacagaaacccactctaaattgaccagcatcggcttcggcaagtcttctcttcactctccctcctgttaagaccgtttccaaaaccaatcagcaaaggacaaagaattctttacagagtgcaattagtgttttccacgtccaccttcaaaagcatgatgctcttcatgggctaaaggacagaaaaaaaacaaaaaagaaaaaaaggaaagaaaactttaagcaaaggatgggccaaccctcctctaggcatctcattcagcttccccaaatgttggcaagaactcaaacaccttatttatttatttatttttttgccagtaactgttagctaaggcgtgcatttcctgagaaacgtaataatgaaaattaaaacaaggaataaacaagcaatgggcatgctgcctgtttcttcttgctgtgcctgggaggatgagtcatctcagcaagccgatgaagagagtatgttgggctgcaagcaaatgccgcaggggaaaatgtgccccacaaaatgcattgcagggggtggggagagggggtgcctgacacaacccaagacagagccgcttacaagcctatctttaaaaataaactaaaaataaaacaaaacaaagaaccacaccagggtgacagcaattatatctaggtgcccctgctccctacctctcaacactctccatgggaaatgaagtttcataaaattgctaagttttatttttccaaatcaagtttccccctgccaatagatattcagacctatcatctggcttgcaaaattactaattttaattaggaactctagaatatatatatatttttttgagacgtagttttgctctgtagcccaggctggagtgcagtggcgcaatcttggctcactgcaacctcctctgcctcccaggttcaagcaattctccagcctcagcctctggagtagctgggatacaggcgtgtgccaccacgtccagctaatttttgtatttttggtagagatgggggtctcaccatgttggacaggctggtctggaactcctgacctcaagtgaaccacctgcctcagcctcccaaagtagtgggattataggcgtgagccaccaggcccagccggaactcaggaatttaaaaaaattatgctaccaaaaatattttcaaacacttaacgttttttaaagtagaagatgccacagggagacctacgaaatacataacattttctctaaggcaaaagactgagtgtgacaatctacctcccggatctggttaaccattaccaggaagcaacgtctgataaaggtggggtgattcaggactctgggtgctttgatccccaacacgctacccacacttagcagtgaatggggttctagggaggcagatgggctggcccatttcaccttttaagccccttccagttctgttttatttttctttttgttttttaagactgggtcttgctgctctgtcacccaggttggagtgcagtagcatcatgctactcggctcactgcagccttgacttcccgggctcaagcaatcctctcacttcagtctcctgagtagctgggattacaggtatgtgccaccatgcccggctaacttttgtctttttgattgatagagacagggttttgccatgttgcccaggctggtctcgaactcctgagctcaagcgatccaccggcctcagactcccaaagtgctgggattacaggcatgaaccactgtacctggcctctgtgtttttcataaggactaaattcttcagactattgctgagggggtggatggaacgggcctattttcccttcaacatcatcttggacgttcaccccaacctactccgcacttggatgaaacactgggagagatgcactttatacctcccaggtcacctcaggttggccatactcctaagggcagcctgaaatctgaactaatttaatagaacatttctcacagctttaactttgcaaatatttcacattgagtgtgtgtgtgtgtgtgtgtgtgtgtgtgtgtgtgttttctttttaagaaagatatttagggaagatatcgaagaaaacacgctttgatctgcaaggaaattacactatgcttcagggtcaagtagaggtaccatagaactacagtgacctggtttccaaacaataaatccagatatacagactatccaaagatctgtgttacttctaggtgtgaggggcagtctggggtggtcatagttgcaaactacaatgttgatgggttaaagagacagtacaacagaacattcagaattgggagtgcctagtgaacaggtgtactgtcagccttaggttaccttgggtagaaagggattatagaattgctctaagcctggagttggcaaacattttcaggaaaaggaagagaataaatgtttgtctttatgaccatatggtctctgtcccaattattattatttgttgttgttgtttttgagacagagtttttctcttgtcgcccaggctagagtgcaatggtgtgatcctggctcactgcaaccttcacctcctgggttcaaacaattctcctgcctcagtctcccaagtagctgggattataggcacctgccaccacgcctggctagctttttatatttttagtagagatggggtttcgccatgttggccaggctggtctttaactcctgacctcagatgatctgcctgcctcggcctcccaaagtgctgggattacaggcgtgagccaccatgcctgacctctgtatcaattactaactctgccattgtagcactaaagcagctataggtaatacggaaacaaatgggtattgctctatgctgataaaactttatttatggacactaaaatttgatattcatataattttcatgtgttacaaaatatactttttcttttttttccaaccactgaaaaatgtaaaaagcattctcagctatacctatacagaaacaggagagcggagagggtaacacagagggcagatttgggctccagcttcctgctgtaaacaattctcacaccagaaaagacctttgtcactcagctgttctgaagaacttagcagaattggccagggtggggctggtcagtgagtggagtctgtgcattgtgagtttctcagtcaaataatgtgtatccatatcaaatgtaagttatcaatggcccaatgcccatctacccgctagaggccatgactgaatatgcttgggttctttctacatggaaaatctacagtcacctggcttatgtaaacttgggaatacttacactaggatcctattaaccaaaccagagtaaaagcatacattggccatttctaacttagcttaccctgctgtgaaaaagatttcagcccaaatcttatttttccaaattacttctgcagcaagtagtgtataccctgctgagtaaaggactgcctgctttgtttacaataaagaaaactgcttgttttttttcaaattcagatttttatttgaacaatctttgagtttttaaatgccaatttatgcccttaaagtatgaatttctgctgagacccttcctcagttctgtattacatactttgcaatggcccctacctttaggtatctatttgatttaactggccaagttgcagttttctttccccttgtttggcttttttctttcccagagccatcacaacagctaagcagtgaatcatcctgccctttgacaatcttatctgattattgccatggccctaaaaactagcctaaccactttgtggccttattatctgataaaacagatatcttattatctgtgttgagcctgctgctaaccaatgtgctacctggaaacttaatcatagaattttgcagtagaaggaaccttggagatcatctaagaccaacctcctcgatactcagatgagaaaggtaaaggatgagaagttgtgacttgctcaaggtcacactggtgaagtgggacaaaaacctaaagtgcctgacttaacgaccccaaattggtgttctcctctttagagtcaagtgtggagctggttcaaaggtgggaaaaaatgttttagccccatacataaatgccaatgaaatacacttccgtctatagagtttctgctagtcttgtgaaataaaaaaaaagaaaaaacccttgatgacctttcaattaatatctggggtgaaaatacaattaaagtatccctaaagaataaaaatggcatcggcaaattggcaacttctacaccacgcagccaataagcaacttctgcagtgccatttttctgtctcttttaaacttccatttaaaattcagaatatctgtagtgccagatcagtcccactgcttaacatctaggtcatttggcctgtaattatatgattccttacagggaggccttagtgttaatatcccctgtcatactaggatactcacaaaacaaaatttgatttttttatccttttttggcaaagagttggaaaaagtgaagcaataatgaaatgtatttcagcaattctaagacgcactcctcacaactaccacacatatatttgaagacctctggtaccaataatgtgttacagtttaattgggagccttttatttttctttttcagtaatactaaaataatggagcattttatcttcaagagcatcttagattcaatgaaatacggtagttaaaaaatgggttactgactccaggaacagttttggatataggaaatttatcatacatgtgtagggctgtcgtccttttctctaactctgttaaatgtgtgacctgcagtctgatctaccaaacattggtttaatagcactaagatgttttcattatgaaaaagaagactttttcaaaagagcacacaaaagcaatgaaaatgaatcatgatggaaaacaatgggtccacacacctattcatactgttaacatttcaccactaggcgtgaattctccctcagttctgtgtcatagtcattcataatgaggaagtattagcatttcagtagaacattcaatcacgcctgtgctcagaatgcatttcttctgcaaatacagatgttatacattataaattcctgtttatgaagggatgattgaatatctacctgccagttcatataatgacatttttgttattgttgtttccaatagaatgtaattttttttctgagaattacaaatttgagttcaggtacaaatttttgaaataacaaatacaatatttgttatttcgttttctgatccacgcagttaggcaagaataaaatcttactttaatttctgagactaagcttgttttttttaaaaaaaaaaaaaacttaaatgtattttgttgaattattttctgaattatcaaatttcaagtaaatctgccttcaccacatttgcaaaacagtttctatctttaaaagtatgatagagtaagctagaaagtaataactggaaatgaagcacttacgtttataaaatactgctttaaaagttatgtggggcagaagttcatagatcttttctaaaacagtcgcttcacccactaaagaggcatttacattccagacttggacgacgtcttctcggtcccgaacactgacactaactcctattacttcatcatctgaggggaagacaggaaaaaaaaaaaatgagtgatacttccaagtcagtctgactgtttctaagaacttagtctttttatctgaaaattaaggataagatggaaaaaagaaggtggcacaagataacttgtaagaaataattgtttctatggggaatcactggaggaaagcaagtcagtgcacaaaagctgtagcagtcacatcacatttatccagggacttagataaagtgttccagccaaatgcattttccagataagtaatttaccctttttaacattaccaaagctttgtgactatttcttactctgttttgatgagactttttctaaaatgggttgcataattccctgccctctgaaagccaagtgaactgaaatgaacttttccttgatgccttgctgtctttgttaaggagagcaagaatttctcctgacttcctgccaagctttcagggaccttggagtggtcagcgctatctgccccaacacgaactggagccagattgtgcattctcgactgctcatctgctttctgcggtttacttgtctgctcctttcctatgaattcttcctgcttcctgatgcctccctctagaaatcccttttctggttttgggcattatatactgtgggctagagagccaatgaccatctgttagcactgtgtatagagtgagagtaaaatcttctgagtacagctctgctattataggatcgtccttcaatgaatgaacgttaaggcatttatccacattgattaaggtggactttttttaaaaaacaaaattccagattagggctgtcttgcacatagttgagaacggcggatggatagtaaggtgttatactgttttatcctcccttgcagccactttgtttacataaatttgcagcaaaatgaaaggaatacaaacttttgattctttgtttccttgttcatgacacggtaatgcaatacggtcagctctctgcactttcataaacagtatcaatatgtaatacgtgagagataagcattatcaatatgagaaaattttgctttagttagtatgctctgcctaatttgctggcctctgtaaatctaaatattcatgccatcagtttttccaattgtcttctggaagttaaaacattttagtattaggatataatttaaataaaaacatatccaatttactaaaagaaataatcggcagtaaagtaattcctttcttttctccattcttcccttctctttctccccctcttccttcttttcttttttaaaatgaatttgatcctggctaaatgtgtatgacttgacactaaaaatgagtccacttacgtaaatactcaaaaccagggaaaattagcctataatgttagaagttagactggaggttacctttgaaggaaggaaagagagcaggggggatcctggcgggctggtaatgtcctgcttgtacatctggatgctagttacagttgtatgcttactttgtgaatatttatcaaactgtacacatacgacgtgtgcaatcttctgtatatatgccacatttaaacaaaagagtcaaaaaacatagtaccttgtcatggccattcacagaaacttattatcccatcaagaaaatatttttagatacagattctttactttctaatttacactttaaaaataatcttgccagagatcaatgttatattttatgtgaaaataaaaatcatcaaataaaaagagaagctttgcagtttaccactttcaagagtggccatgaagtcacatcacccttttggggaaatgttcatgtctccagtcttttggtgttgcccatttctaccctattggtcaaagcgtaatgtaactgatggatgccgaactgtcaatatttcagtttggtttggctcttggtaaccaggcacagttactagcacagcactttcacaaatggctcggtaaaaaaaggctgcaactcttatccaaaggcagatccattagcaaacatgtaatattcataagtagaatcaaccagcaaaaccttgattattttagggtactggcagcataagacattagagctgggaggagccactgcttaaagatgaggggagtgaggcccagagagattagctgacttgcttaaagtgtcatagctagttaatggaagagctaatggttaatagttaatggtgcgctcatgtcccaagtcaaccacaaaacaattggtcttctttactcaatactggctatttattaccacttagactatttttccctggttctggaaacaggaataattcatgcagaaaacttcctctcccagggatttatgtgtttataattatacacaggatacatttttggctgtatattatcaagttgctaaatactccctattaaaacagaaggaatctgtacttatagacaaatttatcttaacccaggtcttctttttttttttttttgaaacagggtctcactctgtcacccaggctgcagtacaatagcgatcatagctcattgcagcctctatctcctgggctcaagtgatcctcccactgcagcctccaaagttgctggggctatgggtgtatgtcactatgcccagctaatttttgcattttttgtagagacaagggtctctctatgttacgtagggtggttttgaactcctggcctcaagtgatcctcccatcttggcctcccaaagtgctgggattacagtcatgggccaccacgcccagcgcaggttttatcttaactgaataaaaagtggtgtaagaagtaagcaaaacagaagtggaatgattggaactgctcacgagatgaatctgaaatgtgccctgggactggcaaggcctacagggctctcaaacacggccccatctaagacatctgagggacaactgatcattgtcattagctaaaaagaaaaacttaactgaaagctggggaagaaaaatagtattctaaatgttacttcaggagcattcagaaggaactaccccaaaagaaaacaaaactttaaacaagcaattaaattctgctctttgaatgggttcatgataaacacaaagcaaaacaaaagctttttgttttgctctcagaaataccctgggtatttgaaaatggtctccaaagaaaagccctgaagaacttctgtcttatcctccactgtgagatcacaggatataatggtgagcatgtccccaccgaccactctagtcctctttgagcaggggacagagagaacaagacgaaggggttaggggttgagagggacagagaggattgtgcctgtccacctaaaaacttcactagacactgaagacactttccccttctggaagaactggaacagataatggaacctactaccaattgtgttaagggcccagttaatgtgagatttttcttttctgcctatttattttggacagatggttatagatactattaaattaagctaagagggaaaaatatacatgaatatatacatacatatataaatatgcacatatgtaaatatgcatatggacacagacacacatatctaacactgaacacgaaaatcacatgaaaaaaaattgagtaactttgtagttccaaaataaacaacttcaaaacatgtaaaaagtcaaacacgtgataacaagctgctgcaagaaacaagcacaagccaggagcacacgaggcagggccggccggagccgtgggctgctttacctgctgcggcacagtctgtgaactgttccccgatggttgctaacagcaactctttccaaactgtggactgatatgggaaaagaataaaaaacaaaacaaacaaaatacagatatttttagacaattatcctcaggagctaaacaaattatgttttcttcaacttcacatgcactttctgtgcccatacttggagtccacagacacctccaaatcctaggtgcaaacacttatcaccgtggcatatttttcattggtttacaaataactttacacagatacaagtgagccaaagtctggtaaaagctaatctctagtgaaacccctggtgaaattcagaagaatttctagggaaaatgcattcaaatgacttaaaactttcaaatttctttacctctcactgattcaaaacatagaagctgattatatgtggatgctattagtaaaatctttctcttcaaaatcctttctctgtttttcttactacttataaggtacttaaaaggttacacaagtaaagaacacttaaggacatttcttgtttatttaatactagagtcttgggaaattccattcatttgaggcagactgtttatggcaggcgatagaactttatgtaagaatgtatgtaatttccctggaagattcagtgcacgctccggtctgcctcctaccaatgagaaatactggagtttctttctcctcatgatctaatagtggcatccaatagacagctacattatttccacacacattacttcctttgaaaagttcttggtcccatttatcctccttcctgtgattcacaggctccaaattgcccccaaactaggtttgaatccttagaggctgcttgctatctgcaaaccagatgggttaacaacctctctggtcatcagtttctttaggtgaacaaggaaataataataggtccgaccttccagggctgttgtgggtatgaaattagtcaacaagtgtgcacaaagggcttagtacaatgactgcaataaaagggcttaacatttaagatccatgccataaacagctgtgtgtttgctacattccaagtgctcaatacatattaactataataatagtgtgtattattatgtcctcacaagcttaaagcagtctcgctgaatctttaaccaaggccatggcagttagccagggaactgaaaagtgacctttcattcttttcttttctctttcctagcctgtcccttctggtctatgagtctcccacctaggaatcattgcttccgttttctatctgtccagctacactccttcaagctgttactgatgaagttgagagctgcgagaggctgttaggggaagggagacttcacccttctgctttgaattcagacaggattggcccacaagactcccactggttgatgatgaaaagtaggctaaactgcctgggatgagggcatttgcacggatatgaaagcgttattatttgtgacccaacgcagccaagtgagctaacaaggagaggacaaaactgcctttcagccgcttttcaaggaatgttgacatcatgattacttctactagagttcaaagtctagtaaataaagtgagtaaataaagaacatggaaaggcaaaaagtgttcatagtgaaattttaagaacaccttatattccctcattctcttatattctctgctgccctgatatttttcattatgtatgccaaataacagtaaaatgttggagcttcaaatcttgactaatagtttgcacctttgacaaataaatctggtcgtgtctttaggtatgttcttatagtaaaatgactccagctcaagcatatgggtccctggagacatttcagttctttgagcttatccacatgaaagaaaccatgaaaaggtaaaactgcctagcacttcccctttgtccattttcaaagaagctttttagtttcccagggcttaagataaccgattttaatgttcacgttcatttccagtcaataagatgaattagagctcactctgggaaatctgggtttctgagacttgatcactgcaaaccagcatcccaccaggtcatcacaccatccaggttctcatcggccccagagggagatggagcatagtctctcatgaaaccccaaaggatagtgaaatgccaagcctccctattctctgtgacatggtcattctcagaactgcttttgttccccctgtagaggagggaagagcctttggaaggaaagatcctgcttccgactttgtaaaaccatatgcaacatgttggtcatggctgtcaagggaatgaccaccataaagacattcacccagcttttctgtgaagttcacaggcatttactcctgcagactgcatgatacagtcacatactacaccacgtctatagagaagcacaattatacactttcaaggtgacagtgaaaggcagaaaatcatcaaggtcagaacagaatttctcacccccagcctgtttggggactgccaggtaaataggctatctgcaaagcacaaaatgctgatgacaggcagtcaacaactccaagcctcgccggttctagaagaggatcagtaggaacctaccgtgctgtccttggggactttcatcttccatacgccaccctttgcattactctcctcttccctgggccaaagaccaacgtttaaagttacactcaggactaagtgattctacatacagttagattaaatatctcttcatacatttagtttaacaacagatgaccttaaaaacaaaatagttgggcatttttcttatttttgttttttattttttattatggacacataatagttgcacatatttatggggtatatctgaattttttttttttttttgagacaggctcgctctgtcacccaggctggagtgcagtggcgccatctcggctcactgcaagctctgcctcccgggttcacgccattctcctgcctcagcctcccaagtagctgggactacaggcgtccgccaccaagtccagctaaattttttttgtatttttagtagagacgggatttcactgtgttagccaggatggtctcgatctccccacctcgtgatccaccggtctcggcctcccaaagcgctgggattacagacgtaagccaccgcacccggcccctgaatttttttttaaagactaggtctcactctgtcacccaggctggagtgcagtggcatgatcgtagctcactgtagccttgaactcctgggctcaagcaatcctccgccctcagcctcccaagtagctgggattacaggcatgtgccatcacacctggctaatttttaaaattttttttagagacagggtctctctcactttgctgctcaggctcgtcttgaactcctggcctcaagcaatcctcccaccttggcctcccaaagtgctgggattacaggcatgagccaccatatctggcctacatgtgatattttgatacatgcatacaaggcgtaatgactgaatcagggtatttaggctatctatccatcacctcgagtctttatcatttccttgtgttaggaacattccaattctactcttttagttatttcaaaatacataataaattattgttaactatagttaccctattgtgctccaagacctcattcattctaactgtatttttgtacccattaaccatcccctgtttatcacccccacaacttcccagctctggtaaccgtcattctactctctttctccatcagttcagggttttttttttttaagctcctacatatgaatgacagcatgaggtatctgtctttccatgtctggtttatctcacttaatataatgttctccaattccatccatgttgttgcaaatggcagaatttcatttttttgatggctgaatactattccatggtgtacatgtaccatattttctttagtcattcatctgttgatggacacttaggttgattccatatcttggctcttgtgaatggtactacaataaacatggaagtgtagacatctcttcgacatactgatttcctttctttggggtatatatctggcagtgggactgctgaatcactaacagtcctatgtttagtcttttgaggaacctccatactgttctccatagttggctgtgctaatctacatttccaccaacagtgtacgagggctcccctttctccacaccctcaccagcattcattattacctgtcttttggataaaagccattttaacgggggtaagattgggcatttttcaataaacacttccccagtccttttgttggatacagaagcagattaatgaaaaaggaaggagctagcgattgagagggaagaaagtggcgttcagtggctacatgggcagggagggtgaaaggacttgagatcctcatcctcaaagcactagtgcagagaggctcgcttgactctggggatggacaacaaatacagctgccacaagggaaggcccttacacttcaatgtcatggtcatgacacgatctcatgtgattctcctatcaaccatgtatcaaggcctcataggtgtccctgtgggggacatctgctgtgtgtcactgcttaacatctgctccctttctggtaagagcatcccagtttccctctaaagagccacttgccccctactcttctgtgagatccactcaggcagggttgactccacgtcctagcttcaaagatgggcttctgacccaggctagcctatgagagcactgcctcttcctagtctttgtgattggccagaaattgaaaggggactcaaagtgggagaatgagacccagacctgggattttatctgggctcgtgagtactgacaatggtaaacttacagggtgtaagaccagagcataggaaggccactttgccacctcagatgggagaaaattaaaccaatgtagaatgaagcagagtaattctggtggggaccatcagattcctgataacatgagctggatctgccagaaactacccctaccagtgaacttcccagtcacaggttaaaaacatactcaatttttttgctcaaattacatttctggtggctgggcctggtggctcatgcctgtaatcccagcactttagaaggctgaggtgggcacattgctggagcccaggagttcaagaccagcctgggcaacaaggtgaaatcccatctctaccaaaaataaaaaataaaaaattagttgggggtggtggcacacacctgtagtctcagctacttgggaggctgaggtgggaggttcacctgagcctgggaggtcaaggctgtggtgagccgtgatggtgccactgcactccagccttggtgacagagtgagacctggtctcaaaaaaaagaaaccaaccaaacaacaacaacaacaaaaaaaaccccacaaaaacaaattaggtttctgtcatttgctactaatcaagatgaggtacatttccattttattaatgagtaaataatgcagaaagactgaatgacatgacataaggatttattactaactgggactccagcctgggcaaactaacttactgtccatcttcatcactacatcaagctattaaagaaggaggacacttacccccagaccctgggccatgattggtatcacagactttctatgttgtccatgtgagacacacatctcaggtgatatgatcttttatgaggttcacaaacattttcctcccaccttgaccttaaattacacgttagacacttaccaaagtggtcgcctctctcctctcattaaatgataactacatctcaaaggcaggctagtcacaggagggatattattgtatacactccaaaatatctttaaaagaaaaacaaacactttgtttaatatacccagtattgatttattatgctgctagattatcaaattaatgcattaaagaaaaattttgattctcattgttttatccattcaaaatagatttttctcagtatcccttctaattctctgttagaaaatgtaatataacattaaagaatgctgggcttggtggctcatgcctgtaaatcccagcactttgggaggccaaggcaagcggatcacttgagcccaggagttcgagaccaacctgggcaatgtggcaagatcccatctctacaaaaaatacaaaaaattagctgggcatggtgacacatgcctgtagtcccaactacctaggaggttgaggtgggagaatagcttgagcctgggaagtcgaggctgcaagtgagccaagatcgcaccactgtattccaacttgggcaacaggagtgagcccctgcctcaaaaaaacaaaaacaaaaacacaacaacaagaagaaaagatgttccttgctgatgctgtgccaagctctatgtttcaggaagctatggttattaagcaaacattcctatgcaacatgtctacacataaaactggaaaggactttgctaatgatttttctggcagctaggtagtatccactaaagcctttagtactgaatatatgtactgaacatatttataactattttgttacaatagaccctgtcttcaacatggtgaaaccccatctctactaaaaatacaaaaaattagccaggcgtggtgccagacgcctataatcccagctactcgggaggctgaggcaggagaatcacttgaacctgggaggcggaggttgcagtgagccgagatcacaccattgcactccagcctgggcaacagggcgagactccgtttaaaaaaaaaaaaaaaaaaaaatcaaccctgtcttctctacaagcctggaagaagtctgtgatgctatggcttgggggttgtgggataaaggagatggcaaagagaaactaccttagacactctgtttgccccttatctctcccctgctaaaggaagagggaacagctcaggtgctgaaacaacaagctgcgcaagatacacagtgttacggactgcacatctgtgtcttccccagattcatatgctgaaaccctaactaccaataggatggtgttagcaggtggggcccctgggaggtaatcaggtcatgagggtatagtcaccatgacaggcttggtgtccttatgagaagatgaagagagccagccctccctctggcatgtgaagatacaaggagaggatggccatgtacaaacgaggaagagggccctcacctggatgtgcccatgctcgcaccctcatctcagacttccaggctccagaactgtgagaaacaagggtttgttgcataaactgcccagtctatggtatttggttatagtagcctgaactaagacacagggcaactggtaaacagaaatagattatacaaaaataataaagtaatagtaaaacaggaagtcttggcaaagacaagtgatctggagctgttctctgagccaggctttgttctatgaacatttacatgtttatgcaatttatcctaatgacactcttaggaggaggtatgattattatcctttttttaaagataaggacaccaggcagagacgaacctgcccaagagtcagtttggtatgaccattaggattaggatgaggattgaggctatgaagaagaaaacacttccccatttgtttggagtaggtcatagaattactacgctatgaatgctatccacagaattactgtgcaaataagaaatattgttctgtgtggtgaggtaagcatagggtgatcatctgggtctcccagtaggtctgaggaaagcagcacgagtaaaatagcaattagaaaaatcaatcctagggctcatgaactgagtcacatgggtggaatagaattttagctatgttgaatgataatcctgctgggttgttcaagcctgttttgtgttaaaaaaataataaagctgaattaactgcaaaggtggcaatgatgaactataagatcaaattgaaggcaaaaaactacaggatgacagatgtattaattgagaatccactttggctcccttctactaaaatggtgctagtgtagtgaggagttaaaagctactgtattaacagtagctcctcaaacacccatctgcctctatggaggtacctatcctgtaaatgctttgctatttgtacaaataagattattccaatatttcagtttctgtggtgtgagggtgggtaggcagggctggaatctgaatccaggcaatttgattcccaaacctctgttcctaaccactcagctattttcttcgaagatactactatatgtttttgacacatctttctccaatcttagcagccaagaatcaggtcatgaagccacagaaagagggacacatgttgaagatattttcccaccagtaaaatgcccataattcacaagaggctggtggttgtcaactccagcctgagaacctggttacgatgtggcaatgacctctgtagaatttatgcacaaaataacattaagaggaaaacccctgcctaaggtaaaactaagaggactttggtgctggcaaacttcaagtctcctcaaaggcatcacaaaccaaagttcctgccgtcataccccggtcaaagttgtcaaatcttgactttttaacctagtacttgaagcacactgaaaaaatacaacaaaacacttcttccatttcaaagatcagaaaaacactaaagatcatgctaaggattggagctttagaagcttctcttgaaaacaaaaacagacaactgattctgcttggcttggcaaatttgacaggaagagattacagcccaagaagatcagtgatagacttaacatattcattaaagcacatatttgtacgtttttgctgagcataaaataggagcaaaatatccggtcacaccattaaaaaaaaaaaaaaaagccctatttgaaaagcatgtgtcattaaactggtctgtttccctgttgcaaacctcatccaataggtagaatatttgtgaagtatgtctgctggtgaaatacctacaggaaggaatctagcattactcagctcctgaaaacctcttccgcccttgcagaagtgaaaggtctgctacagcggaagcctggtaattcaagattatactctctgtaacacatcttgaaaatggaaacacttaaattttactatatataaaatcttgcaaatagatttcagaagcctttaggcttataattaattctgttagacttgcaaatccaagattgcagtaaaagtaaaactaagcacaatgtttattaatgatggttaaatgcttttttttcccaaaagccttgataatcaccctaagactaggagaggtataaaagttgaacatcattcattcagtcaacatctgtgaccatcagttgtgaacagagcactgtgacgggtccttggggaacttagctgaatgcaggagggtcagcttttgaccacagcaatccactccttgggaggtatgttctggaacaccaatctggcacctctcctggagaaactgaggcagggaagacacctgtccagtggagtctaatacctggatttaagacctaggttctcagcataaccttcacaggtcatgtagcccgtgaaacccacgttgcctcctctgtataaggatacagctatttcactggaaaatgtaatgatgaaatgcaaagtgaaagcacttgctaggcctaaggaaggaaacaaagtatggttagacccattaatatgctgaccacttgataaatccccaatctgatagcactgattggagcaactatgccccaccttacagccttctgccaaatagataatcattcattaccaagaaaactggcaaatttcctcctcaatttcctactgaaatgttctgaagaaaaagaatgcacttggaaattcttcagaagaaaagatgtcatgtgttgacagacaacaaagtgatatgtctgttttgtaaaacaaaccagaaacaaaaccacccagcaaacacacatcaaaaaaaaaaaaaaaaaaaaaaaattccaggatttattccaaggttgtggcatgtgtagcaagagagtatttccaaaaaaacaaaacaaatatttttgctcattaggtattactagttgcctggggcttcccaccaactgaataagtggtatttatgggcagggccaataggcatctgaaccgaataggcaactgaagagtttaatggatgtttttaactcacagcagacacaaaggctgaaagcaaagtgcttctgatttacaagagctaggtacttgagagagaaatgggttttcctttgaattccaaaaagggcttggcttaaagagagagcccaagtgtggagttgtgatcatagagtaaacgagatgtgacaggatgtgagggtaatttcccaccacatagaaagttagtaaaaaccaactctgagttggggagttaaaagcttggagagagaggacagtggggttaaaaccctgaaaggatgggagagagccccacccaaagattggggatgcctagaccagaggagtgtggaacctgcttcctggtacagcccaagaggctccaagactcccagaaaaggccctcattcctacagcgctgagcaacatggcggtcaggtctgagaacagctgtgaaggcaggaggggttattctggccgggagggcctgccacaaccttatagagttcccctcattctggtggggtcgggggaaggcagccaacatttcctaaatctccaatctggagcttgaaattgctagaaagcctaaggacaacagggcctggggtctggatgtgtgtgtacatagcaggggtcttcataacatgaggttacagcagggccaaaggtggtgggcatggcccaaggtcaggaggggtcaggggtatttctgcatatgcctgttcatatggagaaggagaagagggtggtcatttttcccaaaagagatttaaattagaagagacccagtttcacagttgaagtgactaaattacttttaattaacaaggtcaagtctcaccccacccaatacacagacacaacagcctccactgagaatgtggaggaatacaagcaatttaacttcagttatatttcttcataactggattgtagctatagatgttgatcctattatgcatataatgaataaactaaatgatggataaagaatcttgttatactggatgcaaagtctgtgctagacagaactatgaagtggacctggctgcaggtccttctctttctcttttcagtgttggctttcctcctctctcccctcaggcccctcccttcagccaagtggttcactccaggtcattctattgcaggacaccacacaccatgggctgtcttgctgtgtccagggcagcaagtacttggaatcaatctttccaccatcctccatgatcaatactgacctagaaaacctcttcttctgaaggaagagccctcatttcccaagggtttggaaagcaatctgctgccctaacttaactgcacaactccagtcaggcggcttgacctgcggatatgaagtcttgatattatcgacagcacacaggataggtttggcatatgcaggggaaacattttcttaatttcaataggttatatatactctttaggaagactttctgcttatgataaacgatgctgaatttccacttatagaggaaatatggtttctgttttatgcaaatttaaataagaagtcaagttataagaaatactgggtagaatgtaccacaagtgagataggtgtggcaaaatctttaaggcgatacaccaaataactgatgttcgagacagagtgctgtacaggaatgagttttcaggggtggaatttttagtcttgtagcagataaggctgaaagaaactggagaagggagacttctcttgcaaatcacaaatggcaggtagctcttcattctccaacaggtaaaacagggcttgttcaaaagccgtgttctatttttttttctcccagagatgtgggtcttgccatgtttcccaggctgaactcgaactcttgggctcacgcaatcctcccacctcagcttcctgagtagctgagatcacaggcatgagccaatgcacccggctaaaagccattttctattctgcactgcaaccactgaggatgcaaaatcacaagagaaatgtggaaaatttggacaggttcacaaaggagtaagagaatcaataagcatctggaaaatacgcctagatgtaaaatggaattttccaagaaagttaggaaagtagaaatgaatttaactccaggcagagagaattattgttaggtgtgatgaaagtgtcctcagcaggggttcccaggtcctttggaggctgagtctcctccactcctcaatcacggggagtaaaagaaagagaattggactgggagggaattctagtcctagaggcaaggcatgactggctctttccaatcatggaatgtttgggcctcttacctccagcctcagtctcctcaactaatagacggggtaacgattcctctcccaaaccatctactttgatttgctaaagggcctcaaagtataaaaagactcatatgtctttaataagacaatcattaatatcacatgatttttacctttcatctaaacacatatgggaggaaaacacagacataattggagaagcagttttttttagtgctaatggagtgagagtaaaaggatcaacgtacaggccaaagtggttcatgcctgtaatctgagcactttgggaggtcaaggagggaacacagcttgaggtcagaaattcgagactagcctgagcaacatagcaagaccccatctctacaaaaaaaataaaataatttagctgggtgtggtagcacatggctatagtcccagatacttgggaggaggctggggtgggaggatctcttgagaccaggagtttgaggctgcagtgagctataatagcaccactgcactcctgcctgggtgacaaagtgagaccctgtttctgaagaaaaaaaaattaatatacaatcctagaataaaataaaaagacagtgggacaaaagcatatcctcaaattacttacaagatagtatcctggccagttcttaaatactaaggacaatttatcagctgttatggacactcgcaggctgaaaactcaaaagttattgataagttaaatatctttacatacacctctgtgttagtggtggtgcgatccagagtataatcacttgaaataaataatctagaagcagtggtatatagtttcctgatataaaacatgactgaagaaagcacgaaaagatatctcagtagaagtagacaaattatggcagatgattgggtacttactatggctttttacctcattgtatcatttaagtctcataacagcatgataaaattaccatcacaattatttccatcttacagatgagtaaactgagattcagacaggttatataacttgtccaagctagtaagtgtcacatatgggacatcaaccaaggcattgtgacaaccctagcccacaccctagccaggtaactgatggagctgaggggtagaatccagtaacacttaagtaaaagctggccacatctgagggctaagtgccaagcattactaagaactatataccatctcatctaactttcactctaccttagcgagtaggcactattactacctcagttttacagatgagaaactgagggagcagagacagctgagacagaaaggaatttcctgatccttagggcagtgtttatcagccatttttttcactgttccccccttaggccctaaaagaaccctttttcctaatcacctatgacgaaattttaataccacagagacaccgtatgtttatggactgcatggacatctatgctttgtacgtaaaaagaatgagatttgttcactgatctacttcccctgcaagaatcaactttggcccccactgagaatgtgcagcccacagaattcttacgggagcagtctgttgtgactcaggaaagtggttcatttattaacttctaattcattctttttttttttttttttgagagtgtgtgtgtgagagagacagagtctcactctgtcacccaggctggagggcagtgcaatctcagctcactgcaacctccacttcccgggttaaagcaattctcctgcctcagcctccccagtaagtgcccaccaccactccaggctaatttttgtatttttagtagagacagagtttcaccttgttgctcaggctcatcttgaactcctgacctcaagtgatccgcccaccttggcctcccaaagtgcggggattacaggcaagagtcaccatgctcggcctcattcattcattcaatccttcaatattcattgagtgcaaaggaccagacacaataatatagtactgtattattccatcaatataaaattcagtaacagaatgaatgtaatgtggtagaaatgagaatagtggttgctttgggggatggaggctggcaggggcacgaagacactttctggtgtaagggaaacttttttcttcttgatctgcgtgatggttgtatgtgcgtacccttgtcaaaagttatacttaagaaatctacatttactgtatacaaattatatcccaataaagtagttttaaaggaagtatttcctagtatgtgcctgcctgggtgctttaaattgctccctgaagaccctaaaatgctgtggattcaggggctctaccaaataccctgggttatctcgtggggtcaggaaaaccaagccaatcccctcatctgactagtgtcagccccagaaccccttgcataaccctgatgatctaatgtcatgtgggttgggaaaagtctaatgagactctgagagcctttacatgaggacaggccttcaaatcaagtgctctgaggattaaaaaatggccgctgggaaatggtaacagaagtccctaaatccacagaagagacgtgcagggaggcctcccagactcttagcgcgttgatttctctggacagtggtgctgccttgaggtgctgtctgtacttggcactgcacagcagcactgctgctctgcttcccacaagcttatgtcatttccccaacgacaccagaaatggcccacagtcaggactgtgtcttcacacccagctcactgcccttggtagccacacgcagcaccttacaatcagattcctgggacttcataattatgcatgccacattttttgaaccagatactgggaccatagcctaaaaaaaaaatggatctctgtgctacttctgcatgtaagaggctgcctaagagacacaatctagatgcagatctattggaatttctaagacattaaaagatttagggatacaacaggaaagctatttaaaatctctcccttctagaaaatttatggacatatggtcaatgcaactctgaagcagccacaatagccttattctctacctgcaccagcccgctaaactagaagacaggagaaactgggtagaacctgctattgaagaaaatagaaatgggatcaattaaatcaatcaggttttttcttttttgagacaaggtcttgctctgttgcccaggctggagtgcagtagtgtgaacacagctcactgcagtgttgaaatcctgggctcaagtgatcattgtacctcagcctcccaagtagctgggaccacagatgtgtgccaccatgcccagttaatttttaaggaaactgtttgtagagatgggggtctatgttgcccaggctgctctggaactcctaggctcaagcaatcctcccaccttagcctcccaaactcctgggatttcaggtgtgagccactacgcctggccagttgtgttttttcagttgtgtttttccaactccaccatcagagttagatagagaaagaactaatagaactaagagcctgcattcattgagaatctgctatgtattaggtattccactaagcatggcataaacataatcttattcaatcttcacagtaacccatggaggtaggtgctaccattagaccagttttacagagatgaaaggggttgatccatgcctaatttaggatgatggaattgcgaagtgaagtaggaaaccaagcagagactctccaccttcacgctccacactatcctgctctccccatgtgacctctaaacctttagtaaccctgcagggaaggcgccactgcctctcactgatggggaacagaggcacagagaggcactggcagagctggagtttgaacaggaacacagataaagatcttgaaaaaccttcgctcttaaccacactgcagtctgccttttgtgcgggtctatgaaaggtttaggtagtagataaaggttcagcaggtggccaagagaagagcaggccacctgactgtgtgctcagctggccctggagcagacttggtcaagggcagctgtgccaacctggacccgagagccaactccagagcagaaccctggacaggggctgccagcacagcaacagatttcaagttgggtgattaggtgtctgacgtgtgccgtgttaatccagttagtccctctcttgatcttacctgtactgtctgtactgtgtagattttcttcagatttgatgcgcactcagctgctgtggcaccagggagggatctaggcaagcaggagcaggacaaagacacaaacaaaacaagcagtcagtgctcacaaaacagcccacagtagaatctttcacgtcttcctaaaaatcaggtctcaaaccacaggactggacattttggggatgctagttggaatttaaaatgtgaaatccctactttgtgaagtcatgtgttggcttcttctaaaaatcagcagatttattcttggaaacttaacagaaaaaaaaagataagtatgtattaataagaaagggaatggacacctgaaaatcacattttaaaacataccaaaataacctactgataaccaagcattttctccaggactttagatgagaaactgcctattgtacagacgacaacgaaaatgcagtgtcctggcctggtgatatgtttgcaaacttgttagtaactgggtggcaaatattcaagcactcttgagaaacagagtgaccatttgcctactttaaaaaaagtcaactctggtttcatatgaatttgctgttaccaaaacacttgcttttagaaaatactttcagttcttttctctggctgatttaattagctcagctgaactttatggtcagactgcattaatctttagtttgctatgtgttccactagatggcaacatactacaggtttagtcaccagaaacactgcaatttaactggttttaccaaggaccattgcctgggatggtaaaatgacctgtcccatcaaaccttaggagttcaagactctcaattcctgccaccttttctttctctctatattgaattagcagttcatgctcaaaaatgttggggtacaattatatcagcctaagattatgtttcatcacacaaataatgcatgaaagcccacatctggttgttggtgagaaataagaagcttgctgagaggagaaagcacctcaatcacagctgacccactaggatctggaatctataaaagcaatgctctttaccagaaactgatcccagagacgttgcccccaaggactctcagtatgttgtacttcctggacagttgctaaaacactgcacactagagacaaaactcacatgagctcagaggtggaggcaatgccaaaggcccatgcccaggttggggtaagcacagcaaggactacagtccttgaactatgaaccagtgaatgctccctaagagttgaacctgaatatcaaaaatgcatttctggccagccgctgtggctcatgactgtaatccaattactctgggaggctgaggcaggtaaatcacttgaggacaggagtttgagaccagcatggccaacatggtgaaaacccacctctactaaaattattaatacaaaaataagccgggagtggtggtgctcacctgcagtcccagctactggggaggctgagacacgagaatcgcttgaacacaggagatggaggttgcagtgcaccgaggtcgggccactgtactccagcccgggtgacagagcgagactctgtctgaaaaaaacaaaaaatgcaattctgaataccgcttccttatcagaaggtcactaaagaagcacaatcacggactagtttgggggaaaacacgggacttccactgggcaggtgcagtccaataaagaaatctactgtaaagcactgaatttacaactcgatttgctggacattgttttagaaaagcaaatccacattaaacaccatgactgcattttgttgttgtcagactttaagcctaaaataactatgtcaaagagtgtggcaaagaatgaagtactcaatcaataccttgctaatgacagttcatacctgggcccctgatgaaatacatcagtccacgtggattgactgggctatagttactaaagtatcaacttggatagatactaagttggctatttaatgtaggttttatatctttttcagctttaattattttttaaatcaggggaaaaaaacttcaaaactcttaaactttttctgaatagactgttagcatgaaaaatctatcactttaacattaaaatatgacttttcttcctttatctgactgctctactacatatgcccagtaaatacattcctggatcccccaaagcacataggagagtatatacagggcttcttccctatgtgtgtgtgttgcggggggtgggcgggggagattctagggctcaaagggaggaaatatactttgcattcttttttcattcaaaaaactgtatttcaaaaaaatttttttaactaatttttaaagttcacttcaatttgaaaggtttataatgagtataatgcaaatgtttgcttcatacagtattatgtcaattttaagcaaacacaatgtgaggataataccatttaacctagaccaaaaaaaaaaaaaaaaaaagcactgatgaaaatttgctatatatggttctttttaaatgcctccgtctccacagtctggtctttacttgtattccagtgcaggagataattgtaccaagttacataggtcccctcagtttcattatccaggttttttgaagaaatcacgtttccagaggccctaaaaggactctagaataaaataacaactaggaagtacttattagtgtaacacaccagtgtcagtgactaacatgtaagtgccgaattcttgctagtgtgctgagcctctgacctccgttgaagcactgaatccctgcaatcctatttatgcagctgtcaatattatttatcaccattacaggtgagcaggctggtacttagagaggtttgggaacttgcccatagccacaaatatgtgatttgaatacaggtgacccatttgtgatttcctgctcttcatccctcactgctgagctgcccattcaagccatatacacacttgccttttttaagtggagttttacagttgattctcttggtatgttttcatcaagtccaccatttttgctgaatcccaatttttttgtttgtttgtttttgggaaaaggtctcactctgttgcccaggctggagtgcagtggcataatcatagctcactgtattctcgacctcctgggctcaagcaatccttctgcctcagccttccaagtagctgggactacaggtgcatgtcaccacagccagctaatttttgtattttttgtagagggagggtcttactatgttgcccaggctggtctcaaactcttggccttaagtgatcccactgctttagcctcccaaagtactggtattacaggagtgagccatcacctcgaggcctgaacaccatttttaatacaagattgtattcatataatattctgagaagaaacaatattaaaatagtctttccaatggatagggtagggaagatcttcacaaaaaccaaaagggttacactcaacaagagctctattttaacagtctaacacctgatgatactgatgtattgggattttaaaggagatatgggctgggcacagtggttcacacctgtaatctctgcactctgggaggccgaggcagttggatcacctgaggtcaggtgttcgagaccagcctggccaaaatgatgaaatccaggctctactaaaaatacaaaaaaatagctggacgtggtggtgtatgcctgtaatcccagctactcaggagtctgaggcaggagaatcgtttgaacctgggaggcggaggttgcagtgagccgagattgcgccactgcactccagcctgggcaacaagagcaaaactccatctcaaaaaaaagaaagaaagaagggaagaaggaaaggaaggaaggaaggaaggaaggaaggaaagaaggaaggaaggaaggaaggaaggaaggaacgaaagaaaggaaaggaaagaaagaaagaaagagaaaaaggaaggacaaaaagaaaggagatatgtcaggcttcatagaaactcagtttcctaatttcttcatggaggagggtgattctgtgatcttaaagattctttccagctgatgggcacctttctgaatattcaggcttcaaagtaacaaaatagtgatgtcggaagtactgatggtagtaaatacttggcgggccagaggaaggcatggcgtccttttgtgagccaaatgtgattccaacagtcactgaaaaacaccaatgtgcccaaacctcatgcccgaacttcatacttgtttaccaagcaaaattgggccgtatccatagaatcaatttcaaaagagcaaataacctgagatttttaaatgatctgccctgtaaacaggtcagtctgtactggacttgctgattcaaaattgaactgcagctgtatcatctacggttactgtttcttaaagtagcagtgcaagctgttcatggcaacactgaagcctgggcagccggcagccacacctctcttccctgtcacctgagtagacatttgtagcaactgaaggtaaatgtctgtaatggatgtcaaagaaggaaacatttttactggtatcacacatacagtatattgtcttagctttaaaaatcttttcctttcattcatgttataaaccttccttccccagcagaaccctagtccaaaccctgtctccacagtccaggggtgctcatctgagagtgatgttgcaccccagaagagacttggcaatatctgaagacatttttggttgtcataaccgaggaggtgctactggcatgtggtgggtagaagccaacggtgctgctgaacatcctacagtgcacgggacagccctcacaacagagaatttgccctggccagaatgtccatggtgcccatgcaaagaaaccctcctggcaatgtttaacaaatagtctcaggggctttaaaatttatttaatcaacaaaaatgttttagcacaccttctgtggccactggggatacaatggtgatcattctagaaaaaggccttttcccatagagtttatgttttagaaccagcatccctcctctctcggaattccccaggctcccaaagacaaagaaacaatgttcatatcattttttaattctcccggaagggaggaggtgggaaagaaagctgagggaggaacatacatgctgataatgaccattcctagtagaagatacaggcagagctgtggaaaatcacagaacccaggaatcaggaccctggttcggaattttctgaatcacatgccgccctcccacggtatacagctggagctgagaacacagcaatggaacaataaatgcccctggatggatcaggttaaagaatttcaatagttccaccaggagtttcctctttaataatattaatgtaataatggctcccttttattaaccatgtattatatgaaagggttttgcacatattatctctaattcctacagcaatcctgtcaggctggtttcattatccccacttcacagattaggaaactgaggctcagtgaacttgtttttaagtagcaggtctgggttcttctcctggtctatctggctctgaggcccatgaccttccccttaaactaggctgactcccagtaataactgagcagtcattgtcagcataggtgtcccatagcacatcttgtgtcatatccctccgtgggcccacctactgtttctgcctgtcaatcttgcctccccaccatatatctagccacactgctggcaaagcacagaggtggaggtgcaggaaagcgctagatgccactagaatccctggcaaaaaaaatacccccaaatgtaatataaataacatgattccggaagaagtgaagtgcttgaaagcattttatcctttttttttttggagacggagtctcgctctgttgcccaagctggagcgcagtggcgcaatctcgactcactgcaagctccgcctcccgggttcacgccattctcctgcctcagcctcccaagtagctgggactacaagcacccgccaccacgcccagctaatttttttgtatttttagtagagacggggtttcaccgtgttagccaggatggtctcgatctcctgacctcgtgatccacctgcctcagcctcccaaagtgctgggattacaggcatgagccaccgtgcccggcccattttatcctttttcttattccagaaatgctgggcccccaataattgaaaagaccacatatcatgttgtacatgcatacatgatctccttttatcctgattaaaacaccttaggtaaataatagttgcaaccccactttaaagataagcaaactaaatctgaaggtggtaaggtaacttgcccaaacatacaccattggttagtggcagatctgggacttgaaccaaaggttacctgacaaccatgcccttagtcattagcccaaactaaacagctcctgcatgaccaatattcagcctggcaccctcataaaaacactgcaccaagcatggccccagctgtcctgcagcttacaatcctccattcagacttcccaaatatgccttccccattaaaccccacttttaaagatataattgctgcagcctaagctcattaagaaagttcatggagatagatacctctgtaaatacctaaggacactatcttaatcattacctggctatcttttatcagaccacagcaccacttacaatccatatgtatgcctagagatgcttcttacaaagtaaagaagctgaaacggtttcttcgaaccctgctgcatctttgccactcaaagtgcaaccaggcaatgggtagcatcacccgggagcttgttggagcggcaatctccaggtcctcatgagacctgctaaatcctatgtgatttgcatgtacattagagtttgagacatgctggcctatgtcatctaaatcaagttatcgtaagaaatgctaacttggaaagtaaaatctaatgaactacagcatcacaagacaaatgtaaaaatcactattgtcacaagcgcatttgtcatcacccaaagacatcaagaagaagttatccttatatgtgaaggacagttctgtaaaagcacttaaatatgggttttcaggcaagggctctcttcttttctcagcaaattccgaggcagggagtccttggcttaatcatctcccatgaaactggctcttggtttccttatttgtaaaattaagaggtagagccagataacctcttaagtcctgtccagctccgatactttaggatgagagaattgtgtcccatctgtgttcatgctcacaggaaagccatgtgcagtggggttagggacaccagggcttggagtcatacagtcctaattcaaatcctgtttctgttctatattgctgtgtgacctcaggcaagttacttctctgggcctcaattttctcatctgtaaaatgttgctgatatatcctacttcaataatgtgagaattttatggataattatgtacagtatccagtccagtgcttaacacgaatgagtaaattgtagttcatattaacaagttaaagtgggaaaagatgtctgaaacagtatgtggtacagtatatccaattactcgatacacatgcccaatacacaggcacacaataaatgtttgctgaaaaaaccaatgatgacaatattccatcctatgtgagagataattttgtttcagccaagagaacccaccttaaaggggaagactttaaaggcagagttatatcttctaaatgccagtcttcctgttggatttacaacatcgggctcagctgtcagagggaaaatttgtacagcccagttacatgattaagtatgcccctcgtatgccattcactccattaaagatgatttcattttaatcactgttagatagacctgtggcttgcggctacaccagcttcctgtctgatcaagagtcgcatacaaaaatggcccaagccctattactgacagttaataatgcatctactgaaaatatatacatcatttaaaggttttatttctgcatgtttatttgattttgatttctccctgccttcctatggtcattcctagtctatcttacagctctttaacagtagcaactggggctcctttcatcttgagatatattaatcccttcagtacatggaggatgggtagagaagtacagcagtgttaagagtttacgacaaaattaagaaagaccaagttgtgaaccattcccatgacagatcactaaattgttgccatgtgccccgggtttggaagtaagtttaaatggtctctgtaatattaaaagcagaaatgtttttgagcagctagtgccaggtaaggaccagaaacttttctgagtgaggatgtgaaaggccctcatacttttctgcaagaagcaaccactgacctgaggtagaaaggctggaagtactctatgtcagggccttgccctgccagatgttctcagaggacctttacccctcacaaaaaataaaatcctgggccatttagagtttacagattcaggagggcaagtgtgggaaaaagacaagaaaagttcagatgccagccactctgtccctgtcaaccatggcccttccatccagtctcctccccaacctagtcccagtaggcaactcaatgaacaaggatgactttggggtcccttttgtcaagctcagccctaccttcccatatcagatttgttattatggaacacaccattggaatgtattttgaagtactgcaccctttagggtgggtccctgtagaactcaacacttctcagaattcttcattgatactactgaaacattcagcatgtgagatatccctcctgcgaggacatggcccaaggtgtagtcatgtttgcaatcttataacctggaatggtgactggtaaataatatactcaattgatatgatcaatacctagagcagtaactctcaagtttggatttctatggcatttgttacaaatctacctttcaccacagaggtctgaatgagtaggtctggggcagggtggggagcctgtattgtaacaagcacagccaggtgattctgatgggcggatgagggaatacactttgagaaacacaggcttggtggagctaaaccatgattgggtagggttggtgacagctgtatatgatggctcacctttctgatgaaaaaaaaaaaaaaagtctgcaaatactcagcacctactgtgtaccaggcactgtaatgtgcactctctggagtcacagacataaggaagttagatctatccaaggaaagggccagtagtctgacgtgaccaggaagagtggacagactgagtggtaatgtggagttgaagagtggtaggtgataaggttaaagaagaggtgggtttggacagggcgcctctaatcccagcactttgggaggctgaggtgggagaattgctcgagcccaggagtttgagaccggcctgggcaacacagtcagaccctgtctctacaaaaaatacaaaaattagctgggtgtagtagcacatgcctgttgtcccagctacttgggaggctgaggtggagggattgcttgagcccaggaggtagaagctataatgagtcatgactgcgccactgcactccagcctgggtaacagagaatgcctgtctcaaaatatatatatatattcatatcttatattttaagaggtgggttccacttaaaaaagcaatatatgaatgtataccataatctctaagtccatagttttccttaaaaaaaaaaagtagggaatcttttattgaaactaaaggggtctttttatatatgtatgtacgtacatatgtaagtatttgtagaggcgggtctcattctgtcaactaggctggagtgtattggtgtgatcatagttcaccgcatcctcaaattcaggctcaagcaaacatctaggctcaagggatcctccagcctcagcctcccaagtagctgggactacaggctcttgccaccatgcccggctaattttttttttaaaatagagacgaggtattgctatgttgcctaggctggtctcaaactcctggcctcaagagatcctccctcctcagcctcctaaagtactgtgattgcacggatgaaccaccacatccagcctaaggggtcccatttctaaaaacaaaccaccacaccaccacctctcaaagctgctctggtagacgtagtggtggagatccagaatccctactgtctggatcacacaacttcataaaagaggtcctcttaggtggtaagagacataaagtaaaaatctgctgctatggcagaggaacagggcaaaggagttttggaatggtaagataaggcgtatgtttagaaggctaaccatgccagtccaggtgggggatgcctggaaaggggcagagcttgggagcaggcaggaagctaagagccggctaggaggtaactggaactagacataaccagaacctgcagagagagggcatggagagaggaaaatggcttagacttggatcaagttttcccaggggaattaacagtatgaaatatagaactggatggaggagggtgcttgagagaaagaagattcaaggatcaaatggaaattccaattctgaaaaactggaagtatggcaggatggttaaccaacacgtggtcagcagaaaagaaagagaatagagagaaatgagctcagtcactgaagaatcagtactgcatttaaagtgcctgtggatttccttagctttcagacatgtgtccagaactccgaagagagctgaaggctggagatggagacttgcaaatgattagcagagtaatggagccaccacaggagaaggtgaagtcactgcgggtagaattcaacaacaccctgttcagggtattcagtgcggactgacttgtgctaggctccaatccaggagctaaggacaaggcatccgggacgagaactctgccctcatgaggtttacatcctagtgggagaagacaagccaatggtggtaatgctatggagaaaataaaacagggtcaggggctcggggtgtgtgtgtcaggatgcttgcgccatttcataacagtggtcaggcaacataagatggtttggctgtgtctccacccaaaatctcatcttgaattgtgatctccataatccccatatatgtcaagggcaggaccaggtgaaggtaaccggatcatgggggtggcttcccccatgctgttttcgtaatagtgagtgagtctcatgagatctgatgattttataagtgtctggcatttaccctgcttgcactcacttggtactgctgccctgtgaagaaggtgcctgcttctcctttggcttctaccatgattgtaagtttcctgaggcctccacagcaacgtggaactgtgagtcaaacctctttcctttataagttacccagtcttgggtaattcttcgtagcagtgtgagaacagactaatatggaaggtctgagaaggtgacatgtgagcagaggcttgaaggacaggaaagagcagggcaagcactgatggaggtgagagcactccaagcagtagggggtgtcagtggctaaggtccctgcttgggatgaaggcgaaagagcaaggggaccgatgagcagaaagaagggcatggcagaagggagagtgacaagggagaaaagggtcctgggtggggcaggaagagctgcaaagctttatggttcctgtaagccctttggcttttcctcgggggggcgggggtgggaggtggttacagatgactctaagatttctgggctgggcaactggaaggatagacttgctcttaactgctcttatctgagatacagatagaaggaaacaagtttgggaaggcagttgaggaggtagttcagtatatgttgagtctggttgtgtattacattggacatccatggagacaaaggggaaggagcactggatctaagagtgtaaggttttgagagtcaccagaattcaggtggacctgaaagcactgtgactggatgagatccctggtgtaaatggcacaaagaagaggcctgaggcctgagtcttgtgggaaaaaactcagaggcgagcgggtcaccataagatcaaaaggaagcagttagagacacataacccagagtggcttccaagaatcaagacaggatagttttaaatgtccagaaaaggggagaaaaactcttcagcctgtacccccaatctaaaattaccttcctcaaatgccgaaatccttaaccatacagtctaattttttaaccaaataaggacttattggagttgactattaaaaatactaataactttacagaggagttctccaactcatccagtgaggggaatgaatttaggtttctggcttcccaacacagaattcagacaagctgctccagagactgtttgttggggtgtgggtatggggaggggttggtagctggggagcatggtaatgacagtgttagtagtttatgcttaggaagctccttctaccagctggcacctgttaggtgttgtacatcatgtctctcatttaatcctcagaactgccctgtgagacatagcctatgactatcccattttacaatgaaagtgaggcttggggcagctagatggcttgctcatcagcacacagtaggctggaaagtaggacaggccgggaggtaggatgccaaaggggagttttaagtagcaagaggcctttgcatgctatggaactcaaaaaccgatgtcatcttgccaggcagacattggctatgctgcaggtaaggctgccttggagggctctcctgagaacctcaccagtctctagaatgttgtttacctggggagaaaagttactaatgaacttctagatcataatgtgttcataacctcaagggggagaggggcaccctatataaaggtaatggattcccacagaaggagaaaaagttcaataaaaattatgagttgtttgatcgggcaaaatgaattcatatgtacaatattggaactcattataatttctaaattaatacagccatttctattaaagatctggacactgtggcaataatgtatttcatttgatgatcgacctttagagaacaaaaatgtgtaaatcaatagtatagatatagtttttgtcttcattaaagttactataatcttaagctactagtcttaaaagattgtgttatctgtagtattgacattttagaccagtccttaaaagtgttgttcctacatgtaaactaattttagacctgtttaaaaagaaactctcttgatactgtttccaccagtcagcagtattcacaatttagaccacaggtccaggtttaacaccttgaaaacagataccaggtaacaatagcacagttgcagcacacctatgaaaacagacacgatttcattctgctaaggtctgccaaaagcacgcttgttatgacagtataatgctctcttagcatcccataatgaaagtgaaaatgttttgaaagaacgaaactcactccatctcccccacccccaacttttttgggtctccggcaaagaaaatggcagcaagtgacaattcttatagacgggtgctataagaacccaaaaggaaaaaagaaatgagcttgtcttaaccaaaaaaaaaatgaatatcacttttttaaaacaaaatcttgcagtcattttatgcaaagccttttaaaaccagatttgtgtgtaccaagcaaacttctcagaacactgtcacacatttcttcctaacacttagccagaatagacacggtttcatcaaaatttccaaatgctcttgggacaaccttgaggtgtcatcattgggcacccactgcagggcagacactaagaaggggctttgcattcatccatctattcattcataacaatttctggtgttcttactagggaccaggcacagttctaggtccaaaatgtccaaaaacaaaaatccactgctcttttatccttaactgaggggaggtgttgaggagctggggagacagactgaaagtaaacaaattcatatataataaaatccagctgcattaagcattaggaagaaaaagaaggcagggcaggagaatacaaaacgagggagcaaggtttctattttagatacggtagtcagggggtctttctgaaaagatggcacctgggttgtcccttgagaaagccataattcacccccttcctgacaaggtcagctgctgctcattattgaatctccagcgcatagcaggtgtgtggctccactgtaggtgttcaggaaatacctgcccagtggatgaggaagaactggaagaggagtccacggcagcagcggccggacacggggtgggagcgcccgccgtgcaataatcattgcaccaccgcacacctcccaagggatgggcaacttttccgagcgctgtcacagctgaggtcgtgtcctgagctcccaggcgccccgcggggtaagcaggacagccctctccctgcagcagggacgcggccacccccagctcgcctaccctctcccacggccctgccagcacgccgcgttccgatcggaagggaacaaggggtagaaagtgttgccgaaacttttcgggctgcgctgtcctcccccggcccggaggcgaggacgccgaacagccgcccggcgcggcccgaagctggcttccgacccggcggggcgagtcccggggtgcgcaggcggacgcgcggaggggccgaggtctgtgccacagcggagcggggccggggcgaggggccgcgccgagacaaagcggcggtggcggcaggacccgggtcggggccgtgcgcggcgggccccgcgccccctcacctgtcgagccagaaggtccaggacgagtgcagcgggaccccgcccggctcaggctgcagcgccgacagctgctgcaggccgagcggcggctcgggggcggcggcagcggcggcggcgcgggaccccggcggctcccgggccccggcggggggcgcggcggccgggggcagcgccattttctccgccccgcctgcaaggccggcggacgcgcggaccgcggggcgagcgcggctgagtcacccccggcccccgccccgccccgccccgcgcgccccgccccgccccgggctagccgcccgccgcccgccgcccgccgcccgccgccttcagggcctgggagccgcgcggaggggccgtgggaggcacggccgggccggggccgccgaacaaagacagacccacggagggatggggggccgatcccgctcaggcgcgggcccagcgtgggagactgacggcctggcctggagtggcggccggggacgggctagagggcccacgggggtgagagggaccggggaacggtctgcgggctggctctgcagccatgcaaaagggcagcgggatggagcggcaggctagggacagatggagggatggatgggacaggggatggagccccagacccacgtggtgcgagggaaggagggatggacagacataccagcagtcagaaggatggagtgaaggctggcagatggctggaggagagaaggagggatggagggcagatggaagcacagttgggtgtgacagataaatggagaggggaaccgatggccaaatggataaagagactccagtgcccgcgagtacagaacaaagggcgagaaagaagaacgaacaagagaaccaccgactggggcatgaggttggagcaggtgggctttgcattcctcttggtgagagcatacttcctaactccgctgatttgaaggggccagagcccccatcccaacctctggagctaccatgtgaccacagtgaaggcctcaagcctggcttaacgtgtggctaacttcagagaacatttcccaaaatcagccaaagtatccagatctgccctaaagcaccggcgagtcgggaggaggaaagcgggcacctgtgaacacagagcgctctgcttcctgtacctctgagcacccaggaagtcccttaggcggtgagattcctgagcccaaagtaggaggggccctcctaacacagcatctccccaggtctctgtcactttctttttcaaaagaaaagcaaaggcatgaggcctgtgaacacacatgtcacaaccagcatggacatcctctttacacttgaatttctagatagttcctctctggctttgaacagtgaagggcgtgggatgccatctcctcattgaccttctacctggcctagcatgtgttctgttcatgccttgagcattcgctgggatggaagagctacaaaacaagatgagttcaggggcatcaacagcatcatagcagactgtcatgaatcccagagtagatgccctccctaaaaggtaatcaaggtcacataaagtgacaataataaaaacaagaccgctgctttaaacttaacttctatacaacatacaatgctggaagcaatgacagattttataaaatctgtccaacactaaaacaggggagggtgcttttggttagatgcatttatcttgttgcttaatatctcctttcatttttccaagaagcgtggtatatggcattgtttaaactgctctgagcactttacccgtaataactcatttaatccttacaataagccaatgaggaagatactattaacccattttacagatgaggaacagagataagattaagataaccccaaggtcacagagctagtaagtgggacagctgggatttgaacataggtattcagactccagagtctagactttcaactgccagactctcctacctctctacacagaacactaacaagtccacaacgtaaaaacaagctgtgaatagtaggtctccctccctcccaagactatcaatcttcattcccagaggaaaccactggcaacagtttccttccagaaaaatgcaagtatgcacatgcaagcatatatctagattcataagttataaatctatatcttttttataaccaaaatggaagcatttaataccaatgctgtaccttcttatttcacttaacattatatccttgaagatttttccatatcaaaacatatagatctactttatcttaagggctgcaaagtaattcattgtaaagaggtaatataatttaattcactagcctccaacatttatgtggtttctagacattttcttatataaataatgctaccataagtatttttatatttatggctttcttcatctacacaagctaatctcagaataagtttggagaagaattgttggctgcatttaaaaatttgatacatattgccaaattgctttgcaaagtggttacatgaatttatatatagctgatatataaataatggttgattctgaaaatttatatttacgaagtgacacatatctgtataaaattccaaggcatgggtagaaaggaagttttgctttctaatgattaaagctagtcaaactgtcaagtttagctccttccttatgtcctttaacaatatcctcagcaaaaaagggctagtcaagaatttttatctgcagtttctgtaaaaggattgtgtaccacatgaaaaaattccctccagaatttagaactaggaacagtctggcagtttttctttactgaatagcaattatatacctttctctctttttgctttggcttccaggctgctcataattacatttggtgctcaatcacagcaccaatattagccaatgaagaagcatcactatttttatatttattcctatttctattttaaagacctaatagcatatatgcaccttacactgaacccctcaaatttattttggaagtaggtggtatatatgaatagataaaatttaaatgaccttaagattaataaaagagattatacaaaatggctaaggagggaacaatggtcacaactttcattcccttcctgtttgaaatatgtaagagacttaattatttttattgctcttcagaatcattcttagaagataataaattggggaaatttccctcatctgggaactggatggcaggaactagaatttcaaggtagaaaggggattcagcgatcatctaagcaaacccatcactttacaaatgaggaaactgaggcccagagaggtgaggtgacttacccgaggccacagctctaggaaatgacagaggcgggactagaacgtgggtagcttgaggtccggaccaacgtgctgtcccactgcatgacacgcaacacagacgacttggggtggcagaagagaggaagagaaggtgaccccacagcccctagcaacaaaaacaacaagaaggacttgaggcactcataaataattaagcaattagctgcagcagctactcccctcccctccagcatccagtcaccaaggcaacttgggcagggtgcctgctggttgcctagtaacagtgtggtctgctcccctgacaagctccctaggcatcaaaggatttgagagccgggaagaaccttagacagggatcacttttccaacaccttcattttccaaatgagaaaagaaaggcccagagaagctgggtaacctgcccaaggtcacacagctattcagacacacagccaggctccattcccagttgctttccattgcactagggctgcctcagggaggctgcagatggaggagagggggaaatcgctctacagttcctagaagaatgagaaagtcagagcgagcaagcaggcaagaaagagacagaaacctgagcactcatatgcaattagcaggagctggtaatcccatcagcccaactttcatcatcaccatggcaacatgggtgaggtgggtgctggttgcctagcaacaagtggtcctctctcttctactcacatctgctccctgggagtcacaggaacagcagaatgatgacgttggaagggaaggcaggggtcctaactcagtctcctcctttacccaatgaggaacctgaggttcagggacactggaagtcacacagccacagagttagctagtgacattccctccattgatggcctctgtctcaacactttgggaagggagccttccactcaataaaggcagaacatgggagggaattggccagtggctcccttgaaaggagggaacacatggtctctaatgtcagaaaacctgggtcaaagctagttctccctaaacctggcaagcttcctaccctctctgtgcctcagtctccacatatgaggactggacatgctaatggtctctatctctcgagttatcgttaggattaaatgagaaaatgtatatgtcaagtccctggtatatagtaaagatacagtaaatgtcaggcgttcattcattccacactcaataaatatttgttgcatatctgctatgcaaatgccactgttctaagctctccaggttcattagcaatacagacaaaagaaattcctctctctgggagcctacattccaatagaatgtgtgtgtgtgtgtgtgtgtgtgtgtgtgtgtgtgtgtgtatttaagtgtttgttgaatgggtggcggaactcattggcaatatgctgtttatgttgctgggctccttctctaacactgagaagtttcctgtttacagggtgtgatactataaatatgcaggcctgtcttttatgtgggaactccgttttcctttaacagcaaaagaaaaaggaaggcaatggccactagatggcagtcttcagtgccggtaggtacagggcacaggaagggactggcctggggcagaggccctcactgaagcttccagcaaaggtgtgttgcagctggtcagtcctagagcaatggcttggaaaggtaggggagacttgacactattctgggatactcacgggtcaggggaggctgcggtgtggttcaagagtgattgcttcagagtgagactgatccctgctctaaccaagatcctgccataggtaaaccctgtgactctgggaagttattaaccttgctgagctccagattcctcatctagggtacagataacaagagcactctcaagggactgctctgagccatgtataagaaaacattgtctataaagcaccttgcaagttgcacatagaaaaagctcaactagtgttatttatctagattccaaaagacctctgaagatcttttaggggccaggccaggcctctcttgttcagagctgctaatggaagagaaaggggcaaaggaaatggcatgtgttaagcatctgcagtgaggacactgaggtccatgtggtcattgagcctggaaaatgtggccttgaggtttggttgtcccactctccacatccatccacctatcagacattgagttctcgtcctgatctgcctgcaatccgtgtgttggtcttccttctttttttctttttctctattattattgttgttgttttttttgagacagagtcttgctctgttgcccaggctggagtggagtggcacaatcttggctcatgcagcctcggcctcccaggctcaagcaatcctcccatctcagcttccccagtagctacaagcacatgccaccatgccctgctaatttttaaattttttgtagagacagggtttcaccatgttgttcaggctggtcttgaactcctggcctcaagtgatcctcccacaacagccttccaaaatgctggaattacagacgtgagccacagtgcctagcctgctcttccttctttattcccactggtgccagccactcccagtcctcactcctgagtcagccaagcatggcctggaggactgcaacagcctcctaacgggtctccctgcttctaacacccgaccctctcatctcctgccagacagcagcctgaacaacagtcctcaaacactggtttgcttctgcctgctctcagaaaaaaacccagactctttctggtggccaacagtacttggcatcttctggatccttcctgcctttccaaatccatggctgatctctccccctgcctcaaagcttctctgtggccacagggcacctgcatatgctgttctttctcctgaactgctagtccctccgcttgcatggctgactccttctcctgccttaggcctccactctaaagcaggtcttctccccttcctcattatttttttcagtgcacgtgtcagctgcacacatcaactgccgatcttccgaaacagaatatccagtccaagtggggagggccaggcctctcttgtccacctttgtccacccagtgcctagtgcagggcctgtccatggctggcacaccagcaacatttattaaggaaacaaactgggtatacagcagatattggttgaaaggaagagtctgtgactttgtctcctaatttcttgtctttctcctctgccagtgtatctttctcatggacggcatgttggtcttcctaaaaagcacttttgtcctattacttctttgttcaaaagccctaaagcgctgcctgtttctcacaggctgaggtctgaaatctggaatctagcctttgaaattgtccacaccttgaccccctttttcaaatgcatttgcgagtatatttccaaatatatttagagagatataattatacacctatatttacatatacttggaatatatatgttaaatctatatatttggagaaacagctatacatggaaatatatatattccaaacagatttgtccctatttcttggtgcattttcagctctgccacaacatgagctcccgaagacaggcctgggcccaccccctccaccactgtcttctgggttcctagcacggtgtctggcacatgggagacccagctttactgaatcaatgatgggcttactccccacttggtaaacacaccatatgtactcatatctccacacttttgcctgagacctttcttctctcctctgaccatctaaattgtctaaccatccttcaagggccaggccaagttccctcacagggaatcagtcaccaaacacaccccagatagggacaagagattcacagagttctagagacacagctgggcagtgcccaaactactttcctgatttaaaaaaaaatctcttccctgatttaaaaaaaaaaagtcccaacgatgtcagtatataggttttgtggccagtctaagagctctgattaaagacctttgttgtggccacacagaattccactgattggaggagtaatgatttgtataaccaactcctcctgttaggcacacagattattaccagtgattgtggctatcatgtgcaaccctgtaataaacactctgccaatcactggcttcttatcaaagagtagttctgaacattcctggccagccaatcaatcagagatacagagatagcttacatcagaaactggactgaaggggagagccggcaggcctcaaattggtcttcagcaatttttaaaagaaaggaaacgatgagcagtagggaggcaatgtgatcagaggaaagtccaaaaacatgtgcttgagccaatgtctaacagccatgtgctttgggacaaatcggtgaacctctgagtctccttttttctcaattaaaaaatgagtgtgccaataacacctgctttgcagtgctgcctgaaggatcaaatcaggaacatttggtgaggctctacataaaagtcaaaaaaaggtcacccaagtgttgattctcgtttccttatcacagttcctggaggggataaccctacatcttctctgctttttgaatacgagtgtcctcctttgtatgctcgttggggatctagagacaggtggagtgaacaactgtcccaatttgcctaggactgttccaatttgagcactgaaagttctgagtcccagaaaaccctttggtcctgggaaaacccgaacggtagatacacaaggagcgggtcctggagcactgcctgttccagaggatttcagcaaccatcttggaggcctctaatccccactatgagctgataactgctcgcctagtgggataaatcaacagcaagcaagtcatttgtttacatctaagaagctgctttaaggataagattttgttttggggatttcatttacggttcatagatcatttaggggaacattttgtaagccagttctctgaggaagtgtattgtgctttccgaagctttattttaagctgaaataatcatatttatgacataagaaatcttgatacagaaaatataagctgatttggcaaaatattaggaggttatgagtcaggctgcaaaaagacctcctgtaccatctttccctgtaccatatttaacccaagcttcctgaggggtggggagctcacctttgaggtcctcagagactattataaagtactgctcatgtactgggaagtcaataaatatctgaataatgaatccttctgtgatttaaaaccattcattaaagtgtagattgaaatactttataagtcatttacttcttaagagctaagtacactaaagtttgagaagccattatcaattgatgaacaattagtaaaggaaaataaagcaattcttgaaaggaagctgcattatttgttttctaaaaaaaatcataattacatgacatttttagaactctaactactgtgcaaaatgcaccattcagaaacagaaggacacttgcagtgtttaggccaatgagaccccttcagttactgaatctcttttgttttaccatcagcaggaattgcatactcacaatacagaaagatcctgttaatttttcactcttttcctgttcattcttattagttacatattatctacataatggcaggttgcaccttatggtatttgctttaaattttcttagtgtttgtggtaagacagtatcttattcccagaggctaaaaagatgcacatattgatcatactaggtcatcattacaaaagaggagctctcatggaggctatgatgaacatggtatccctcagatgactttatacaagtatttgatgtcacaaatatatactgtggttgacaatgatcttggagatagctgagtcactttcgtcctttcaaaacctaccaggtcactcagaaatacactgtgaattatcctaaatttgggatgagtccctatcattcctaaaatgcctaagggtcatgtctgcttgccttattggactaaaatattttataacacatgaaacataaatttgtcaattaaatgcagtatcatgtttttcatagtttgcaaaagcacagttaatgatgcaaataatttcctatttttcattctgagggaaaatcattaataaaaccaaactccttattagaattgaaattcagcagtaagagggcacaagccacccataaaggcaagatataaattagcagtgaaaaaaacaagccaactgattataacgtccagatggaaatgaataactgaatcattctttgtcaaatcaaatagcatcttaataagttgttgcatcatctctgttgattcaatttaactggaagatatcagaaaatgactatgacctgcacaagtatcttcatttctcgtgctcattagtatttggcctatgagtcctctccttttattttggaggtgaattcacctctaaaatggttttttggtttctaatcctcaacatcatcccatgttaaaaagaaaactggccccaggctggaatgaaattattggaattaagaaactggggccccagtggttggtcaaatcttttatcagaggaagaattcaagcacttcttttaccaggcaagctggtaagtacaagttgtcatggaaacaggatgtattcaaattatatgaggaatgacgttccccatctaactaggtgttcatctcatctaaatggggagagattggtgtagctgaaatccattatatttttttcaaatctgcattaaaaacaataatttcctttattttacataggagtacacaggcacagagcctcattctcataaaacgaagaattaaaattacttgcaaaagaattggtgcgtaaataaaaagacataaaacgaaaatgaatcctatgatataaatctattgatgcatagtgaagggtgggagaatggaaatcagataatataatacctccatctatcatgggacatatttttcttcaatagcattagtaactagtttttctacagaatgatccaggccagagcagttctctgcaagttgaggagacttgctaataggtgtaatgtcaccaccctgataacagcagagcaccttgtgaatccacagattcctaacaaagaaacgcaatactgtgctaagcaggtacttcccactccttaataaggcaattgttgaaaaacacatggcacaaactaattttgtggggaggttattagagcatgaagggcccatgaagtcacagctctacttaagaggcagcctgaagttctttctggatcaaagtaacccagaacatcttttcattttttttttttcaagtgaagatcatttatccacctccctccaaaaaatgagaagaaaacattttcatgttttactggttaaaatgctgaggtcttaatgaaactcttgtccaagcacttaagataatagtaattcaaataaaaataccaatagctccaaaatctacaaagaaattttttaattcaacaataagaaaatgaacaccatgattttaaaattggacaaaagacctgagcaaacatcttgctgatgatatacagatggcaaataggtaccaagaaaagatgcttaatatcatatgtcactggagactgcaaattaaaacaatgagataccactatacacctattagaatgtctaaatcccgaaacgttggtaacaccaaatgctggtgaggatgtggagcaacaggaactctcgctcaatgctagtaagaatgcaaaatggtacagccactttgaaagacagtttggcagtttattacaaaactaaacatactcttaccatatgatccagcaattatactccttggtatttacccaattgagctgaaaatttacgtccacacaaaaacccacacagagatggttatggcagctacattcataaatgccataacttgaaaggagacaagatgtcctttagcagtcagtagatcagtaaactatggtacatccagacaatggaatatcattcactgctaaaaagcaatgagctattacaccatgaaaatacattggggaaactttaatgcatattactaagtgaagaagccaatctgaaaagccacatactgtatgattccaactaacataacattgcagaaaaggcaaaactatggagacagttaaaggatcaggggttgtcaggggttcaggtgtaggagaggaaggaatgaataggcggagcaaagatttttatgaaaataaaactattctgaatgatactataatggtggatacatgtcattggacactcatcaaaacccatagaatatacaaatccgagagtgagccctaatgtaaactatggactttggttgataatgatgtgtcaatataggctccttgattataaaaaatgcacccatctggtgtggcatgttgataatggagaaggctatgcataaatgaggataggataaatggaaaactccttgtaccctccactcaattttgctgtgaacctgaaactgctctaaaaaaagaaagtctattaaagaaaaatatcaacagcaacaatagctaccattttgtgaatccttaactattctcatctaattcacatatcaacctgatgaggtattaacaagtatgattatcatctcccactttacacaccggaggctcaaaatggttaaataacattcccatcatcacccagcaagaggtatggagttcaaaccctaagtctgcctgtgctcctaacagttgcaacttcaggaaactttaggaaaagtttcacttctccgaagtcatctctatgatctggaaaatgaggtgagtctttgacttatgaaaatattcaagttatgccctaaatgttcaaaacagagcactgtggcagaaggtgcttgaatatctggtgtacaaaacatatgaccacctattaaataaacaatttagaacctggaaaatatcagagttcaactacaaattaatagcagtctaatttttactgtaaggtgggttgagccacctgcttttagagagtgactgcttaagaggaataaacccttggattcaagaatctcaatgaactccaatcacaaaaaacatgaagaaaatcacaccaaggcagggcaagggcataatcaaactgctacagtgcagaaaaaaagacacattttatacagaggaacaaaataagaattaggctgggtgtggtggctcacatctgtaaacccagcacttggggaggctaaggcagggggattgcttgaggccaggagttcaagaccggcctgggtagcatagcaagaactctcatctctaccaaaaaacaaacaaacaaacaaacaaacaaaaaacaacaacaacagagatttttttcataggaaatcatacaactaagatgataacagaacaatctctttaaagtactgaaagaagaaaacctgtcaacctagaattctatactcagtgaaatatctattcaaaaatggagaagattctctgccagaaagatggaataagacatgctttctcaattcctcccacgaagtatagtgaaaaaccctgaacattatataaaataaacataagaagactctgaaagaggccaaaaagtggaataccagttagggacctcagtagttaaagaacaacacagcaataacttccctgggttttctttttgtctcatatctcttagactcagagatggagaagctggcaacctgaaaatgctaacaagcgcagacaagaagagtctagtttctctagccaaaggagcagccttgcaagacagaaaactaactatgccagccaaatgcaacagaaaaaactgtgatccttcccctacctaagccagcaaggccaagtgagaatcttagacttttacccccaccaggtagagtggattaaataacaagcaaatacacaacagcaaaaaaacgtgacgcaacaaaatgctatttataaaaaactcacttcaaatacaacaatgtgggtaggttgaaagggaaaaaaaatgaaaaaagagatatcatgtaacaataaccccacaaagttaagagtagctatataaatatcaaataaagcagattttagagtaaagttaacagagacagagaaggacattacataattataaaagaatcaaccctccaggaagacataatgatcctacatatatgtgcaccgaacaagagaggctcaaaatacatgaagcaaaacttgacagacctgaaaggagataggcaatagaaaattatagctgggaacttcaacagcccactctcagcaatggatagaactgctagacagaacatcagcaaggatatacaagaaatgaacaacaaatcagacagcaggatctatttgtcatatatagcactttagcagaacacaatttttttttcaagagttcatggaatattcaccaagatagattacattctgaaccataaaacaaaacttaacaaatgtaaaataaatcaataccagaaaaagaaccagaaaatttccaaatgcctgaaaattgaacagtatatatatatatatatatatatatatatgggttaaaaaggaagtctcaaagaaaattcaaagatacatagacctgaatgaaaatgaaaatacaacatattaaagcatgtcagatgcagctaaagcactactgagagggaaacttacagcactaaatgcttacattacaaaagaggaaaggtttcaaattaacagcctaaattcctacattaagaaactaggaaaagaagagcaaagtaaacccaaagcaagcataaggaagagaaaaataaagagcagaaattaataaaataaaaaattaataaaatcaaaacagaaaaataatagagaaaatcagtgaaacaaaaacaaaaagagagaaatagagatgttttcagatatgcaagagctgaaagtatccactaccagtaaatcaacaccataagaaatgtcacaggctgggagtagttgctcatgcttgtaatcccagtactttgggaggccaaggccagaggatcacctgaggctatgtgccccagaccagtctgggcaacatggtgaaaccctgtctctaccaaaaaattaaaaaattaaccaggtgtggtggcgcatggctgtagtcccagctactcaagaggctgaggtggaaggatcacctgagcctgggagattgaggctgcggtgagccgtgatggcaccactacactctagcctgggtgacagagtgagactctgtctgaaaaaaaaaagaaatgtcatgggaattccttcaagaagaaggaacatgatgccagaagggaacgtagatgtacagaaagaaacaaagggcactggaaatgataaccacatgggtaaaatataacataattttggtatttttaaaatctctttaaaaaataatgactgtttaaataaaaataataacaatgtactatgggctttataacatgaataaaagaaaaatctatgacaataacagcacagaagttgggagggagaaatgagaatatgccactgtaaattgttatagtgtatgtgaagaggtataatatcacttgaaggtagactgtgataagttaaaaatgtacactgtgaatcctaaataaagcactaaaataacaaagcaaagaattataactaataatccaacaaaagagataaaaagaaattataaataatatttaattaatctaaaagaaagcataaaaataggaaaaaggaagcaaagagcagttaagacaaatagaaaacaaaaagcaagatgacagatttaaatcttaccatattaatattcgcattaaatgtacagtttaaatattcccaattgaatttcagccattatttggttgaatataaaagcaagaaccaacaataaggctgcctacaagaaatgcactttaaatataaaggcaacaatagattaaaactaaaggacagagtgtgcatttttctttctgcatgtagtagactcaaacattccatttaacagatattggccagtcatggtggctcctgcctgcaatcccagcactttgggaggccaaggcaggtggatcgtttgagtccaggagtttgcgaccagcctgggcaacatggcaaaacaccatttccacaaaaaatacaaaaattagccgggcatggtggtgtgcacctgtagtcccagctacttgggaggctaaagtgggaggacacctgaacccaggaggcagaggttacaatgagctgagatcgtgccactgcactccagcctggacgatagagcaagaccctgtctcgaaaaacaacaaaacgaaacaaccaaatatttactgagtacctactattgtccaggaatatatgagaaaacctgttaaaggaacaaaagaattgtaagaattcattaaaaaccacacatcccagccggccgcggtggctcacgcctgtaatcccagtactatgggaggctgaggtgggtggatcacaacgtcaggagatcaagaccatcctggctaacatggtgaaaccctgtctctactaaaaatgcaaaaaattagccgggtgtggtggcattcacctatagtcccagctacttgggaggctgagccaggagaatggcttgaaaccaggaggcagaagttgcagtggatgtgactgcaccactgcactctggcctgggcaacagggtgagactccatctcaaataaaataaaatacaataaaaacaaaaaaacacatccatgcacatgcacatgcacgcgcacacacacacacacacacacatcctggaatcccaggcatagattgtaagcaaaagtaggagttacattgatccttagcttgatgttatgagcatatcctacaatgaaataatttttaaagtaaaaaaagaaggtacattgtgctaattctaatcaaaagaaagctggagaggctatatttatatcacactaagtaaattccggagcaaagaatattatttggaatgaagagggtcgattagtaatataaatgagtcagttcatcaagaggatataataattctaaatattttttactcctgataacagagccccaagatacatgaaacaaaaactgttagaagtgcaaggagaaatacaaatccagaattatagccagagatttcaacactcatctctcaataactgctagaacaagtagacagaaatttagtaagaacataaaagatttcaacaacactatcaaccatcttgacccaactgacatttacaaaacatttcacccaacaaccatacaaaacacattcttttcaagggtacacagaatgtttaccaagatagaccatattctgggtcataaaagtcttgataaacttaacagaactcaagtcatacaagtatgttctctgatacagtggaatttaattagaaatcaataatagcaagatctctgggaatcccccaaatacttataaactaaataacacacttctctataactcatggatcaaaaaagaaatcaaaaggacattaggaagtattctgaaatgaatgaatataaaaaaacacctatcaaattcatggaattctaccaaaacagttcttaggggaaaatttataacacaaatgcccgaataaagatctcaaatagatggactcagcttctgtgttaagaaactagaaaataaaagcaaataggatgcaaattaaatagatcaaaggagataataaatatcagagcagaaatcaatgaaatagaaaacagaaaaacagtagagaacatcaatgaaagtaaaaatctggttatttgagactgaaaaaaatgataaacttctggcaggactattcagggaaaaatgtaccactatcagaaatgacacagaagatatcaatactgactttatattatagctatgtagaagataacaatgaaatgttattaacaacttatgccaatgaattggtaacacagatgagatggacaaattcctttaaagacataaaccaccaaaatgtacttggtaaaatatataacttgaacagccatatatctataaaagaaatgaaatatatagttaaaaaccttcccccaaagaaaactccatgctcaaatacttttacaagtaaattctaccaaacattaaagaaaaaaattctacataaacttttaaaaaacaattgaaaaggagagaatacattccaagtcattctattagatcaccttcatcctgaaccaaaagacaaagccagtacaagaaaaaaagaaaaacagctggagatcaataaccctcatgaatatagatgtaaaaattcaaaacaaaattttagcaagtataatacaagaatatacaaaaaggatagtagttcatgaccaagtcatatttatctaaggaatgcaaggttggtttaatatgggaaagtcaatcaatacaattcactatttaacaaactaaaaatgtaaatcagtgtggttatctcaatagatgcatggaaagcatttgtcaaaatccaacattcactgctgattttaaaacaagcaaacaaacaaaaacctctcagcaaagtaggaatggaagggaacttcctcatctataggcgcctataaaaatccatagctaacatcacgcttaatggtgaaaaactgaatgctttccttttaatatgagagaagagaccaataaggttagctccagtcatttctatttaacattgtattaaaggttctagccagtgcaacaaggcaagaaaaagaaataaaaaggcatccagactgaaaaaacggtaacattgtctattccagacaagacgcatgtctatgtagaaaacctgatagaatttaccctcaaaaaactgaaataagtgagtttagcaaaatttcaaaatatgaagtcaatatacaaaaatcaattatattctttttagggtagaaatgaacaattaaaaattttaaaaataccattcataaaagtatcaaaaacacaaaatgttgatagataattctgacaccagatatacaagaactatacactgggaagtacaaaagactgctgagagaaataaaagaagagctgaagaaatgaagagatacaccttttttgtgtataggagagtattgttaagatgtcaattctccccaaactgatctagacacaaccccaattaatatcccagtaggctttatcatagaattagataacttcattctaaaacacatatgtcaatgctaatgaccaagaacagccaaaacaactagaaaaagaagaacaatttggagaaataatgctccctgattttaaggcttattataaagccacaataatgaatacagtgtgacatcaagatagacaaacacataaactcaacagaataaagagtccaggaaaagacccacacatatatggacaatttgtttttgacaaaggtgcagtaagtttttcaacaaggggtgctggaacagttgaatatccatacattaaaaaaatgaatttcaatccattgaaattcaatccacctcacaccatttataatattaacatggaacataaaactaactgtaaaaaacctaaaatcataaaacttctagaagaaaacataggagaaaattttcacaaccatggtttaggcaagaatttcttagatatgatgtaaaagcataattcataaaataattcaaattgataaactgaacttcatcaaaattaaaatctctgctcttcaaaagacactattaaaaaaataaaaagacaagccagaaaccaggggaaaataggatttccaaatcttatatccaaaaaagaacttttttccaggatgcataaagaactcctaaaagtcaattaagaaaaataaatgatttattgaaaaaatatggcaggtttatcagcaaagaagataggtagatggcaaataagcacatgaaaaaaatgttcaatatcattggtcataattgccaacccagtagaattttattcccagccaaactatcaagtatgaagaaggtaaagtaagagcatttccagatacgtaaaaaatcttaaaatattcacctccggctgggcacggtggctcatgcctgtaatcccagcactttgggaggccgaggtgggtggatcacaaggtcaggagtttgagaccagcctgatcaacatggtgaaaccccgtctctatgaaaagtacaaaaattagctgggcatggtggcacgtgcctgtagtcccagctactcaggtggctgaggcagaagaatcacttgaacctgagaggcagaggttgcagtgagccgagactgtgccactgcactccaggctgggtgacagagcgagactccgtctcaaaaaaatatatatatttacgtccaaagcagctttctcaggaagctactgatatatgtataccacttgaaaatgaaacaaaagaataaaacaagaaagagaaagatgtgggttcattccaggaaacaggaagtctcacagggagagaagagaacagcatgctttggaaggcagtgccagggccacagctgtgcagggagctgtccagaccagatgaagtaagagaatgaaggaagggtggtagcaggggtttctctgagaaatgcagctgtttatccaaaatgtttgacatatggaaatcagaccactgcaagttcacatgggagtctaaggagaatcgaacccaagtcatactttttatgtgatttatcataaaaatctgtctgccttatctctaagatttatttttacagatgctctccttaacaactgttacaattctgcaaatgaaagggtctctacctcatctaaataaaaacccaatgcaaagcttggtgctggtggcataggaaaaatttatatgtgtgtgggaggtgtatgtatatagagggtgggcatttaaaagagccaaactttcatattttattacaaggaactcgttgcataataggtaaactagcaattcaagaaacagtaggtacatccttaaagatgtgtcttacaggaacttaaagatgtgtcttatggaactatgaacctgttccatagttcagaacattttatatggatgtaccccccaaatcgccaccatataaagtatattcactgtaattctctagagtagaaagtatcaataatcgatgcactatttgattttcgaccaaataagagagaaaggagatgaaggcaaggattacagcagtagcagctttgatatgcaatatttataccattattccatgcacatgaagagatgcttaaggaataggtttgatcttgtaatcttcggcactcccagtagcactgtagtcctggtggttgcattgagtctgtcaatgcaaaatttaggatcacaacatgacttaaccactagagagagtttaaacagctagtaaatataatgcaaaagaaaggggccacattttttaagaaggcctttttttctcacttggagccgttgctataacttgcttagaaaaccattatagaaatatcaataatggcattgtaaatagtgataacatgttagtgtagactccttgtttgtttcttttcgatattgaaagtgtttattttcaggtggttaaaatactgccacctatgccgttagcataatggtttttcgcaattctgtactagcagatacaatcccagtttaatacttctatcatcccaatagattttctttcaattatatattagtcgacaaagctttctgtacatatttgtcaagaattcaggcttttggtccagacagactggaattttaccttgctcttctactttgtgctgtgtgaccacagactatggttaattgctttaaaactcaaggctcctcatctgtcaaactggggtaggagattttgtaggagtaaattattaatcatatatgcaaaacagcttagtgcatttttggatctaaaaaatgatagcttttctagtggctgtgctgtaatataaagctattggttaaataaaactttcttaatctctcttcccaggtttacctaaacatcaaagccccaaagcacgtaaacgttaaggcccaccaaagggggcaatccttatgcacatgatcatatggcaaggcatgacttatttctgtggccagcctcaggtaagagtacaagaaatcacaccttaagaatctgcactcactcagaaagccataactaggagttcatgttacttgccaggctcctatccaccttttaataaagacacctccataggccacagaggtgacctcactttcatatgaatttttttgataattctgttttcttatgatatccacagagttgtggaactatcactattacctaattttagaacattttcatcaccccccaaaaagctctggacccattagtggtcactctccaatcctttcccccagctcccagcaactactaaccaactttctatcactatggatttacctgttctgggcatttcatgtaagtggatttgtacaatatgtggtctttcgtgtttgacttctttcattgagcacagtattttcaaggttcatccacgctggagcatcacataccagtacttgttattatgagtgaatagtattccactgtagggatatatgacattttatttatccatccattcattcattgacctttgtgttgctttatccttttggttattaggaatgacgatgttatgaacatttacatgtgggctttcatgtggacatgttttcatttctcttgggtaaatgcctaggcgtgaaatggctaggtcataaggtaactctatgtttaactttttgaggagttgccaaatcattttccaaaccagctgtatcattttccacccccaccagcatcatctgagggttccaattcctccatatcatcaccaacacctgttatcatctacatttttgataatagccactatagtagatatgaagtggtatctcagatggtttgaattgcattgtcctattgactaatgatgcaaagtatctttccatgtgcttattggccatttacatttctttttagagaaatgcctatttaaagcctttgtccatttttaaaattgggttgtcttttttgagttatgagttctttatatactctggatacaagtcccccatcagacacattatctgaagacattttctcccattctgtaggcgggcctttcattttcttgatggtgtctattgaagcacaaaccctaaaaattttaatgaaatccaatttatgtatttttttcttttgtcacctatccttttgggaacatatccaagaaaccacttcctaatctaaagtcatgaaaatttactcctatattttcttctaagagttgttatagttttagccctgagttttaggtctatcatcaattttgaattttttaaaatatatggggtggggttggggcgcaatttcattctcttgcatgtggagaaagaaaaccaactgttaaagagttttcactaaacacattttgcttaaatgaagtttaacaatatgctatacatatacacataaagatattcagttattcattcaacaaatacagacagcaagcacaatattttgagatatgcagtgatcatttttcttcctctatttttccctttccttcccaacattcaagtggatagcaggctctgggcttccttgactaggagaggtttacggcaaggtggcttcccggcttttattttttccaaacacctgaatttggggaacacagcttcccagggaaattgattccagttgactcttgaacaacatgggtttgaactgcatgggttggtttatatgtgattttttttttcaatcaaaacaagatggtaaatacagtatttgagagatgtgaaacctgcatatatgaagagctgacttctcatatatatgggttctgcagggctggctatgggacttcagtatgcatggatttgggtgcacgcggaggccctggaacgaattccctgtttatactgagggatgactataattacattgtccagaagaacaaggaagaactgggttttcaccctcttccagagtatatagggagtccctggagatgaaggtaggaggaggagaagagaagggtactgagagagaggggagctgcacccagtttctcagatatactgctgagaagaatacctgtggatgcatctaatatcaaatgcatcctcagcccagattctcacaccacaagtctggcacaaggcagccaagagtcaccaaaccacgatggcttggaagaacaggaacgatatgccaacaactgatgaaatatgagaagggacaccccacacacatgcgcgcactatcctgaatgaccatatactaggcaatttaggcacctgcctgaaattacagtatattctgagaaagcaaggacccatgatgaaacccaagatgcactaaggctacctctttttttccccaccagcaagacaaaatggcaacacagagtcagaaattaggtttctaggaagcagctgcacttcttgcactcttgattatatagactgacactcatacttgccacatacatattgagaacctactgtgtacagggcatcctgctaggttaagctgaggtgggaaatacaaaagtcaattaaatcatggttagccaagacatttatatagtcaggtaagagcaaatatgcataagtgtagttaaccatttattgcacacgacttgtgtgcacaccttgtgctacactctttgtaaatgaatctcatttaattgaatcttcccacaatgggcttttgatattcagacgttcagagcaggcaagagacttgcccaatgagccaaagtctgggctctttacagttaggtacaatctggttcatgtacaactaccactaatgcacagctagtcagtggtggaaactggacatgaaccagagtggtcctcaccgcaaggcccactttcattgtcaaagttatgacttcgtcccatggggaggtcaacttgagtgctgccctttgataatccaacatccactgggcctagactttggctcactttttctaagagttgggatggagttaagtcaaaccaaccttctctaacttggtgtttaatgtacctattggcaggtgactggccagaagcctgaggttaaacaggatacactggccagactggacctcatgattagggaacccatgaccttgactgtatctgccaaagggtgccaaccagttcctctgaacagtcaggatttctagtaccattcacaccatctatacgtacatcaaagaagtgacataaatgatttggggagtgggggtgggaaatacttttgtttctatgtccaaaaggaataatttgattatacaagaataatggaaattttcttataggaaaaaaatgtcatagagctgttttgctttgagatgaaggcatgcaatttggtgcctaagaaagcatttaaaattcttgcctgcagcttcctagaaacagtaaaaggaaaatacgttgatcctggccaatgaaatgtgaacagtttttccttaagtattaatctactgaacaaatgttgataatgaaagaagtaggcatataaatgctgtgagagaaccatgatttatgtattttctactgctgcttctgctatttgagcctgggaaaatgactaaaccaaatctcaagagcagcattttgcaccgtagatagaaacagaaaacagaaaattttaagttataaggaattaataatgtctcttcttttgtgtccttttctgaaaaataaatctctccccatttgggagacataatcacttaacttccatttccttatacctaaactcaacttcagagcccaggaccctcagaaatcatttggtccaacgtcccatttcataaatggacacatttgagattccaagaggttaagtgacttgtcgaacaccatgtgctcattagaataaaaaatatgaagatttaaagtggaaggtagtgacctaggagtgggaggacctgggttctccctcccactcagctattcatgagcttctctgtttgtaaaattcaagtgttaggattagatggttttgaaaaatccttccctctcgaaaggggttataattctgtgcccgggagcatcagtagtttgtgtatgttagtttactgcttttataaactcaaaagctttcttcacagttataacaaagaggcagtgtttgtggagatcatgaggatggactctaaacacagagttcctcagctgggtgtggtggctcacgcctgtaatcccagcactttgggaggctgaggtgggaggatcacttgagcccaggagttctagaccagcctgggaaacatagggagaccccatctctacaaataattggtttttttttttttttgagacggagtctcgctctgttgcccaggctgaagtgcagtgacacgatttcggctcactgcaagctccgcctcccgggttcatgccattctcctgcctcagcctcctgagtagctgggactacaggcgcctgccaccatgcccagctaattttttgcattttaatagagacggggtttcaccgtgttagccaggatagtctcgatctcctgacctcatgatccacccgcctcggcctcccaaagtgctgggattacaggtgtgagccaccgcatccggcctctacaaataattttttaaaaattagcggggcatggtggtataagcctgtggtcccagctactcaggaggctgagataggaggacggcctgagcctgggaggttgaggctgcagtgagccatgatgatgccactgactccagcctaggtgacagagtgagaccctgtttcaaaataaataaagtcagacttccagctcttacacttacttgaaagtaagtgtaaagtaagtgtaagtggtgaaagcgtgaacaaattaacccttctgcctcctctgcaaaatgaagacagtaacagcacataccacatctggccattacaatgattacattaaataacacatgtcgagaatttagcacaatgcttggcatacggcaagtgctcagtaaaaggtggctgccattagtattaccataaagcaaccagagttggtgaatttgtgtgggttattaagaaggcattccctcctctgggcagaggcagcccaagcgctaagggccacagcaaggcaggatcgaattctctacagccatgggtctaactttaaacaaagaaataagaaaccatttcctaccctcccttgctcaagtgctcactctcaattgatagccaatgatatgtttaagtgtttgtttataatgtagggcttctagaaagctcttcctacttagatggctggaatattgctgctcttttcccttttcttctttctgcctggaatgaagaaatgatggctggggcgtcggcagcctactgtgatcatgagggaagggctaaaagattttcagagattcagtccttgagccaataaatcaatgtcagcaactactgacctccaaacttcttctttcacgaggaaaataaactcatgtacacgttttttgctactagtatcaaactgcaattcctaacccatacaccctccaaaatctattttctatcaacatacatttacagatgtgcctggtcagccacttgctgctggccacttaggagtcccaagtcaggtgctcaatagttgattttcttgaaaaatcacttagatttttaaaaaaatatccaaactgtccccaagggccttactattcaaagtaaggtcagcagaccaacagcattagtctcaccccggagcttgttagaaatgcagaacctccggccccattccagaactactaaatcagaatcttcattttaacagggtccccagtgatttctgcacatagtgaagtttgaggctctggactaggtttaccggctctgctctgtcatccctcctcaacactgctgccagaataatgttcctggagcacacctagtcatgtcgctccccttctcaaaagatttcaagggctcctgactgcctgcagactaaagtttcgacttcttagcctgatcattaaggccctctatgatcttgcactatcctgaaaatgcccatcaaggtgcctgccttgcatgtaatcagtaggcaacaaataattttctgcacagaagaaaaaacaaatgagtgtgggtgagaaacaatgcgttgcttaattctggctttaccatgctaagcactggggatgcagtggtaccaaaaaccaggcatgatcccttgccttcaaagagcttagagcctagttagaagagcatgatttttaaaaagaaatgaaagtatataatgacaaattataagtgctaagaaggaaatgactagagggcagggatacagagtaaaacagacgggttagaaggaggccctacggagagggagcctgttgtggggctggtccaggcagaggtaccagcacatgcaaggtcctgcgagacaaatgcggtgtgtctgagaatcataacaggggctgccctttcaggcttacccagaaaatagatatcctgggaggaaggtggcatagggttcaccttccaagtcacttaaagatgaaatgctgcatttcttttccctgatataggtccttcaccgggatcacggatgagttagcgagcaggggatgctgcggagtcgctgtgagtccagcactggaaatcagaccaagcgaaatttgaatcccagctccgctacttcccggctctcaactcccttgacctccaagcctctgcttcctgaggtataaagtgggattaaggatggcaacaacttcgtgattactgttgagggagataatgcttgccaagctccccagcacactgccacccacatcagtgcgcacctgagtatcagcggttttaggattacgatgactattactatcgtaaattactcccagctttcgggcagaaggctcattccagatattcctgtcccctctgaggcctcccgaccctgccagcccaggcaacctcccccgcgcacggccaccgtgaccccagcgcgggcgccgccgccggacccccgttacctggggccaaacgcgacttgtcgccaccttgcgtcctgggccctgcctccctcccggccgcctcccgaccccgcggctgctgcggaggcgcccccagcccagccgggcccaggcggtgcgggatgcctcggcggggctggcggcggcggccgcgctgcgcgctccggcggaggggagggggctccgcggcggcggcggcggcggcggcagcggcggcagcggcggcggcgggcccggcggggggcagagccaagaggcgcggcggcagcagcggaggagtaggaggagacggaggaggatgcggggggctgcggacggtggcgaggccctgtccgcagtgaagcccgcggcgcctagggcgcagggagtggccgcctcctcctgcgcgcaccattcctgagatggcggcggcggcacagcggcggctcggggagcccaggaggggccggccgggagcgggctgagccccgcaggacggggagctcgcccagggccggcggagcggcggagctcgggccgggcggcctgcgggagcggcgaggcaggggacggccccggggcggagcgcacggcctggtgaggccgcgatggcgaacgcgagcgagccgggtggcagcggcggcggcgaggcggccgccctgggcctcaagctggccacgctcagcctgctgctgtgcgtgagcctagcgggcaacgtgctgttcgcgctgctgatcgtgcgggagcgcagcctgcaccgcgccccgtactacctgctgctcgacctgtgcctggccgacgggctgcgcgcgctcgcctgcctcccggccgtcatgctggcggcgcggcgtgcggcggccgcggcgggggcgccgccgggcgcgctgggctgcaagctgctcgccttcctggccgcgctcttctgcttccacgccgccttcctgctgctgggcgtgggcgtcacccgctacctggccatcgcgcaccaccgcttctatgcagagcgcctggccggctggccgtgcgccgccatgctggtgtgcgccgcctgggcgctggcgctggccgcggccttcccgccagtgctggacggcggtggcgacgacgaggacgcgccgtgcgccctggagcagcggcccgacggcgcccccggcgcgctgggcttcctgctgctgctggccgtggtggtgggcgccacgcacctcgtctacctccgcctgctcttcttcatccacgaccgccgcaagatgcggcccgcgcgcctggtgcccgccgtcagccacgactggaccttccacggcccgggcgccaccggccaggcggccgccaactggacggcgggcttcggccgcgggcccacgccgcccgcgcttgtgggcatccggcccgcagggccgggccgcggcgcgcgccgcctcctcgtgctggaagaattcaagacggagaagaggctgtgcaagatgttctacgccgtcacgctgctcttcctgctcctctgggggccctacgtcgtggccagctacctgcgggtcctggtgcggcccggcgccgtcccccaggcctacctgacggcctccgtgtggctgaccttcgcgcaggccggcatcaaccccgtcgtgtgcttcctcttcaacagggagctgagggactgcttcagggcccagttcccctgctgccagagcccccggaccacccaggcgacccatccctgcgacctgaaaggcattggtttatgagggaggccccgccacatagacccccaacccagcctttccctttggctcggacggtgacgttgtatcttttccttctggcccctgtttaattttctaagctgccttcaaaatgactcgaagtggacagacacttggattgtactgactcctttgggggtggggtgggtgaggagtaggatgctcagcccactccagctccgcacattcgtcctcctaactcgactttcttcctgacaataggccctgcagtctttttgtagcggtactgacgtcttttattccatgtgtggttcctttttttctttttctataaaggctgtactaattttcttcatgcaacgtttcctaaagaccatggccagttttctacagaagctatttttgacaacctcaagtggcattacattttgcagtgaagtagaggaacctagggggacttcttcacaagttagatttcttgaggatcttctgttggaagcaggagaaagtggggggtggggggaagttgtccgaaatgccctctgaattgccggctgcagggtccttgtgctgcgctggttctttgaaagtctcagtgttgatattgaacttaaagagcagagatggagatcagtagcaaggcagtcatttttttaaagcagtaagtaacaagtaagatttggttcccggtttactttctgctgctaaaaaccacgtcagtgacaactgctctctgtattatagcaatcttgaatggaaacatttctgtcaagttgtaagttttaaaagagtaaagtgttttggttagtaatgatgtggagaaaaatacagtattgcatgtgttcgtgtgtatagattgtggttcgaggattgggagggctctgagaagcagagtactacatcaaaattgttttaagtattttttgccaataaaaaattaattttatggaaatggcttgtgctttgagaagcccagttttattctgtcttatgaaactaatttccactttgaaaattgttcttctgttgtttatggtataaatgaatggaatataatgatatcctccttctaggaaacaaagcatttccttaaaatgtttgctaggttaagctgtgctgttctactgatggttgttttaaattaataatgagaactataatttaaataatatttctttgttagacattataatgttaaactgaaagactaaattctgcaagtactatataatatttttggcttataatgctacatttttattaatgtaccttccgttttgaggatttatatctgtatttctctttgcattatacaaatataccagtattttcattctggagtggttgttttgttgtggtggtggtggtgtttgaggctgtaataatacatgcgtcgaagtatgttacatgcctctaagtatgttatgtaaggataacatgctctatgatccttttagcacgtgttcttcagttacaggtttcatagtttgaccatcagcatatccaagaaaagtggaggcttaatttaaaatgcaagataaaatctgcgaaacttttctttaaagggaagaagcagtagacatatatacggctttaaaactgtttttttatttggatgacaacatttcaatgactattcgttaaatgacataaaaaagcttttaagtaaacatatcaaactcaagtacaagcgatcattttgataaaagtactaggtaaaagtgggggtggtagattatattgaaatttagctgagtataatataaactattaaatgttcagtccaatgggaataagttataaaaagagtgtggccaatttaattgatctctggtaaataggctgcatgattttattttgttgtggaagttaatcagtctgtgaagacagtctcacacttggaaaatatgagacagttaccctatttctccccacatcatgaatccaggttggcctcaatcatccaagggccactgatcggaaacctcagccaaccccaagatagaggagcccagaagtacctctctcctcatctaaccctccacctgcccaagtgatctcagttccaaatagaggtcgaaccagtctacgatggctcatgcctgtaaccccagaactttgggaggccgaggcaggagaattgcttgagaccaggagtttgaggccagcctaagcaacatagcgagaccatgtctctacaaaaaatcaaaaaattagctgggtgtggtaatgtgcacctgtggtcacagctactggggaggctgaggtgagaggatggcttaagcccatgaggtcaaggctgcagtgagccatgactgtgccatggcactgtagcctggatgacagagctctcgagaccctgtctcaaaaaagcccccaaaacagagatcaccaagtctctgtgattttcccacctggcatggcacaggaaccagcccatcatggctgactcctgagccactccagctttgggcagcagctcagctgcaccagaggtgacgtgttggcctgacatagccttgaattcaagggatattttgtcatatgagaattcataagccagaggttctcaaattctaacattcatacaaattaagtgtctgtgtgatccagagtcttatgaggacatgttgagttgggtcctggggaaaagcatttcaacaggttcctcaggtggttggagacagacctccaggacttcgttcagacatgatttacttcagacatgatgcgttcaaacttggctacctgggttttttatttttatgttttaaagttctgattagatgggggaaggcaagatttctagtgagtgtgcaggtgagagtagcaagaaataacagccaactaaaggaaacgagaaccaaaagagccagagaaacaagctatgtagcagaaagtggggaggtgcaaagggccaccccaacagcttttaggattggtgaatctattaacatgtactttgatagttaattacattaatcaaaaattataaaaaaaaaaaaaaggttagttgtgtccacagtactctacttattgtaccagcacaggcaccatgtatttagggaagatttcattaaaattgctcattttatttatttgggaagttaatttagcacaacttccccaccctcccacgcagttgtcactatacttgaagcaatgtaggcttcccgtacatagatctttgtctgtatgttctagcatggaattgctgggtcaaaagaagcatttttaggacttttgatatcttgtcaaatagttttgtagaaggaccatatgtctatatgtctgtttaaatgtacagtacacctgacatattctttttttttcttttgagacagagtctcgctctgttgcccagcttggattgcagtggcgtgatctcagctcactgcaacctccacctttgggttcaagtagctgggattacagctcagcctcccaagtagctgggattacaggcgcctgccaccaggcccaactaatttttgtatttttagcagagacagggtttcgctatgtcggccaggctggtctctaactgttggcctcaagtggtttaccagccttggcctcccaaagtgctgagattacaggtgtgacacattcattttttaaatgaaatattttaagcaaagtggggaagcatgtaacaaatcagtaacaacagtgataatctctgtgtccactactcagccttaccaaatgccatattggtttctactcttccttttctcttttcccttccttccttctttcttccttccttccctccctcccttttttctctttcttttttaaaaagaaataaaacggcaaaattatttctccgaagtctttgttctcaccatcagccctctacattctcaaatgccctgctccctaacaggtgacagggtgccaagtcctagggctgactcagggttattgttttgcaggtggatcactgggttgatgagatagagtccaccctgttttcccaaggcctacaggatggaggagaaacctctttgtctgccacagacctttcacagtcaggccctctaccaccctggcctcatccttcccttgtattctcatctctcccttcttggattactcttataccagctctccactcttcccggaaagcccattcccacctttctgcctgacaattcctcaccaactcctctagagcaggggtgtaaattcacaatatttaacaactggaatggcacaggcataactaatctataccactgtacctccaagttctggctgaacattggatcttggatccaggtccaaggcttctggaaacccttcttggctcagtcatgcctcctctgggctcccagagtgcatggtttacctccttgaagtctgcactcctgcgtctggtgcatcccatcagctgctgctccctctccagtctcacttcctcccactctctcctcaggccgtgtgacatgcttcaggcactcctagttgccagcagtgcctgaacagaccacgccacgtcacaccaccatgcctttgcgtacagtgttcctcatggccaaagcccttgctccttgtcccccctcaactgcctcttaaactttcagacataaagagataactaaacataaagagtgaattcctagcctctacagaaagagggtgatggtcctggggcaggccctacaagattttcaaggctccaaactaagtcattagatccgagcacacagctggctaagtggcagacttattgtcttactggtattttaggttttctgtgtgcaccgaggtggctggggttataaaatgcagctgacccaagatactgttcttcagatgtgcaccctgtgtgggctgccaagaccactgaacttcaggaccctctctccctgaggggcaagggaggcaatgggaaaccacctccacccatccacatccgagtcctattagctgcttcaggagtaaatataagtaaaagcaaacttaatctgacgccaaggggttctttatgcttctcccccagctgggacgagacttttgaggcctaactcagcccataaagagaactctttttccttccctctttactccttttggggtgataggatgtgatgcttggagccacaacagccatccttcaaccatgaggggagacactgtcaagacagtgaagatagcagaacagaaagataaaaagtgcaggcacccattttaacattcttgagttgcttaattagattagcaacctcctatctctagacttctggttttgaaattaaaactacttttgtttcagccattagtagtcaggaagcttgttagttggagtgacaagaaactgcaacaatacttgaaactactgcatctccttgacccctttgctaggtgtgcctgatattctagagctgcatccacaatttttttaaaaatttggcttattaatatttttcaactctctgattgttctgcctgctgctgttaaattaacctggttctagaaaaatgagatatatttggcatgatttcttaaactgaaataagtccagaagattaaaaagatacctattactaggtcagttctgtttaattgcactttatgatacttttttttttttttttttttttgagatggagtctcactcttgtcgctcaggctggaatgcaatggtgcgattttggctcactgcaaccgtcgcctcccaggttcaagcgattctcctgcctcagcctcccgagtagctgggattacaggcacctgtcattatgcccagctaatttttgtatttttagtagagacgcggtttcaccatgttggccaggctggtctccaactcctgacctcaggtgatcccgccacagcctcccaaagtgctgggattacaggtgtgagccaccgcactgggcctttttttttgtttgtttgtttttttggacagagtcttgctctgccgcccgggctagagtacagcggcatgatcttggctcgctgcaagctccacccactgagcttaattgatgctcccacctcagcctcccaagttgctgggactacaggtgtgtgccaccactcccggctaatttttgtatttttagtatagacaggcttgtcttaaattcctggcctcaaatgatctgcctgcctcagcttcccaaagtgctggaattacaggcatgagccaccatgcctggtctatgatacctttttgatccactcatgtttattcgtttgtttgtttgtttgtttgtttatttgagacgaggtctcactctgtctctgaggctagagtgcagtggcaccatcatagctcaatgcagcctccaattcctggactcaagtgatcctcctgcttcagcctcctgagtagctgggcccacaggcatgtgctaccactcctggataattaaaaaaatttttctggagagatggtgtatctgtttcccagactgggctaacttctggcctcaagtgatcctcctgctttgatctcccaaagtgctaggattacaggtgtgagtcatcatacctggaccaaacttttttgatatcataaatctaattacaggaatctggaaaaccacctgaataaatccatctaaccaatagatattgaaagctaataagaagccagtttctgtgttgggcagtggagaaggacacagggataaggaaggggcagcactcttgctaaagagatagcagttgcggcagctcatgcctgtaattccagcactttgggaggccgaggcaggcagatcacttgaggccaggagtttgagacaacctggccagcatggcaaaaccccatctctactagaaatacaaaaattagttgggcatggtggtgcatgcctgtagtcccagctactcaggaggctgacgtgggaggatcaattaagcccaggaggtggaggttgtagtgagctgtgatcatgccactgtactctagcctgggtaacagagtgagactccatctcggaaaacaaaagagttagcaggctaattgggaaaacttggcaaatgtacccaaaaccataaagcaaggcagaacatggtagatgccaaaagagggatctagataaagagctcgggaatactgaagagatcagacatcatcgttgattgtccagaaggagccctaggcgttctatctctggttactcaatggagggaaaaagaaacacccgaagactgaaacagaaattgtccagtttccatctctccctcctcctgggttcttacatttctttctgacttcctctgcactctccacactctggaatccatcttccaaaatacatttctctgagcgaaataaaaccacataattccctcttcaaaggtttttcttccaattctatccaaatgttcaagtgccagtaaggaatgtggccattttattggaggaagtttgttacataaaatcatgctgtgaggagagccagcaaagacgccgttgaccagaaatgtcagaactgaatagaaatcaaacaggtagccccgaaaagtgccactccaataccctcccaaaggagggatgggggaaatggcaggtttacactacagaaaagggtattttgtgctttcatttaggagaaaagagggcagggaaaaggctcagtaggtacccaaccaactctgtatcctagtcggagaatataagataaataaacagctcaaattttatatgtgaaagcctgaagttttgaagtcatttcaaattacacagagaaatcatgaaaaaaaaacattttaagttgcaatgccaaggcataaatgcaatatttgtatttctcagttacatttaggagacagataaattaaagctatcattacttggcttctaggagaaataacttatttataaattaagttttaagtggccagcccactctaggtggaaagcatgtaaactgttggaaaagtgtatatttaaacatttccctgataaatgcatattatctgaactatgccaatctgcctgccaaatctgcccagctttgtgggatggaaatcttattttctgccagaaaatgatatctgagaagcctacattgttttttggtttgaacctggagggaacagtaaagggtttcgttttcttgaagatacagaagtattctaattttgaagggctttgaaatagtatttacatttcaatgccacctaatacatgtcttattaaaaaaattctataggaatcattaagcttaaagtgcatgagatgaaactttttcttcttttaatttaacagatttatttttcccttttattccttataaattctccatatatttcctgaatattgaccaacgtgtatggcaatgtcctgcacagaggagaaagagaagagacaggaaaaaaccccttacaggaactcattctgcaaagtgacagaaggagcgtaaatgtacagtgtgtaattcttttaacccacagtcacgatgagtttaatttgcatatctgtcttgaggaattatgg

SEQ ID NO: 1248 - DNA, 67073 bp, Homo sapiens
aacaaaaaaacaaaaacaaaaattagccgggcatggtggcgcacgtctgtaacccagccactcgggaggctgaggcagaagactcacttgagcccaggaggtggaggttgcagtgacccaggatcctgccactgctctccagcctgggtgacagagtgagactccatctcaaaaaaattttaaaaatattggctaggcgcagtggctcacgcctgtaatcccagcactttgggaggccgaggcgggcggatcacgaggtcaggagatcaagaccatcctggctaacacggtgaaaccccatctctactaaaaatacaaaaattagccaggcatggtggcaggcgcctgtggtcccagctactcgggaggctgaggcaggagaatggcgtgaacccgggaggcagagcttgcagtgagccaagatcgcgccactgcactccagcctgggcaacagagcaagactctgtctcagaaaaaaaaaaaaaaaaagatcaaatgtttagccaaccaaaattagtttaaattatacaacccgaccccagccaataaaaaagggtacaaaaacaaaacttgcatcaaaaataaaggctctcgtgcccctttgttcaagtatactcataacaactggccaaaaaaacacccccctgcacaaaaataaattactttgctaaaaattcttcgttcaagtgttcaatttccttaaaattttaagcgttattcctaacagtttgcactcctatgagaatctaatgccgctgctgatcttacaggaggctccagtgatggggagcggctgtaaatacagatgaagctttgctgcctgcctgctcactgcctgcctgctcacctcctgctctgcggcccagttcctaacaggccacagacaggtaccagtctatggcccagatgatgcagacccctgtcttaaacaaaaacaaaaaaccaaagcacacttaatgtgagatctactctcttagcaaaatttttgtttttgttgtcgttgacacggagcctcattctgttgcccaggctggagtgcagtggcgcgatctcggcttactgcaacctccttctcccgggttccagcgattctcctgcctcagcctcccgagtaactgggattataggcaaccaccaccacgcctggctaatttttgtatttttagtagagatggggtttccccatgttggtcaggctggtcttgaactcctgaccttgggtgatccacccacctcggcctcccaaagtgctggggttacaggcgtgagccaccgtgcccggctactgtgatgtgattattatacatcgtatgcctgtatcaacatatgtcctgtagaccataagtatatacacctactacgtacccactaaaattaaaaataggcagggcacggtggctcacacctgtaatcccagtactttgggaggattgcttgaacccaggagttcgagaatagcctgggcaacacagtgaaactccgtctctacaaaaaaaaaacacaaaaaaattagccaggtgtggtagagagtggctgttggtcccagctactcaggaggctgaggtgggaggattgcttgagcccaggagtgagaggctgcagtgattgcaccactgcactccaggtaactaaagtacaatggggccgggtgtggtggcccttgcctgtaatcccagcactttgggaggctaaggtgggtggatcgcttgacgtcaggagttcaaggccagcctggccaacatggttaaaacgtgtctctactaaaaatacaaaaattagccgggtgtggtggcgggtgtccgtagtcccagctactcgggaggctgagtcaggagaatcacttgaacctggaaagcggaggttgcagtaagcttagatcgcaccactgcactccagcctcagcaacagagagagactccgtctcaaaaaacaaaaatagaggccaggcacagtggctcacgcctgtaatcccagcacgttgggaggctgaggcgggtggatcaagaggtcaggagatcaagaccatcgtggctaacacggtgaaaccccgtctttactaaaaacacaaaaaattagctgggcgtagtggcgggcacctgtagtcccagctactcgggaggctgaggcaggagaatggcatgaacccgggaggcggagcttgcagtgagccaagatcgcaccactgcactccagcctgggtaacagagtgagactctgtctcaaataaaaataaataagtaaaataaaagtataaataaataaataaatacattacaatgaggttattagggtatgagccctaatccagaaaaaccggtgtccttataagaagcagagattgggccgggtgcggtggctcacgtctgcaatcccagcactttgggaggctgaggcgggcgtatcactgaggttgggagttcgagaccagcctgagcaacacggagaaaccctgtctctactaaaaatacaaaattagctgggcgtggtggctcacgcctgtaatcccagctactcaggagtctgaggcaggagaattgcttgaactcaggaggcggaggttgcagtgagctgagatcgtgccattgcactccagcctgggtaacaagaggaaaactccatctcaaaaacaaacaaaacaaacaaatgaacaaacgaagcagagatcagccgggtgcggtggctcaaacttgtaatcccagcactttgggaggctgaggtgggcggatcacaaggtcaggagtacaagaccagcctggccaacatagtgaaaccccatctctactaaaagtacaaaaattagccgggcgtggtggcgggcgcctgtagtcccagctattctggaggctgaggcaggagaatcacttgaacctgggatatgtaggttgcagtgagccaagatcacgccactgcactccagctcgggtgacagagtgagactttgtcccctctgcaaaaaaggaagtggagattaggacacagatacacacagagggatgactgtgggaagacacgagaagacggccatctgcaagccaaggagagaggcctcagaagaaagagaccctgctgtcaccttgatctcaaacttccagcctccaggactgtgaggcaatgcatttctactacttaagccacgcggtctgggtgctctgttacctgcaggccgagcaaaccaatgcaggtgcccctcagcctcttccctctggctcccagcccccacccactcgcattggctgttgcgtgcaggcctctgccatctgtctgccttctgtctggcttcctttccacttctgtaccttctacccagcggactcctccatctccggttctccttctcgaggtataattatagctgctggcactagtgcctgtctcctctgtgccaaagtgtgttcctggccatcagaggccgtatcttattaacaccaacccggtaaccctgggaggcaggagctatcattagctctcttataccaaagcgatgcagcacccaaggcttccagagaggaagggggatgcccagggccacgcagctagcatgtaaaagataatctgtcacctgggcatggtggcacatgcctgtggtcccagctactcaggaagctgaagtgggaggagtgattgagcccaggcgttcgaggctacagtgggctgtgattgcaccatcgcactccagcctaggcgacagagggagaccctgtctcaaaaattaaaatagaagcccggcacggtggctcacgcctgtaatcccagcactttgggaggccgaggcaggtggatcacgaggtcaggagttcaagagcagcctggccaagatggtgaaaccccgtctctactaaaaatacaaaaattagctgggcgtggtggtgggtgcctgtagtcccagctcctcaggaggctgaggcagagaattgcttgaacccaggtggcggaggttgcagtgagccgagtttgtgacactgcattccagcctgggcaacagagtgagactgcgtgtcaaaaaaaaaaaaaaaaaaaagaattaaaatacagtaataaaataaaataaatagcagggtgtggtggcatatacctgtagtcccacgtactcaggaggctgaggtaggaggatcgcttgagcccgggaagtcaaggctgcagtgagctatgatgctgtccactctagcctgggtgacacagtgtgagacactgtctctaaaaaaattcaaaacgggctgtggccaaggcatcatttcctcctgcctggattcccgactttccggaggcccttagccctaccggggcagttcgggcatctctcctgagaggtcccaggtccattacaggctatttccacggtctcgacatccccagctctttgacgctggccactggccggccacgggctgtgggttgggggatccgtggctttcgctgaggacccgcaggcctgtctccatgaggcttgacttgatagaaactggcactggggcctgtcctgtcatacctccccttgtcaactgccccttcctaggtgcacccttcccccaatctcttatcctaggttctgtcaactggaaaggagcctgattcagtggccttgcccaggcctgcttcctctcctcccaccatgcgctggctctctcagctgcaatttcctctccttacccatgccccactcactccacgggccctcggccagctgccattccattcctcctacctctcctcctccacctcctcctccctctccttctcctcctcccccttctctctctcctcctcctcttcctccctctcctcctcctctctcctattcttcctccctcacctccttccccctcctcctccccctcctctcctcctcctcctccccctcctccccctcctctcctcctcctccttctcctcctcttcctccctctcctccttccccctcctcctccccctccccctcctctcctccttctccccctccttcctctcatccccctcctccctctcctccttccccctcctcctccttctctcctccccctcccctctccttcctctcctccccctcctccccatcctcctcttcctcttcctccaccatcccccagcattaacatccctcactgtaagaaaaccaaacagacaaaatgccatccttgcaatgaaggtgaaaggccacggtctacaagaagtcctaagatgaactgaaaaattctgagcggagactcgattgcatcaggtatttgggagagaattccccagccaggccttcagcagctaccgggagggaccctggggggaggaggctgccctggaggcggagggagtgcaggggaggttggcaggtgctcaagggcccccggcttgggttaatgctttctgttgccattttgaaattctttttctttttttgagacggaattttgctctgtcacccaggctggagtgcagtggtgcgatcttggctcattgcaacctctgcctctcaggttcaagtgattctcctgcctcagcctctcgagtagctgggattacaggcgcacgccaccagcctcccaagtagctgggattacaggcgcacaccaccacgcccagctaaatctttgtatttttagtagagaccaggtttcaccatgttggccaggctggtcttgaactcctgacctcatgatccacctgccttggcctcccaaagtgctgggattacaggcgtgagccaccacgcccagtaacaattttgaaattcttagtcatcttcgaccaacaggccctgcacatttttcctttccttttttttcttttctagctgattgcagcctcgaactcctgggctcaagtgatcctgttacctcagcctcccaagtagctgggaatacaggtgcatgtcaccactcccggcctttttttttttctttgagagagagtcttgttcttgttgcccaggctggaatgcaatggcgtgaactcgactcactgcaacctctgcctcccgagttcaagcgattctcctgcctcagcctcccaggtagctggggtttcaggcgcccgccaccacgctcggctaatttttgtatttttagtagagacggggtttcactatgttggccaggctggtcttgaactcctgacctcaggtgatctgcccatctcagcctcccaaagtgctgggattacaggcgtgagccactgtgcctggcttttttttttttttttttttaatagcgtcttgctctgtcacccaggctggagtgcagtgacatgatctgggctcactgcaccctccacctcccaggtttaagcgattctcctgcctcagcctcccaagtagctgggactacaggcacacaccaccacgcccagctaatttttgtatttttagtagagacagggtttcaccatgttgggcaggctggtctcgaactcctgacctcgggtgatctgcccacctcagcctcccaaagtgctgggattacaggtgtgaaccattgtgcccggcctcatttttacattttttatagagataggctctcatgatgttgcccaggctggttttgaactcctgagctcaggcgatcctccctcctcataccagttctcaggacaggttgctgagaactcctcaggctctgaggacactgaggtgggagggaaaccgcgctctccctgccccttgccccccagcgaaaacactctcatgtcagaactcggctattactaaacacaaacagtggttctccggacaacgcaggtgtctaggtttctccttctcttccagaaatccttttaaattgtgctaagaaattactgaggttgaaagacacacacaaagcccagggaaaaaaggatgcaggcctcagacccttgaccttgaagggagcaatggaaatagcccccccccagaggcgggggtccagaggggactggtggaactcgaacgtcccccacaacacacagggccctggcttggggctgggcctctcgggctctgaattctggggtgaggcggggatcgggagccgtctcttctccttggaggagctcggggggtggatttccttgcttggttgggggtggccgcaaggcctgtggtgagagcatggggggtgtccaggccccctggtgtctgatcctgagcccctgagccctgtctacccctgcaggtcatgcaggcagtactcagcctcctacccaccctcaactttccatccatgtctaaaccctgaaacagatagttcagaggcacaaaactaagggggcggccgaaagccaggatgctctacgccaaactaagaaaataatcaccagcacagcgtgttttccaatccgccaagttctgctgtgtcatctgtgaaataggtgcatgaacggtaaagtactgtgtaacgcaaaaagctaacattcactattgggtccttcctgttccaacgtcactcccttaagggccctgcccctgctgcccagagcgtccaggcattcagcacccctactgtgtggggcaggcgtgcccggtctgttctccctgctgcccagtgggtgggcccttctgggtggagtagaacatgtttaagcccttaacctgggaccagcgctccctcgtccacagggctgctgtgggacgtcaagatggtttcctggccaggtgaggtgggtggctcacacctgtgatcccagcactttgggaggccgaggtgggacaatcacctgagatcaggagttcgggaccagcctggccaatatggtgaaccccatctctactaaaaagacaaacaattagccgggcgtggtggtgtgcgcttgtaatcccagctactcgggaggctgaggcaggagaattgcttgaactggggaggtggaggttgcagtgagttgagatcgcgccactgaagtccagcctgggcgacagggcaagactccatctcaaaaaaaaaaaaaaaaaaaaaaaaaggcttcctgaagttgttgtggcagaggatcagggacagcagagggtgagattcgctgcgctcccccccaccccaataaaaacactctcatgtcacagcttggctctcgtatgactaaacacaaaccgtggttctccagacaacgcaggcatctgtttctccttctcttccagaaatccttttaaattgtgctaagaaattactgaggttgaaacacacacacgcaaaacccaaggacaaaaggatgcatgcctcagacccttgaccttgaagggagcaatgaaactagtccccatagaggcaggggtctggagaggtctggtggaacgcaagtgttgcctgccatgcacaggcgcctcactgggcctcttgggctctgaattctggggtgaggcagggatggaagccatccctggagcagaggtggagatgggggctgtcaggtttcattaaggttcgtcccacacaggggactcttctaaacttcttgcttctcacggtgagtctgacactggcgtcaccagggagaaatacaggttctcaggccaggcgccgtggctcacgcctgtactcccagcactttgggaggctgaggagggcagatcacctgaggtcaggagtttgaggccagcctggccaacatggtgaaaccccgtctctactaaaaatacaaaaattagccaggtggcgtgggcctgtaatcccagttgctcgggtggctgaagcagaattgcttgagcccagaaggtggaggttgtagtgagccgagatcgcggcagtgcactccagcctgggcaacagagcgagactctgtcaagaaagaaaagaaagaaagagagagagagagaaagagagaaagagagaaagagagaaagaaagaaagaaagaaagaaagaaagaaggaaggaaggaaggaaggaaggaaggaaggaaggaaggaagaaaggaaagaaagaaagaaagaaatgcagattcccaggcccacaccagacctgcagaagacgaatctgctttgaaatgatgctcccccatgggaggcagatgcattcttaagtttgggaggcgcagacgcccggaccctttctcctgggttcacaggtggggcggtcaggagatccattagcctgagccagtggagctgcccagaggccgcaggagccccagctgtcggcccctggggtctgaacacctgggggatggccccgagcgctgtcagggctctggctggagcacagccctggccctttggccccaggtggtgtcagacaacatgggtttttcctggaagccgagggatcatttagtcacgtctggaagagaaggtgatgaacacagacccacaagacacacaagcaatagagaaactagcaacttgaaaacgggctccgtaaatgctttccgagagaccgggctgcgggcccatgttagctcagctctctgggtgctgggcgcgaccatccagtccttggctgattcttggtagcaactgtcaccatccctacttgatctcattttcctgaggatctggagggggtgggcagcgtggacccatttcacagagggtagagcggagactcaagagagccagggactttcccctgggtggcacgctggggagtggtgtcagagccaggatttgaacctggactctctgaccttgagacccctaaccattcccatcccaaaggagacaaaggagatcagtctcacggaggggacactgaggatggccccagggctcgggagtgactatggttccacatacagacgagggaagaggcaggatccccgggtcactgttgggggagcactggtgtgggaagcagatggaggggggccatacccaggggccactcggtgggcccactgacctgtgaacctggagaagaggggcatctgggtgggagctgaagggccgtgggtcagccagcacagggcacacccgaactgggtgtcccctcgtgggctcccgggacctggcacaggcttacctcggagggaagaggtccccatccctggcactctattactgggctgtgggctgctcacaagtcatacaccatcacccctacaccagcacatcgcaatgatcccacttcatttattaccaaaatatcacagaattccagtcatagttaacatacagcgtttaacacgaacctgatacctgtagaaagaactgagtatcgggacaattgagtcgttggaactgtaagccacgccccaaaccgcatcactccgtacttcaaaaatacgattttttgagagctttggaaactgaattaaaatgtctacacagctatgaacaattgtttaataaaactttttcatgtttccattacatgtaaatatatcaatttggcatctctataaaaactctgaaaatggtgcaaaagtttcattctctttgagaaagccattgacaaaaaatattcacacttcactaaaattttgaaaaatggtcttctttcaaagcttctttattaatctgaagtcttctgggttatcaaaatctaggtttgctttttcctcctaaaacactaaagaacatttattcacaaggattaaaaaaaaaaaataaaaaggcaatgggctgatggaaaactgataagggcttttctttttttttttctgaaaataatttaaaaagcttaaaagttacataggcatcttcaaaagaacacaatgggattcattttattgttgacttttggacaccagtgtcagactttattgaaaacaaacccatgtaaaaacaaagttaaaatgaaaaatggcacctgaaaaataaattattttatataaaacaaatcaataacttaaaacacactaatatacaaaaggtctaaccatctactgtacaacatgggaatcggttaagagagcctcccctcccccaaagcaagtcactgtaaacggaacatcacatggtcatggtcaaagaggtggccccaaaccaacggaaaaggcttctcttctggtggaagaaaaatccagtcctgtcaaagtctccgttagcctaacttaggtactggcggtgacttacaagtgagaaaaaaaaaatttgtttttttaaatggccaagaaagaaacctgaacgatgtcactgaaaggttgtagaaaaataggatccagccattagaggtcaggggaaatcaaaaaggtttggaaatgtgaaccctgcctgggatccgagattcagattctactgccatcattacacgccaattgccaatgccacttaaaagaaagcacttgtgacttcagggctgtcttgcgaagtttggggacaggaacccctgacccccagagtcagctaaaccccaggggtctctgctaaggagctgcctcaggtcctagtaggtgaggtaggtctggggaagatgggaggggattgaggtggagggtggggtggagggacaggatagaggcctcctgtcagctgaattcttattctctttcatccaacacaggaaggctgcgaaaagcacatggaaataaaagggggctgaatcggatgtgaaatgtaacagctgagtgatgtcaatttcgatttttcaagtccgatgccggactgggtaagtcatgtcttttcaatgcctggtggacaaatggccttcatttggaagcaaaccgggtcaaggaattgccactaaccgtcttcgggtgcttctatttctctgatccagcagggacccctgggctgccggctccaaagggccggtcttggctcccaacagcagcacggttcagtccctggaggctgggtctccaggactaaggccaagcgcagactctcagaggttaaggcagctgcccttggccaggaaaaggctcaccttccaggagaaggtggcggaacccacccagcaccacctgcgggcgggcccccgaggaagcccatgaatttcaggatattcacgcaggatggtggccggggaggggactcagcacccgggagggaatcagtcacagagctgcgactagaggcacagccagcacagaaaactgcggcttggcaaattacactgaaaacgaaataatggcagagccaagggggaacaagggagaattcatcaggaagcaggttcacaaattcggagctgcctggggtctaactaccagaggaagttacacacgggtcaaaagggaattcaatcaaagcctctttggtatttcccaaaccagatttttgataaatgaacattatctactctgaacgctttttcatcgaaattcccaaataaaagcagagcactcatttttgctaaatagaaatacaactgatctatgtaaaattttttaagaaatggtttcttttgggttgagccttttttaagaaaagggatctcccctttgcaaacaggccttgataagatgtaatgaactttgaggacacagggccagcaactagaaccttgatggaacagagattgcttttcaggagtgacagttgttaagctaaatccttccacaagcttgcaagctaagactcccaaataaaggctttggaattttttagctagaaggctgttcaaacagcggagaccacatacaatgagaatgttcctgaactgagaaacttcagggaactttcaaaggctcatatacttcacagtttcttctcacctgtcccagcatcagaataattgataggattcagataaaagggggcgaggaaagaagctgaggtgctacaagcccgtcatcattttcacagttgaagcttaagacagagttctctgttgaatgctagctatgggcatgtgtgggagtgagactccagggggagtttcagaagcgggaatcccgccttccatcagaagggtgttggctcccaccttccatcagaagggtgttggctcccaccttccatcagaagggtgttggctcccaccttccatcagaagggtgttggctcccaccttccatcagaagggtgttggctcccaccttccatcagaagatgctggcccagggaaacctgaaaggcttctttttccaggaaagcattctggtcccaggatgcagactgctctcgggcaacagagcagggaccctcttttgtgtcgaatccgggcaatgggcctcggttttggcttttcctgaggatctgggattctgtgggagaaaggaggtcctctctggcaccaggccgacttttatgagacacagcctgggtacggatggcaacatcatcaatttgcaaggatcgcgcacacagcccctcagtaaaagatcagggaaaggggaggggatgggcatcctcaattgtccaggggcctctcgagacgctgacctgctctggggacggtggtgcctgcctattgctcaatttcacacttcaataaataaatacataaataggtataaataaacagataaatacagccatcatctcatgagagcaataactaaaaaacagcctacggtcacgttttagtctcacgtcaaggttaaaaactgctggtactaagttatcctgtttgtgattctctctgtaaactagttatttataaacgccagatcccagtcctgaggagttttgggtgatctggccctgcctatttcacaggctttctctttcacccttcctccgggctcctggtttaaaagccaccagcctgtaactgcacattcttgcgtcacagattcagaaatgcttttgcttgaggcaaggattggtttcttaagatcttacgactcctccctgaatgctgggccacctgcaccttccctagccaaaaagaaagaaaaggtaaaataaaaaacaaaacaaaattcgagcaaaacaaaatcaaatttaatggtcttaaatgcaaaagtaaaaacaaacaaaaaacacaaaaaagcaaaagaaaattaacagaacagaacaacccaaaatgtcaaggcagttatgaagagaactttgagggttaatctttaaaactacaaatcaaaggttttggttaatagataactggcaagaagtaagtacttttctgctgagtgttcatacaaaagcaaaattccaaaacaaaatccgactaaaatagaaaaaggtctaagcgctcacgagaagggatgcgagaaatacaatgctcaaatgtttctgtgttattaaaatacagagccattttacgcctccaagctatgttaaatgctctggaaaacgggagaaattatcgtgaacaacagtatccaatgtgtggggcgctgtgcatgcaatgtgtggacagaaactcgggatgtcagagtagcaacacatcttcaggcgtgcctggagcttagatctgactctggaatatactggagtttccctgaaactctttggtccattcccattggtgcctgggcttacgaaacacgtttgtgtccttctctggagggcccgcccagcatgcagcccgtggcccccggccccagtggtggcccacgctggacgggcccgccgccattcccaggaccactcggcagagcccgggactgagtgagcaggaggtggcaacgggacctgcctggaaaaggaacttcctgtcaaccaaagcatacatcgcttacaatgttgaagcggttgagaaaacgcacactcagcatctgtctaacatctttagattaaaaactaaaactaaaaggtgatttttttgctacccagtctgtggagacattgaatgaaacgcgtgttagacagtcttagaggttaaagcatgcttcaggttcaccaccatccagagggactggttagtcaatgcagttctacttagatttctgtttaatatatatcttaaaggaaataacttacgaaacttaagattggtctaacattgtgggatttcaaacatttgaacatgtcggttgcatcccagagtataaaaaccttctcacttctcattcagacaaagacaaacacttgtgaaaattggcgcaaaatgagttgtacactaacaagaaaagtttcaactccttcactcttaattatctattccgtacaaaaaaaagcatgagcgagttatttgtgggacttgttggttttgaaggaaacctgtaagattttgtcccccaggcggtagccgttcaggctggctatggccatcgcggcttcttcatagtttgtcatggtcacaaagccaaaccctttgcacttgttggtgttgaagtcgcggatcactttcacattggtgacggcaccaaacggcccaaacatctgccagaggatcccctcgtcggcatcctgccccaggttgtagatgaaaatgcaccagccggaggaggcgtttcctggcacgttgacgccagagagcccgctcatgtgatcgacgcccatgggggagaacctggcagacagagagcaagcgtcaggccacggtcagcgcaggcggcctggggatggggcaaggcctggacgcatgctgaccatggccgctgggccccatcccgctctgcgcagccacgaggtgctcacggttgagacacctgcatgggtcaaaaccctgggaggaattaaatacagtagtggaggggcgggaccctgttctgtagggagctgactctgaggggctggttggtgccctccactcctcccactgtgtatgtcggggtttctgtttaggggttcctgcggttccccacattttagatgatgggcgcttctcctggtcctccgttgaaggtagaaatgctctgcaggcctctgacagcctcagttctccctggaggaaactctcctcgtactgtggggtacgtgcaggggctgaactcctttttccaaattttgcaccttccccttatcatgacccgcccccaagcgttgacagcccagtggtctctggttagagcacgcctttgccagggccacttgtagggcacaagaattccttcccaagcaccaggcaaccaaccctctgtggctagagctcaacatcccctgagggtcaggggccaaaccactgaggactgagaactcaagggacagggaagggccctgggacaccagcaacggcaggctcaccaaacttgaccacacacgtggggctctttccacagtgatacttttatttacataaaaaataagcctttctgggccaggcatggtggctcaagcacggaatcccaggactttgagaggccaaggtgggaggatcacttgaggccaggagtttgagaccagcctgggcaacacagagagaccccatctctaggaaaaaaacaaaaacctcagaaaacaaaaactaaactaaactaaaataaaataaagccttctgaaaatgtacagatgctgtaataaggattaaggtatatgacaaaacagttcctaaagctatgtttccctctggaactttctcacattaaaaaagtaaaggtctgagggtcagtttgggaatatctgagtagcatacatttgtgaagccggcatctgtgaagctgcgtgatgcatgcagagaagcattacctgctccaaaataaaactgggcttcaggctatggccctatcagccaagcgcagccctgcaggccccagccggggtaaacgagtgccttcaagcgctgttaaacagattcaccctctcgacagacacgagaggacaccagctgccatggggcagctcactagcccaacggtgattttctttatttttgagagagggtctcactatgttgtccagtatggtctcaaactcttaggctcaagtgatcctcctgcctcctgagcagctggaccacaggtgtgtgccaccatgctggctaatttttacattttttgtaaaaccattttcaggatggaaagactaagaagaaagggtctatgttgtccaggctggtctcaaattcctgggctcaagtgatcctcctgctttggcctcccaaagcgttgggattacaggcgtgagtcaatgcgcccggccttcttaggaattactcttgttggtagtttttctcctgctgatttctctggtcttgacagtcataaatcttctcctctcttcctccaacccaattcttttccatcccttatctctgggcttttctggacgtgatagggactgactgcaaactcactgcagtctgggtctttcttcctcctcttctctcagcctcctgagcgaatctttccctccagactctcccgccctccccacttccttccatcactttgtcttagtggttgccctgccactcacttttcctgctcgaccagaaatgtccacttctccggtttcccctttcttttcttgtcctcattactgggaccagagtcccatgtctcctccaaccttccctgttttccttccaggctaaggagcagttcacccaaccccaccgcccatatagcccgccccatcaagagcaggaccgactgtatgatgggatttctagagctggattttaaaattcagctccattccgtccagagaagcttccccagccttgtcttcaagccagaaacctcaaggaaggcaggccagctttggaatttgagccaggctgagaatgctgggtaactcagccatgagaataacacctctcacagcagcatgtgtggcactgggcagcgcccacccagcttcactgttaaaacaacgatggggccgggctcacgcctataatcccagtacgttgggaggctgaggtaggaggatcacttgaggctaggagtttaagaccagcctgggcaacacagtgagaccccatctcaacaaaaaataaaaacattaaaaattaaaaaaaaaagggaaatctatccttgtcatacctgagataagccctcgatgccactccttgaggttttgacaaaaacaaaacagccctgacactgagacctctgctgtttctgaggcgacagcacaccacatcctggagtccaaggccctgactctcatcgcctctatcccacttcatcctggcagccagaaccattttcaggatggaaagactaaggaatccgggaaaactcctcccctctaggacagggcttataaacagaatgcatacatacaacattcaccaatacaaatgactccacgaggcaggtgtttgaaaaaggtttgccttagggctgctgatcaaatgtctaagaatgctggaagatctactctcacccgagtatacctaaggcagcatcttttctcccacagatatgagacgttcattattcatttattttttagagaaagggtctcactctatcacccaggctgcagtgcagtggtgcaatcatagttcactgcagcctccacctcctgggttcaagcgatcctcccaccatggcctcctgagtagctgggactaaaggccagcatcaccatgcccagtttttttcattactttttgtaggaacaggggtctcactttgttgcccaggctgctcaaactcggggcttcaagtaatcctcctaactcggcctcctgagagctgagattacaggtgtgtgctcccccacactgggcatgaaaccatctttaaagctcgcggctccgttctgctgttactaggaactgcgtgctgaagctctaagtgctcacgctcacagcaactggtggggactggtgctgtcttttttttttttttaataaaaacaaaaaaagacaggttctggccctgtggcccaggctggagtgcagtggtatgatcacaactcactgcagcctcaacctcctgggctcaagcaatcctcccacctcagcttcctgagttgctgcaactacaggagcgcaccgccatgcctggccagctttgtattttttgtagagatggggtctcgcaatattgcccaggttggtcttgaactcctgggctcaatcgatcttcctctctcagccacccaaggtgctaggattacagggataagtcactgtgtccagcctggagtcactgttttgattcccatgaaagacaacgcccaatcggaagtaaacggctttcctacagacacctttctgatggaggttgtggtgtggagctgcagaatgattctgaaacgcgctctctgacgggatcagtctatcatccccgtggtttctattctgtggctgtgccgtcgcctgccagcggggctaagtatggctttcaggagcgcgcaccctcccgacccacctgaatctctgcgcctggtggtgaacggggcctccgaaccgtcgcgctggcgagtggtacagctgcgagaggagtgccacgtttttgttctggttggggttggctgcaaacttcactgtgatgggctcagaggaacctgggggtttatgaccattgaaactggtaattgcctcttctgcctccgaccgtttgtcaaaccggataaacgcaacccctctggacaaaccttttcaacaaatcaacaaaaacggagttagggggaaaaacgctaggactttcaaaactgaaaagcaaaagtcaggtcagtctactgtgggccaggctagaagtctggttaaggaaataaacaaaaattaaacctaaaagtgaaaacaaatggatggagtaaagaaaaccaatgactaacagaagattaaagcttcagactttcttcccggctgaagccatgactccacagtgttggcgcccaaagatattttggtgacagacatccccaatagacacccaggcctcttatttggaagaaagcaacattaggaaacagcacatccaccgtcactatttagctgccaggtgtccgccacagagtgggtgcgtgggtgtggtgtgtggttggtgggtaacagggttggagtggggactgcgtctgagagatcctccctgggctcaggggccactctcctggctgctgtctctgggcccgctgtgacagcaggcctcgtggccgagcctgctgcaaaggtgcccagctcagcctgcatgccttctccttcatgccaggagggagtagggtcctgtggccaccccctgccagctccatgctgctgctgtcacctcactcctgtcttgggatactccactctaaggtcctacacccctcccgtgggccccaaattgccatcagaatcaaatgaggccagaacactgcccaggctcatacagcagagctgaacctatccacaggctcgccaggcaggcctggggtccctgtatgggaagggccagggccccagcagccaagcccagagggcatcttctcttgccacctcaactgagccacccaagggccagtcccgggttcccggctaaacccaatccctggacggagcagtgtgagacctgaggaccgtcctgctatgggggacattggtcagctgggcatgggtgtgagatgctgagcaaggcgggtggaaggagagcatggctgtcctgcacccctgcctgtccatacactaggcccgggagggaaacatgagtagcccgtcccttgaggaacctgggaagcgggctggaaactggatgagggggatggggatgagggcacactgagcagcgcactagctccttctctgggggcaaggacatgatggagtcaggggaaggcccaggggtgggagaggtgacagctgagaggccagtctgagagtgacatcactaggcgggagtcacgggtgtgtcccagtgggagaggccgtcacagacagcccaacccaaacaccctggttctcaagacttttagtcaagccaggccaaggctcatgcctgtggtctcaactactccagaggctgaggcaagagaatcgcctgaggccaggagttcaagaccagcctggacaacacagtaagatctcacctcttaaggaaaaagaaagacttccagtcaaagggtgtcttaagtcaggtttcttctccaggcaaaggcctctggtgcatggtaacaaacaacgaccaaagccaggcagcccggggccttgggtgacctgtccagcgggcacccaactgtccccatgtcctgtctccacgcctcacacggcaccttactccaccacttcccagagggtcccgccagctgcccccacaatcgcgacactgcaggccccccgtgagcacagagacagcagctttagtaaggtcagacctagcgctacgcacacgtgccaggaatattctggggctcaagctcatttctgagctgctgctcagaaggaacacctgaaaacacaaccctgacagatgctgttttctttgagtctctcacgacacgaatgacagcttagtcagtcttggaaacctaaatgaaaatcgaactttaggcaaatacgactgagagctgacgctggccggctcgtagggaagctggctccaagcagatggcttcattctgtttctaaagaccctgcggcccagcggagagaaggcacgtgtgcaagtgtggcttcctcgtctggggttgtagagtggctttcaaatgcaaactgcctgagtgaaaggaagaaagctctagtaaggggggcaggagggatgctgtttagcagagggggatatcaattcactcaattatttaatggatgtatactttctgaagatggctctgcattttttgtttttttcttcccctagtgttttttatttttaattttttttttaagatggagtctcgctctgtcgcccaggctggagtacaatggcacgatctcagctcactgcaacctccacctccccggttcaagtgattctcctgcttcagcctcccgagtaggtgggactccaggcgcctgccaccatgcctggctaatttttattttattttactttatttatttatttagagatggagtttcgctctttttgcccaggctggagtgcaatggtgcaatctcggctcactgcaacctccgcctcccaggttcaaacgatactcctgcctcagcctccccagtagctgggattacaggtgcctgccaccatgcctggctaagtttttgtatttttagtggagacggggtttcaccatgttggccaggatggtctcgacctctcgacctcgtgatccgcccaccttggcctcccaaagtgctgggattacaggcataagccaccgtgcccggcctatttttagtacagatggggtttgccatgttggccaggcaggtctcgaactgctgacctcaggtgatccacccaccttggcctcccaaaatgctgggattacaggcgtgagccacggcccccggcccccttgtgttttttagaatttaacagcagagtccaagaaacggcataatctccagatgaatacactataaagttcacaattaaggtggatatagaagcgaaggaatacaaaaaattaagctctgtcagctcagggtgggattttttttctctttttttaaaaaaagagttgggggtctcgctatgttggccaggctgttctgaactcctgggctcaagcaatcctcccaccttggcctcccaaagtattaggattacaggcgtgagccaccgcgcccggccatcctcatctatttaacactaaaaagcccgtcacaggaaggcaaactccacacaggctggcctgccacacacactctgtctccagcagagggagctacagccctgggatgggagcctcaccttcccaccaattctgcatcctggggtgggaagcagagccgggagaccctcctggctcccttctctctgcctccctcactgctctgcaaagatgacaaaggttccttaggccaccttgaggttcacagccgaccctgggggcgcaatactaaggtgcccccaacaccctgggagacactatcttgcagagggaaaggaagcaatgcccccagcagctgtgtgcagaggtgagttccccctgcctgtggcccgtgtgtgcctgagagactagggaaggccccaagagagttgggtggctggaggcatgttctcaggcattgggggctccaagtggagcacaggcttccctcatcagggccatactggacacagacaggccgaggcagagcagtgcatgtggggtctagaggaggaggggagtggactgtgggccagtgaggttggttcccccggccctgggccctgcacagccagctcagatgccccagtgcagaatggggggcaataaacccacacactggcccactgacaggatcattcgctcagctggcacttaagtgagaggacttcagggaccacaggagactcttctggtgcagaccaggggagtttacaccgagtaactggcatcccccgaccctctccccagagcaaaggcagaatggcggcggccgtgcgagtgagccctgtccttcggcactgcccggtgccagggcgcgagtctgtgctaggctacaggaagctcccagggcccccatgaagtgcaaaggggcccttcccctcctcgggccccagcgggaacgaaggccggcagcggcagggccagtgcatgccaggtggggttcctacagccggaaaggaggaggaagagagactgataaggccgcccaccccaaagcacgcagctcaggggacgcaggacaatgtgcatgcccctctagcctgcaggccaggaaggccccacctgtgtgcacatgaaaggcgaggctctgggctgctgggggagtgctgctgttctctcaaaaagaggtcacctcagagcatgactttctgtggcccaactactcggtgttatttcaacatcacagccaaggtgcggcacacacagtctgtgtgggaagaatatgaaaaccacccatacaacgcatgggcctcactaggctcagggagtggattcttccctgctggttagttagcagactcctgctcctgccccaaacagagctgagcgatcctaaatcccctcagggtggcccgagctccctgtcccccaggcggggccacgtgcagggcttggcaaaggatgtggtggggcactagttcctagcctagtgcggcaggcgggccaggcagtagggccggagcacagccgtgggcgtgcacatgtcccctgctcatctctgcctgacggcatcacacaaagcccagagcccacatccagtgccaagacggactgggagggccagcaaagtggccaggattgcctgcccattagaggaattcgctgccatgtgctctgtgcactttagatgtgctccccagagaggggcatccgaattctggggatttgggccatcagactactgcaccccaaatgcctgcaacgaaagccacagtggacaaatgtgcagcagcctttttttttctttttctttttttttaagaaacagggtcttgctctgttgcccaggctgaagtgtagtggcgcgatcacggctcaccacagctgtgaactcctgggctcaagcaatcctcccacctcagtctcctgagcagctgtgatgacatgcccgcgccaccgcacctggctgcagtatcctttttttttttttttttttttttttttttgagatgaaatcccgctctgctgcccaggctggagttcagtggcgcaatctcggcttgctgcaatctccgcctcctggggtccaggcgattctcctgcctcagcctcccgagtagctgggattacaggcgcctgccaccacacctggctaatttttgtatttttagtagagatggggcttcaccatgttggccaggctggtctcaaactcctgacctcaggtgatccgtccacctcggcctcccaaagtgctgggattacaggcgtgagccaccacacccggcctgcagtgtccttttcaccccattcatgggcaaggccagcacatttgggtgcctgagggaaggtgctagaatctcttggcgttttcactgtacatgaaatgctggcctaatccccagctttttttttttttttttttaagacggagtctcgctctgtcacccacgctggagtgcagtggcaagacctcggctcactgcaacctccgcttcccgggttcatgccattctcctgtctcagcctcccgagtagctgggactacaggcgcccgccaccatgcccagctaattttttgtatttttagtagagacagggtttcaccatgttggtcaggctggtctccatctcctgacctcgtgatccacccaccttggcctcccaaagtgctgggattacaggcgtgagccaccacgcccagatatccccagcttcttttaatgccatcttacctcctcagcctcctcaaaccaaagccaacgtcttctcattttggtgctgtcctcgtttgcggaataactaatgacatttaaaatcaaacggtgatctgccttccctagaaaacccagcccccacctagagaacaccctccccacgcgtctggggcccctctggtacctgtagtctgatccacgaggacccgcgagttgatgatccgcccaaaccgagagaacatgtcttctacgtccttctgggtcatggtccgcgggagcccgctgatgtacaagttggcgtctttgatcacctctgagctcgggcgagcatacgacaccttgggaacacaaccactttccgagattagtacaggcacgtggccaaagcattgaggagggtgttgaatgctgggttaggaaaagccaacactgtgtgttagaaatcatgcagggaacgattatcatcactgacgctcaccgcctgcagccgcatggtggcaagctcactgagggatgggccgtgagccaggatgcctggcagtgcttcctcactgggtgctcaccatcctcaaggaggcaggcgtgactcctatgtcacaaagcccagcaactgagggcccgcagcttgtgtgtggctacctctctgatgtgctggacagtgagccggtgccagagaggtcctggtgcctgaaagcagcccgtgctgcagcgggcaagcaagctgggagctactgggaacacaggagactcccctgccaaagagcaagctcgccacagaagccctgacaggggctgtgagttctgggaggaccccgagtttgtactcaaatccactcaagtgttcaatattaaacgactcaatgccttttggatttatattttgcaaaatcaaagaaaactgaagagaaccttctgggtgctttgacaaaatggtacattcatcattcgtgtggagagggtggtgaggggagcccggaggccaatgcaagacaaggtcttcggtgctttctcaggttggcgctgacggccgtgcagaccccatgggcccagaaggaagaaaaggaccacagtggaacccctctgcctgtgaaggggcagcctggcaggactcacagcctcgtcaggaggctgggatatggaggagggagcaggagatgtgttcccgagaagggtggggacttgaacctgtgcgaaaggaagttcattccctttgagtgaggggcacagaactgatgagccaaggtaactgagaccagaacgcagggagaagccgccactcaggagtcactgggcagaatctgcgtgctgagaacacacacacagcatcctctgagaagctcctatcatgttccagagaaggaacaacagacattgcccctgctcatagggcagtgggcggcccagcaggggaacaggacagccccacgaggagaggagtgtggggctggaggccagctctgcctggtagcggtgggaatcgagggagcatgtcactacggagcccatgaggtctctggggaagccgtgctgctcccaggcccggggcacctccatcagcctgtggacaggagctctggggacacttgctcaccccatgatgtgggtcaggggctgccagtgctgtccccagagaaaaagaggctgccttggcccccagcctcccctagtgtccgggcttgccctggctccctgcagacctgtctggactggggcagtatttgggggcctgccaaaccatgaccctggcgccagtggagcggagctgaggctggcactgactggacctactgccgtccctggatgaagccccagaggagaagtgccctagagccaaatgctggggaaagctctgatgcctcccaaggacaggtgtctccaaggaccatgggaactctgctttcctcttctctctggacactgtcatgttcagtcaggctagaatcagaacagctggcgcacagcaggcgtgcactgacctggggctccccggcccctcggccagaaccctctttcctaagctcccaacatcgcttgctctttggcctcaatcaggtctttttctggctgcccattctcaagaattcatccagtgaggggttcaatcgtgttccccccaccccacaatccaaattcatatgccgaagtcctaaccccttgggacctcaaaacgtgacctgatttggatacagtcattgcggatgtaatcagttaagacgaggtcacactggtatagggtgatctctaatcaaatgtgactgatgtccttataaaagagggaaatttaggccaggtgtggtggcgcaggccagtaatcccactgttttggaggctgagtgggaggatcgcttgaacccaagagttcagcctgggcaacatggcaagaccccatctctacaaaaaaaattagctggtcgtggtggggcatacctctattcccagctactcgggaggctgaggtaggaggatcacctgagctcaggagtttgaggctgcagtgagccgtgatcacatcactgcagtccagcctgggtgactgagtgaggtcctgtctttaaaaaaaaaaaaaaagtatttttttttggctgggcgcagtggctcatgcctataatcccagcactttgggaggccgaggcgggtggatcacgaggtcaggagatcgagaccatcctggctaacatggtgaaaccccatctctactaaaaatacaaaaaattagccaggcatggtggcaggcgcctgtagtcccagctactcgggaggctgaggcaggagaatggcgtgaacccaggaggcggagcttgcagtgagccgagatcgcgccactgcactccagcctgagtgacagagcaagactccatctcaaaaaaaaaaaaagtattttttttgaaaacataaattcaatttagaaaggcgggaaatgtggatacaggcactctcacagggagaagtctgtgtgaagatggaggcagacactggggtgatgcttctctaaagcaagcagtgccagagaccaccagcctccaccagaagctgtgagagaggcctgtgacagatcccttcccagtgccttcaagagaaaccaaccctgctgacaccttggtctcgggcttccagcctccagaactgtgagttgatacccttcttctgttgaagcaacctggcctgtggggctttgtcatggcagctgagcaaactcctgaccactcagcttgccacagatccctccactggcatcaacgcccagttcctcctgtccctatttagttcttgactgcgttgatcatgacctgacacgctacattttttttttttttttttagttttttttgtagagacagggtcttgctatgttgctcaggttagacttgaactcctgggctcaagtgatcctcctgccccagcctcccaaatgccctggattacaggcatgcaccaccctgcctggcatctattttacttatttaacttttaactttgcaaacagactctgtgagggccagacttgtgtgtctcctgccatatccaaagcactcagagcagcctcaggtgaacggcaggcatctggggaccgctgctgcgtgagtggagtgcgcagtagccactgctgtgaagaacgcctgcctatctgcactgcagtccccggcgccggcttctgtgggtgacaggagttctgctgttctggttcctgaggcttggatctcacaatgtgctggggaagcctccaggtgacaatgttaagtgcctgtagccacatacagcacccggtttcacaccctggctttgcccctccatccctccgtgaccttggcagagctgtttcactactcgaaacatcagcttcttcaacccgaatctggggaccattttttatggggctgtggagagggcacgtgagatacaggatggaaggtctggccccgtcagcctttgataagcactggctgtgtgtggcacacagggacccagcagtgatgaagagctgcacacagagactgtgcagcatcccagcagggacactgagctgcatctgggacatgctcagcctgtcgcctccatgcaggaccactcccactgtggctgcctgggctgctactatgggaaaaagatagatagggatgaggagacaggactcctccttctccactctgccaccaagggaatgacatcaggaccaaagaggacagagcggacggggtgaaggcaaggcacgtctgcgctctctgtgcagggctggggcctcagagcccaggatgagcacaaggctccaggaggccctgcctgcaagggaggagcggggcagaggcttggggccagcctgcagttcccatgatgtgcctggccactgggtctcctctaggatgcggcccttgccttgtgcccctgcaggtcctgctgctcagaataccctcatctccaccctggtctggctaactccctctcctcctccagatctcaactctggctttcttgagggagcctcctctggcactggccactattataggctcctaagcccaccctgggaccaccttacagagaatggtgggcacaactgggctccccgaggatggaccatgggccagtgacccccagcacctggcagagggcttggccctagcccgtattgtcataaaggatttgtctggtctctgtcccagattcctaggaggaagcttgtaaaactcctggaatttctgtctttgttaccataaggccttggatcccacttgagtttgtgctaagtgatggctcaggatgggctccgacaccagaaagaccaagcatgtgactagacggctggggctgtgagctgggcgataccggcctgacctccagggtgggggaggggaaaggggtgctggggatggagttcgatcacatggccaaagagtcaatcggtcatgcattcgtaatgagcccagtaaacacggcagacaccaaagctccacggagcctcctggcaggtgcacaggtcacatgcagggaggactaggcacctgatcccaccaggtgcagacatgtgagctctgtgcttgggaccctccctgtgtggctcttcatttggcaggccctgagttgcaacctttataaacaaactgtcatcagaagtgtgagttccaggagtcattctagtgagtcatgcaccctgaaggggtggcgggaaccctgaatttgtagccagctggtcaaaagtgcaggggcctggggtcccccaaagggtgactggcatctgaggtgagggcggtcttgttggggaccgtggccttaaatgtgctggggctgtgctaactctgggtgactggtgtcagaatagaactgcaggacaccaggtggcatcagaccaagatgcaataaaatccaggatcagttgaacgcacaactccatccaggcccttatcacactgcacagatcagtcacctttaaactggggatggcaggggatccgaagtccctcagtatcaacgtatctggcccagcaccacactggccaggggctcagtaaaggtttgcggaatgaacacacttggagcacagaggaccccagggctgcgccgggggaactgctagaggagccaggcccagggagcctcggggagacctggggagaaattacttagggctgtcacgtccccatgaggctggcctgtttctgcagaactaggacagtggtgtgaagccactgagaagcagactctgccggcagagggcagggccgccgaaggtgaggcaggcttctgcatgcatggccgggatgacagggagggacacctgcccaggcctgggcccctggggtcccgtgaggctctggctccaaactcaggcagccactccagcctttcccaccaacatcaatcctagagaggcaagacagtcctgtttacacactgggcacccggctcctgcatctgagtaaacggaacagctgtgcaggaataatcaagcgttctgctccacacctcagcctggctgcctcagaaacaagaaccttcacacattttctaaataggggagagaattcctagatggggagtccagggccaaggataagccacctggggctggaggcgaggaagggctgcccctgctcaggtggaatcccatggcgcttggctgccctcaccagcccccaccggggaaggtgcctctgaggacctgcactggacacgaggaggcaggagtggcgcgcctgccctcagggagcccactgcacaccacgtccatgcggcatggggcaggtctgggagagctgctgctgagccagggtttggccactgagtaaccaagatcatggggcagtctgaaggcagggacagaggccagctgttggctgaaggtgctgtcactgtcaggtcacagaacccctcttggtgggcaggcaaaaatccaggctcccaggcccaccctgcagtgactcaggaggcccccctgtgaccatggaatctatatgttacagctccccaggaggccctaataattggcaggtccaagagggacccttcagggtgcctgatgtgactcagggagcacctttctctggggcaggggaatctagcagatctacaggctcacacaggaccacctcattccaaatggccttggagcaagagaggggattctggccgggaagcccttacgtctgtgggtatcttgtgaaggcgggcactgagggcgggtgggtgcagtggctgctgcaggaagcccagttgcaggggcctgcctggggcacgggaggctcagggaaggctcagcagtacccaggactgacaggagaccagggagcaaaggtcggaaagacacgaggcttgatacaggtggcaggagctgcccacgaacccaggagccagaaggcagacacgtggggacgggggtaagtggggctcggggttgacagccccagtgcacgagagcgcgggtcagatgatgaggacagaggaaatccatctgtgtgacctggaggacctgcaactcatcccaggaagccactatggccctgctggaggtgctgcccctgggctgctgcacagttggcttcctcaagtcacctgccgctgtgaagcctccacacacggcaactgccggtcacacatggctatcctctgtcttgtttactgtctgcacccccgacccacgggggcactgaatttgtctgttttggtcactgtggggcacacagtaggtgctgagtgaggtgctgggtgagggaagggttacaactggccccaaggagcgcagagggagcactgggcaggctgggggtggatggagctgtccagggatgggaacacagagagccaggcaggagagacgacaggggaggcctgggagctgacgcaacctgggggcaccctgggcggggagtgggtcctgagacactcatgtaaggcctgggtcagatacacctgaccagggtatctgatgggagcccccgaggagcggctgtgctcatagtcccttggagagtgactgtgaggctgggcggggctcagcacagacctgtgcccagggcaggaatggatgcggtggtgatcagatccctttaccttaatggtttttgactggagcctcaagccgttcagcgtgttgatcgctctctctgcatccttcgcggtcacgtagttcacaaagccatagcccaagctgtgtcctgtgcaagagaacatgaagacattggtaagccaaccgtctgcgagtgagggacagggaggtcgggaagcactatatctgcctggcctttgggaaatgggattacaggtgctagcaaactttattttctttggcaaacacgtacattttctgcaatgaacacaggttcctttttttttttttttttaaagagataggatcttgctctgtcacccagggtggagtccagcgctgtgatcacagctcaccgccacctcaaattcttgggctcaagacagcctcccacctcagcctccagagtatctgggactacaggcccgctccagcaggcccaagctaattgttaaaattatttttagagatggggtctcactatgtcacccaggctggtctaaaacttctgggctcaagcaatcctcccacctcggccccacctcgacctcccaaagtgttgggattacagatgtgagccactgagcctggccaagaggttttacttttgtaattaaaataaccccaaaagttatttacaaaggagtattttttaaaaatactgtgctacggacagcatctttctgaaagaccagtcccgtgggtgccggccgctctgtggggcctgggtggtgaggatgaggaaggccacggcagtggacaggctggtgggaccccagtttgtgtcactgctgtttctctgccacttccttgtccagagcaggagggcctgctggcaccacccaccaccagttccatttacctttccaagcctgagaccagcccgaccccgctgtggggcagaagagtccagggagaggccaggggctgagaatccccagccctgccagacagtgggggagaaccaggttcacaggcagatgtccctgtaccccctttgtgaaacactcagcacaggtacaagtgaacacccactcactggataccatgggagggactcgggagggcaagggcaggaccagaggggacagcctctggggtcagggttcagaaggagcttcacaggacatttggccaaatgctctcactaaaggggaagtgaggaggcacagggaagagcgcaatccccgtctcccgcagcttatccatgcacttgcaaggctgctgaacatctgctgtgggcctgagcctcacccagcactgctccattcccccagccggcagagcgcgacaacgagcaggtcaccgaacaggaggtggcctggagccccactgaggcagagatcctcctggcagctgggccagggacatccagatccatctcaccgacagcaagattacaaatccagcagagagcctaacccaggtttgccactttctttttaaaatgaattttatttttcagaacagttttaggtttacagaaaaattacaaggataataccaagttcccatatggccccctcccagtttcccctatgggtaccaccgcaagtgagtatgaaatgctggtgacgatgaatgttcccattacctctagtccacgccccagccgcttccttagtctttccctcatgttctttcctgccccaggacctcatccaggatcccacgtgacatttagcagtcacatcccctcaggctcctctcgactatgacagtttcttgtttctcgtgactgtgacggttttgaggactggtcggacatcccgtagactctcgattgggtttgctggagtctgtcacagctggagcgcccttctcgtcacacgatgtcaagggcacaggccgtcaacgtgacttatggctgctggtgctgaccgtgatcactgggccgaggcagtcagtttgccaggtttcttggctgtaaagtgactcccacccctttccacactgccctccgcggaaggaagtcaggacgcccagcccacacttaaggcatggccctgacgtagcagctatagaaatgacgtgcagttagttctgcatggggcgctctctttcctaaagaacaaaaccaaaatcagatcctctagactcgtatttctaataaaactcctcagggctaagagactcagctctggggccctggacaaagtgagaacccagagcaccaagaccgtaggaccaggcccgtgtggagcgaattgggatcgcagcttggagaacaagcaacggagcagtgcagccaggtcaggactgccagggcctctgcaagtgctccagatggcagtgtgaaactggcaggtgtccctgcaccccctttgtgacacactcagcacacgtacaagcgaatacccactcactggacaccacgggagggactcgggatggcaagggcaggaccagaggggacagcctctggggtcagggattcctgtgatatggattcttgaccacgacgccagcctggctgggtttttttcactcctgaacacctgctctcgaagtgctcagcgccttctgcatccgggccccatctttctgctccataaacaagcctggaccacctgcctccttggctgcggcgcctcaggcagcctaagtgctgcttgagaaagtcacacactgatagggactcgagcaccaatgcccgttcctgtgtcctcagccacagccggttcctctcaacacagaaacatggtccctgcttggaccaagtccctgcttcctcatctcccaggtgctgggtgatcctgactggtcccctaggatggtcactgccctggggaccgtttcaggatgtgtcccctgagctttcggcagctcagggtagggcctaccctcttgggacacccctcctccaggatgtggaaaccacaccaggtttccgtctccctggctgtccctcctcaggctcctcactccctgtccattccatggagacccatgggccctgaggacccacctttggcccttgtctctgccacatgctcttcctcaccacacatgcccacacctgccaacatcaccgagggagtcgcacacccctgggctgcccgtcaccttccatggtcaagctcttctctgtcctcaaggagctgacgcattaactgagcacctactatgtgtcaggccctgtgcttggctgggagttagtgatgcatgacagaggacggtcgctgccatcatgaaagccatcacatccctgggggcaagtcagacaacatggtggtgagaaactgacaagcattaagacaggggtcaggagggcccgtcgcagaggagatattttaaacctctgcgtggctgacgtgagcattccagacagaagagcaggtgccaagtctccgaggcagagacaatgccagtgtattcccagaaagtagaggtggcccgtgtggcaagggcctaggaagtggccactggcagcagggcagagccagtgtggagccagcgggctggtgatctaatccagatgggagatgcaggctatgtgcacaggccagggcagtagaggaatgccccacccagaggacaggtagtgggggcaggcccctgatctccctacaggctgagccttgtgagtcaaggcctggcttcatccccagaatctgctctcctctctgtggtaggtgcctggaggcagcaggaaggcaggcaggtgagggatgaaggtgccctggtttccacccgctgggtgaggccatcactggaagggctttgtccagcacctgaccacccacctccacctttgcctccaatagaaacaaatctggacagctttctaagccaccactgactgcccaggcgacacccccaaccaatgaagtcagaaaaggaggaggtgggggggttgccagttggcctcagtggttttaagtcagggtctcagtctgttgccaagactcggctcactgcaacctctgcctcctaggctcaggcgatgctcccacctcagccccccaagtagctgggactagaggggcacgccaccatgcccagctaattttttaattttttgtagagatggggtttcgccatgttgcccaggttggtctcaaactcctgagctcaagcgatcctcccaccttggcctcccaaagtgctgggattataggcgtgcgccaccgcgcccagcctcctcagtggtttttaaagctccctagtgattccagtgcatgaggggcatggggcttcccatggttatgcagaggagaggaggcctccagaggagaagtgcaaacgggcccccaagttactgtttctccaggcagggtccacaagccacctgcaccaggggcatctggagttcaaggcaacaacttggctccctagatacccctaccccatcccgggacccaggatgtcaggcaggtgtgggaatccacatccccaaactccttacagatgctcctcctgcccaccagtggcagagcttgccaaagcccctgcctggagatgggagatcagccctgagacaggaggcctgagggtttgcgagggagcaggaggacagggagccaagctcagaggggcctggctcctgcacaggccgtggtgggcctgcctggtgtcagtgctcggggggcaaacggggcccctgggatgggagatgggatggagagggtgtgggtgggagatacggggaagcaggaaggagactggcagggaggaatgcaggatgcagaacccgggagtgaaatgcagggctgtcccagaggccagtgcatgcccggctctcacttccctcaactggaggaagagcctcctcaccctttctggccacaaggcagggtctgagagtcacatttccccaagtatcctgatgctgctgctggcccagggactgtaccctgaaagctgctgcctggagaagacaaagctgcctctgcggggagcaccatggttgccttactgggcacccatacaccgcccacactgggcaaacactggccagtgctctcgaacttccaaacacatttctccctctctttggatgagggttaagactggagagctgcttccttgtcttatgctgccagacacaatgcttccatccctccatgcttcttgcagctggaagcgccctgacctgacacggggtgcagggctgagggggcgagtgccctgtgggtgaagccctcctctgcaccgtgagggcaggtcccgtgagttctctctttaaaggctcaagggaagacctcactgagagacagagactggaggtggagactgaattaattcagcaataaataagaaacagcaaaggtctgcaaaagaaaagaaacaggcgaaggacaagaagggtattttacaaaagtagtacaaacaaccactaaatagaaacagtgatgaacttcactcgaaataggaatcaccctgatcggatgtcgctcgtccctcacagggtggcaaaggtgagaaatcctgccaaggctagcggatagcagggctggacagaaggaagggtgaactaagcgtcccctagagagcgagttagcgacagggaccaagagcctttaaaaggtgcgctctcccatctgccgcttcaccggcaggaagactttctatggaaataaccagtgagcaaagatttgtgccaggacatttatgtcagcagggctttcaaatatcaacaaatgggaagcagaatactatgcgaccgatgatgatgggatcgcgagatgttcagcgaagtggaaaaatgtccagatacaggaagggaagtttatccacagcctgagagaagagcccattctgtagaagtacgtggctgcttatggccatgaatacgtaaagaaaatcatttggagggacatgtgcccaaaagctaacagcggtatgattgtgggtgattttttgtttgtttgtttctgcttggctcatgcttaagtttttttttctgtgaggagcaaacatgactcatattaagaaaaaagccatcaggctgggaaagtccggaaggacattcctgcagagggaacagtgttcagagaatcacaagcgcccaagagtagagcctgaccggggggtgccgggggggggggagggtgcagcaagtggggagagggggcaggcgcccaggggtgtccctaccctcttgggacaccccctcctccgggatgtggttaaagccttgggcagcggtgtgggctttaacccgaccagagatatacagcaagacagaagccgtgaatggggctgcagcctggtggctccggcatgacaggtcatccatgagggtagagggctgactccttctgatcccccgagggacatatggggccactgtggagagaccagacactggggcagggctgcccaggaaggcagcgggcaggaccaccgggcgctgcagtggcctccttagctggtgtttgtgggtggaacagccaacaaccaaccaacgccatatccccaacatagggaccagggccaggccagccagaaacattccgagtcttgagagcagcacatggggcagtcccttcctcccagccatcatcacgcccctccttcctcccgccaccagtgcccagcccatggctggcactcaaccagtatttgctgaatgatgatctgcactctcccccatccccagcaccactcattcattcattccttccttcactctgcaaacaccgactggctatgtctagggctacggagattaacaaagctcctccctccaggagagatactcatgtgctggaccagaaagctccagctcagtgccaggtggaaaccccacagtgcaggtcggcccaggtgccataggaacccacagcggagcatctgacacttgggccaagggaggcctccttaagcaaacacgaccaggacctgaacggtttgaggaggggagtgacagggtcacatgcgggctgtcaaacaggcccctctgctgcagtgaggacagtggtcttcagggagcataggaggccagttaagaggccaaaacgacagtgcaggccaccagcagtggtgtcctgggctagaatggtggctgaggagagaggggaaagggatggactgaagcaacacccaggaggatgagagccaaggacacgcctagatttctgagcagagctaccaagtggatggtggtgccatcggctaaggtggggacaactggaaacgagtggctggctttagggagagtcaggtcagttaggaatatactgaatttaaggggccgagggcttctggagctcaggacagccttctggtcaaaaaggaggtggcagacagagggcagctgggagccatgaggtgactctgcccaccgtgagtgtcagctttggaagaagaggagaatgacataaccctctgagcataaccctctggcataaccggctgagtcaaaggctggggaaaggcgctaaagacagatggggcatggcctcaggggcagttagacaggtgggaggaggaggtgctcctgaaagccaatgggagaggatgcttctggaaggaggtggagacagggaacaggacagtatgtgggtgggaggccaacacacacagcagtggctctcgctaggggagactctgcctcccaggggacatgcggcaatgtcaggacatttttgggtttcaccactgggatgtcactactgggaccacgtgggtggaggccagggatgctgctcaacaccctgcagtgtccagtgcggcgtccagccctgacatcaggagccacagatgtggaggaactccgagctagaggaagctggaagtctggaaggaattcctttcaagacactcgaagcccaggaaaagtgggcacttggagagcctgaggctcttgggaagccgggaagggaagggaagggaggatcggggctggagagctggagacgctattagttccactgcgaagcgggaggtggtcatcagctgagggtgaagggggtggtcagaggaccgaggagggtaaacacggggaaatggctgctgtggggctcggagacacccgtgttgtgagctgagctaggccagggatcagattcgccggggtgcctgcctggccgggtgagaggctgtcttgggaggctgggagaaagccgttggctggggagaggggtggtgagacctagcgccgtgccccgggccctgccagcgaagaggtttgcccacactggcggcaggctgagcaaagccaggttgcagcatgttctccgtaaagctccagtcacttgaagggctgctaacaagaggctgggccaagatgaaagcccaggcccagccactccacaactcctggtgcgccagttactaactactgtccaaagataagacagggctcacctccgaactgaaataatttccaaattacacttttgcagccttcactgattctcaaaaccagttctctccagactgagccaaatctaggtgttcctttagcatagctcacattcctgtgaaaaccacaagggaacagacaaagaagtcaggttgcaggagaataactgcaaattccatgggaatgcttgcaatatctctggtgctcaggaatatcaaggaaaattcccttccaccagaaagaggaaaaaggtgagaattgttagtggcacaggagaattttaaaacccttctcttatttaggatggtctcctggagcaggagagagatgctggcttctagaacattctaacactgctcaagtttgtatactgtgtaaaatccccattgagaaggcgtttattaaatcagactcttggagttggaaggagagaaggctttcttattcagtgcctgcatctgaagagctaattccctgtagagcggccagacaggctctttgggagtcatgtgggggtcaggtgtcttaaggttactggggaaatgttgaagataaagtgcaatgatgggtacatcaggttcaacacatcactctatgttcatgtatgcctgaaatgtttcataatagaaacttttgttaactttttatttttgagacagagtctcactctgttgcccacactggagtgcagtggcacaatctcagctcattgcaacctccgcctcccaggttcaagtgattctcctgcctcggcctcttgagtagctgggattataggcgtgcgccaccacgcctggctaatttttgaattttagtatagacagggtttcaccatgttggccaggctggtctcgaactcctgacctcaggtgatctgcctgccttgacctcccaaagtgctgggattataggcatgagccaccgtgcccagcattcaacttttaaattagttttttttttttttgagacaaggtctcactatgttgcccaggctaaagtgtagaagacactttagtaccaagtggtacttggtaaggtgcaatctcagctcactgcaacctcaacccccgagactcaagcaattctcctgcctcagcgcccccaaatagccaggaccacagatgcgggccaccacgcccagctaagtttttgtatttttcgtaaagatggggtttcaccatgttgcccaggctggtcttgaacttctgagcaagtgatcctcccacctcgacctcccaaagtgctgggattataggtgtgagccactgtgcccagcctgaagtgagttttcagtatagggaatcacagtccccaaatccagggtggcagacagagccccgagaggactggccgctccttggcttcctaaagcagggcggagacagaaaggaaggcaggggggtaggggtgggtagagggaagaggaggaagaggggccattgggagaggaggaggaggagagctccgcacatggtctgtccgtaattctctcccgagtccttgaagccatgctctcagaatggaggccactctgtaaggaaggccttcacaagtgccaggacctctgcaaacacctacgaggtagggaccaccaggatgtagaagccacaatctccacattccggatggggacacaaaggcttagaagtcccactgtgagggagtggaacagcagggcttttagctgccaggctcctgcccctctgagagttcaagctcagcatggtgcagaagttcaagttgatggtgttgacagtagacagagcagcccaaacataacgaagggctgtccacaaggtcctcggtgttctgctgacctgggcctgaccaagagtgggggcctggacagacaggggcaggcctacctgcacctgccctggacagtacactcgccagggtcccttccacacgtgggacccaatcaatctgcccaggccaagccaggtcaggctgtggttctccagccccttccagctctcagaatgccctgtctctggttccttcctctcctcccactgtcttattttgtacatgctctctgtcttacaatgaatttttcctcttttgggaacttatgtccgatcttatacaagagcaatggacagagtttgaaataaaaatgaaacttcacagccatcgtttcaaggctgtagttatcctgcactgaggaatgccacagagtcacaggcaaaggagacagtgcccaaaggatggccaccaatacccggtttactaaaacgcctccatttctttacctgctactttatcccgaataagttttgcagattcaacttcaccaatgctgctgaacaggcttcgtaactcatcctgggtcatgttctgagggaggtagttgacgatcaaattcgttctcccgatgtcacccctgcagtcttcggccatgtggtcttcataaccattagacattgtatttttcaaaaatctgccaagagaaaaagagcaagtaaattcaaaatgttcatattgcagtatatgaaggcaaaactagtaactgcatttgcacttagagattttctttctttctttttttttttttttgttttgtttttgagacagagtctcactctgtcacccaggctggagtgcagtggcacaatctcggcttactgcaacctctgcgtcccaggttcaagtgattctcctacctcagcctcctgagtagctgggattacaggcgtctgccaccatgcccagctaatttttgtatttttagtagagacggggtttcgtcgtgttggccaggctggtctcaaactcctgaactcaggtgatccacctgcctcggcctcccaaagtgctgggattagaggcatgagccacagcacctggccctgcacttagagattcttttctatgctgcatgttaacttacagccacacaaaaatctgcacatggatgtttacagcggcttcactcataattgccaaaacctggaagcaaccaggatctcctccaatgggtgaatgaatgaacagactccattcatgtggttcagctgcacaggggcatattttttgatgataaaaagaaatgagctattaagctaggaaagacatttaaaggaactttaaatgtatactgttaagtgatacactgtatgattccaactctatgaccttctggaagaggcacactacagagaaaaagatcaatggttgccagcgatgcaggtcggcgtgggggggacaacaaatagtggaacacgggattgtcagggttttagggcagtgaaactattttgcatgatatatagtggtggatgtgacaatacatgtttgtcaaaacccacagaatgaacaatatacagagtgaactctaatctgaattacgtgctttagttactaataatgtgtcaatattgattcaccaagaataacagaggtaccatgtgaatgtgagatgctaataatgggtgtggcggcgccatcacagctcacagcagccaaggctcctgggagatcctcaagcgatcctcacacctcagcctcctgagtagctgggaacgcaggcatgtgccaccacgcccggctgatttttaaaactttttgtagagatggtatcttgcccaggttaattttgaactcctggcctcaagtaatccttccatctcaccctcccaaagtgctaggattacgggcatgagccactgtgtccggcttctttctatttaaaaaaaattttattcagtcaatacttcattgtaatgctacagaacgagtgttctccacaatttttctgtaaacctaaaactgctctaaaaaatagtctatggacacaaaacagaacaactccaagttcactaagagggcttcggagagacctacaaacaattccagcaccacaatttaagatcctgtaaaaaagcctttgggttgtctctcgagagaattccagatttccgattgctttctccccatgtccagagcctgtggggtgtacctgaaccccacccctggacaccctgctgctgagggggcaggtaggcaatggtcctctgcacctgtttattcccaaagacacagtgagtgagctggaaagaggtgagggtttctctaccagtcagaggaacttggtcttcacagtttgcaggctttgaaatgtctttctcagttgctgaagtctttcctttcagtgataaacatcagagccagtgatgactttggagaagagtccagatcaatgcggccaagtatgccgagcccgccctgctgaaagtgcgccgcacactgggctcacttctcagaggcccctcatccctgcctctaaacacacaggtagtcatccctgtggatggccacccgcctggaggtctcggtgagagcccatccctttccccagatccctgttgctcaattctgttatgtttgaacacccagtgcccacggtcatgcgcctttggccttctttaaaaatagccttgccagcagttacataaaaatctgaacacacctctcatgtggagatttcctacctactccctgaatcaacgccgagggaagaattaggtctggtttctttcttcctggtagaaacatccaggtcttccctaccctcctactagtctcagacaatgtggaaaatcagtacaatttcctaacatttcttttatttgaggatgtcctatgctccctgctctttaaaaagtaggttagcatcaaaagccatagaaaaaaagactgaaaagtgagactccatgaaattaaaaacctctgtacagcaaaaggcatcacagacctagacgaagaggagtagcctagagaaaagattcactgcatattctattatttagacctgtggttttcacactgggccattctgcccccaaggggacacagggcaatgtctggagacatttttggttactgtgacttggtcagggccaggggtcgggggagggggtgctactgacacctggtgggtagaagtcagagagctgtaaagcatccttcagggcacaggacggccccacaaccaagaattatctaaccccaaatgtcagtactgccgaggttgggaaaacttgattcggaacatctacaaattggtaagggataaaagaagagacgtaaccaagagggaagtaggcaaaggatgtgagcagcaatttataaaggccttaaattcaaatggctcgtaagtccagaaaaagacactgaacttcatcttcgtgaacaatgaggaaaatgcaaaagaaaaccagatgctattttctgccagtcacatggaataaaatccagcgcaagatcacctgctactgatctgagtatgagatggtagaaccttctgactcacaactgcaggatctttctacagaaataatcacgcaagtgcaggagttcaagaccagtctggacaacaacgtgagaccctgactctcaacaaaaaataaaataatttagtgggcatggtgacccatgcctatagtttcagctactcgggagacaaaggcagggaggatcgcttgagcccaggagatcaaggctgcatgagccatgatggcgccactgcactccagcctgggcaacagagtaagactctgtctcaaaacaaaacaaaacaaaaagtgcaaggaaggcactacctcatggttcataagagtataaaactggatagaattctaaatattcgttaatgggaaatggctaaatttcaactttcagtagcagctcgggacctatagactttaatcatgagaaactccacgtgtctgttacaccatctgtggccacgagattttagaatagatcactggctcaaaaacaaacaaacagacaaaaacatttgctggaagctgatccaaacagaccacaagggttaacactgaagaattaaaatgcacattgaagcttgctcaaaatgtaattcaagcatttcccttctttctttctcttttttcctttacctttccttctcctcgccctttctctaagagttaggcatctactttgctttttccctcattctgctttcatggacggtgagatggacaatggctgtcccaggcttactgtccacagtgtggtatcctctaggtctgggaaaagtggacctcctgaaacacacatcatggcctgtggtacaaatctggcccattgcctgttgttataaataaagttttattggaatacagcttgtctcatttgtttatgtattgtctgtctatagatagttttgtactacaataacacagttaagtagtagcaaccgtatggccaaaaaagctgagaatatttaccatctggctcttcacacaaaaaaaatctgccgacctctgttttaaaatgtaaaaacataaaatttcttggagaaaaatctttgtggcattgggctggggaaagatttctcagacacaacaccaaaagcccacttcgttaaaaaaaaaaaaaaatggataaactggatatcatcaaaatttgaaacttttgctctgtgaaagatactgctaggagaattaaaatccaccaactggagtaaacatttgcaaaagggacttgtagtcagaacacttttttttttttttgagtcaaagtctcactccactgcccaggctgaagtgcaatgccataatcatagctcactgcagccacaaactcttgggttcaagcaatcctcctgcctcagccttctggctaattttttattttttgtcgagatagggtctcactatgttgcccacgctggtcttgaattcctggtgtcaagtgatcctcccatcttggcctctcaaagtattagaattataggcgtaagccacctcacccaacccagaacccttttttttttttttttgaaatggagtcttgctctgtcacccaggctggagtgcagtggcatgatctccgctcactgcaagctccacctcccgggttcatgccattctcctgcctcagcctcccaagtagctgggactacaggcgcccgccaccatgcccagctaattttttgtatttttagtagagacggggtttcaccgtgttagccaggatggtctccatctcctgacctcgtgatctgcccatctgcccacctcggcctcccaaagtgctgggattacaggcgtgagccaccacgcctggcccagaacacttttttttaagctctcaaaacagaagcaggctagtgtgctggctcatgcctggaattccagcactttgggaggccgaggtgggtggatcacctgaggtcaggagtttgagaccagtccggccaacatggtgaaaccccatctctacaaaaatacaacaaaaaaaaaattagcaaggcgtggtggtgggcatctgtaatctcagttactggggaggctgaggcaggagaatcgcttgaacctgggaggcagaggttgcaatgagccgagatggcgccactgtactccaaactgggcgatagggccagactccatctccaaaaaccaaaaacaacataatgagcaaacaacctggtttcaaaaatggcaaaagatttgaacagatactataccaaagaatatatatggatggcagacaggcacatgaaaagatgctcaacatcattagtcaaattaaaaccacatcgagacaccgctacccacttattagaatggctaaagcaaaataaaacaaaaaacaaccaacagcaacaaaacagacaatgtcaagtgctggcagggatgtggagaagccagaatattcatgcactgctggtgggaatgcaaaaatgtgaaatgtgacagccactttggaaaacagattggcagtttcttatggtgaaatatacacttagcatgggatccagcaatcctactcctagtattaaggcaatagaaaggaaaatctatattcacacaaaaatctgtatataaatgtgcagagcggcattattcataatcatccaaaactacaacaacccaaatattcttcaagccattcatggataaactgggatacaccatacaacagaataccacctggcaataaaaggtatcaccaattcatgctacttgtgtgaatctcaaacacatcttgccacatcatttctgtgccttcctggaaaaggcaaaaccatagggatggatctgtggtcgctggggttagggagtgaggggaaaagtcgattacacagggacaggaggagggagtatttctgtttgtgggagagcgaactttccaatctttattatggtggtaatcaaacaactttatccgtttgtcaaaactcagagaactctactcgaaaaaatgaattttcctacatgcaaatttaaaaataaattgtctgagtgtggcgactcatgcctttaatcccagcgctttcagaggccaaggtgggaggactgcttaagcctggagttcaagaccagcctgggcagcacagagagatgccatcattacaaaaaaaaaaaaaattaaaaattacccaggaatggtgatgcacacctgtatgcaatcccagctaatcggggggctcagctgggaggatcactagagcctgggaggtcaatactgcagttagctatgattgtgccactgcagtccagcgtgggcgacagagtgagatcctgcctcaaaaacaacaacaaaaccacaataaaaataaattttaaaaggtttaaaaagagaacttctgctttgcggccctgttcctcctgacactctgagtcaaggctgagcagcccctgcaggtcaagttcttggtcaactagtaacacgggagaaaccaacaacctgccctgcaaagcagtttcatgacgtttctgggcccccaccccactctctggaggcccttcccttgaccttctccaaatctgcatcatcaatcctgggccaaatcagcttctatcccacaagctccaaccacaactgggccttgtcaccactcaattatcactgactcccaagtcgtagccacttctgtctctcgaggtgcaaggcctgcactgtcctgcaatcaagatgctcacccctctggtattccctgtcagtggtcaccacccattgaggctcggcggtcacacgatgatgctcacggtcaggcatgccattaataagtggcagggccaggcctcaagttgtcatgacaatgcaactgtcaaactggcaaggcccttcacaatcggacccaggtggttctccagcctcagtcgccaccctcccttcccgctcactccagcttcttgccaatatgctacaggcctctgctttggctgttccctctgcagggcactagtgtcctctccttcacttcccagctcattttttaaaattagtatttttttttaaagagatgggggtctctctttgttgcccaggctggtcttgaactcccaagctcaagtgatcctcctactttggcctcccaaagtgctggaattgcaggtgtgagccaccatgcctggcctcccagctcacttctatttttacttatttttcttttgagaaagggtcttgctctgctgccaaactagagtgcagtggcataatcacggctcactgcagcctcaaactgcctcagtttcccaagtagctgggactactggtgtgtgccaccatacctggctgatttttaaatttttttagagacaggggtctcattttgttgcccatgctggcttcaagtcatcctcccacctgggcctcccaaagtgctgggattataggtgagagccactacaccaggctggctcatctttaaaaagctaccttcctggcctggcgtggtggcttatgcctgtaatcccagcaatgtgggaggccgaggtaggcggatcacctgaggtcaggagtttgagaccagcatggccaacatagtgaaaccctgtctatactgaaaatacaaaaattagctgggcgtgatggtgcatgcctgtagtaccagctactcaggaggctgagacagcagactcacttgaacgcgggaggcagaggttgcagtgagtcaaaatcacgccactgcactccagcctgggcaacagagtgagactgtctcaaaaaaataaaaaataaaaggccaccttcccccaggacaacaggttacttactctagttctcagtgcctccatgccattgctgtaaacctttgttactgtcccaaccactcctatcattatttgccttacactcaatgaccaatgtcagtggtgagaaccttgagggcccaggttataccattgccatctaagagtccccaggcaaagccagggtgtgtcacacagcagtacaggaggctgctggctctcagaccaggctggagtgcagaggcatgatcacggctcactgcagccccggcctcctaggctcaggtgatcctcccacctaagcctcccaagtacctaggactgcaggtgcgtgtcactacgtagtcctactaagtcctctatgtagttctgtctaagcttttttatgttttgcagagaggggggtcttgctttgtcacccaggctggagtgcagtggtgcgatcttggctcactgcaacctccgcctcctaggttcaagtgattctccggcttcagcctcccgagtagctgagattacaggcacctgccaccacgcccggctaatttttgtatttttagtagagacagggtttcactacgttggccaggctgctctggcactcctgacctcaggtgatccacccgccttggcctcccaaagtgctgggattacaagcatgagccaccacgcttggccgcttttttatgttttgtagaggcgggggcgggggggtgtctcgccatgttgttcaggctggtctttaactcctgacgtcaagtgatcctcctacctcagcctcccaagcactgggcttagaggtgagagtcaccgtcggtgcctggcctctgggagaagtcttgtttggatgatctctgaaggtttttgactccaatgcactattttaaacaatcctggttgtctatgtgacatcagtgatgttgttcacatccgtcgatcatctagcgcatatccaggggagagagatgtgtgtgtctttatgtgtgacagaaaaagagtgaagcagtgaggctgctttccaccaggcaagcatgagaatcactttcattgcaccatgacggagcaggtattctaaaccacttgagccagagcaaaactagaacagtcaaatctatcttcaggctcaatcttgacacttcacacatcatctgacagggcttggacccaataatgtttaaggtcctttccagatgcaacattctgagtcttccaggtaaaaaaggcttaggtcattcaggaaatgctctgctgccagaaaaaacccaaagcaccacctgacccagttataaatgccatgcaaggcaaggtctcaggtggacatggcaccagcttcttccaagcccctgcccatggcccacagaagggcaggatgcctggctggagcagctccagctaagtgacaattccctttcagccaggctgagaagcccggggcaggagcaggtcaggtgtggctggcctgtggcccagtccaggcaccccacagccctgctaagggctctggcttctttctggctggtcaaggccaaaggccactgcagggatctcacacagaagtgcaaagcaacagggcatggcaggaaaaaaccctgagctctggagcctggcaggcccgagctgggcactaagtctcctgctcatcagctgaactactgtgcagaagtcgctccccttcccagagcttcagcttcctccactggggatgtcaccccttgctccacagtgcctggtacagtgagtacctgtctctagtcccacttcatgaacaaaatcaaggcgaatgtatgtctccccaacctccctgtctgcagctacaaacaccttcatctcctctcctcctgtccttgccctctcttcaaaccgcctccgccccctgaattacttcatttggtggcatagccccacctgtcccccaagccacctctctctagcccttggacctaatcaagcaccatgtcctgccagtttgacatgtgagatctctcaccgtcctgccacctctctgccaccatccctattcagattcctgtcacctcctgctagaccgactcctaagtgggattgcaaactcagtgtctctaaacccagcttcatcttcttcctcctagtcactccccttccttgagtctgcctgtttctgttcatggtgacatgagtctggccatcgagctgttcaggattgttccctctcctgtgattccttcccctgacataaacgtctcactcttaaaaaaaattttttttttttttagagatgggatctcgctatgttgcccaggctggtcttgaactcctggccttgagcaatcttccaccttggcctcccaagctgttggggttacaggtgtgagccactacacccagccacagatgtctgtttgacaggtacctggatccagtcgcttctgagtagtctgccaatctttcctttccctggcacagacaaaatatcaaccacgtgccaggcacagagcaaagcatcaggcatacaaaatatagaagcagtcccagtcctgaccctcaagcggttcagccattacggggccacctcagtactgcaacagcctgtgactggtttctccttgtctccccccagcctctccaccagggtgagcagtgaactaaaactgctcagtagccacccctggcctacctgcagggtaacagccaagccctctgcccagtggacacctgagcactcctgccaccactacccatctcagccttcttgtccctaaagaacccacgtggttctttgaacacacgatgttctctgaacactgcgatgttcccacctccgggcttggctgtatcctaaaaagccccaccctattgtctttgcctggttagctcctccccaccgctactgcctcctctcctccaggaagcattctgggctctcctgtgcccacccaggtcccttttctgggcttccacatcagccagggcataattctcacagcactcatcagagtgggctgagatgacctacacacatcatgcacactctccagagcctagcgggggcccaggacacagcagcggagcagggagagtcgttcagaggagggagcgagcctcacttccctcccacaggctggcttccgttggtcttcccctgacccacagctcgggtcggccgcaccgcctcgctactgccacctaggggcgccagccgggcgctgcgcttctctcgccattcagccttgaattcgattcaataaactgaatgggatgggaacactaaggagggaacagttgattccggtgcgggtggaggaagagtggcagtcagacgaggcttcaaacggccagtgagctctgggctgagccatggagcataagcaaaggatctccaggtggaagagatctgtctccaggtggaggctgcaacaggcagggagggttagagtttggggtctacgtgcaggggcggggagggttagggtgtgaaggaactggcactccaaactaagggcttctagctttatcttttaagccaccagagaggtcaagaaaacgtgtcttttttctgcacaaagattttaaatcagaagggatacaattagatgtgcatttacagaacagaactcctgctggagtgtggaaagagggaagagatgggaagcggagagtgagagaggcaagaaattttcataaagttttttcataattctctcatttcttttacttgaaatagcaccatgggctgggcgcggtggctcacacctgtaatcccaggactttaggaggccaaggcgggtggatcacctgaggtcaggagttcgagaccagcctgctcaacaaggcgaaatcccacctctactaaaaatgcaaaaaattagctggacgtggtggcggctgcctgtaatcccagctacttgggaggctgaggttgcagtgagctgagatggcacaactgcactccagcctgggcaacaagggtgaaactgtctcaaaaaaaaaaaaaaaaaaagaaaaagaaaaaaaaaaaaaaagaaatagcaccatggtccgggcgcggtggctcacgcctgtaatcccagcactttgggaggccgaggcgggcggatcacaaggtcaggagatcgagaccatcctggctaacacggtgaaaccccgtctctactaaaagtacaaaaaattagtcgggcgtggtagccggcgcctgtagtcccagctactcgggaggctgaggcagaagaatggcgtgaacccgggaggcggagcttgcagtgagccgagatcgcaccactgcactccagcctgggcggcagagtgagactccgtctcaaaaaaaaaaaaaaaaaagaaatagcaccatgatctcagactcaacacatccagactgaaactctgtctgctcaaaaccaatgcatcaacataaacagtattatttccttccacatttgagacgttcgtgtatctcaacctctttgtgggcctcgaagttgcagaatttgataatagatcccagcacagaactttgcacacagaaaatattcgatgacaactggagtgccctggagccttgtgattataggagcagtacaatcgagtggttaagagtaagggttttgaatcagagggcccgagttcaaaccctggcgcagccactttagtgcatgagactggtcacatcaagtgacccatctaagcctcagtttcttcatctctaaaatggaaattaatggaaattataacatcacctgcctcaaggactgcagacaaacgtccacaaagtgtcaagcacatagtaaatcctcaataaatactggtggctatgtacaacatcatttattcagtgcctaccaggcacagaccacgcacaacgcaacgggatttccaccctcttcaatttgcaccacacttttgtccttcccattttatagataagaaaactaaggctcaacagagtcaagcttgttcgaggtcttgggagcatctcccagggcattagaacttttggaggaagagcatttagttcagtaatggttctcacctgtgcgtgtgagagtggaagagacccctcccccgcaacccgagccatctggcaatgtttggagatacttttgatcctcacgacttggagcatggggatactgctggcatctagtgggtagaggccaggaatacggctcaacttcctacattgcacagggaagcccccactaccaccacaaccaaaaactatctgaccccaaacatcagtagggccaacgtcgagaaaccctgctctagacagatcattctcctcatcttcccatttctggccatccggatcttagatgaacactttctagcaagggggctcagtcccaccacgggaagcccatgcagaagttgtgcagaagttcttctccacctgccctgcacacagtagggaccaaaacccattttaacaagccccgcagcccagagcaccggaaaaggaaggaagggcatccatcccccattgttcaactgtgtgcagcttgtgtttccaacaggcacacacacatattttacaaatcctaacgtcccacgccccacaaacagctttgttagagatggcgctcaaaaaaagatgcagtttagattttttttttcccccaggactcccgtgtatctactgaagggtttgcacacttctcaaaggacctcgcaccggccgcggtgctctgacaacgaccacaaaagaatctgtgggatttcccgggggagcaagcccgtgggccgtgacctctgcgcgctcaaagcgttcccggcgctcccccgtagctggccccactctcccgcccccggagcccgggcttccaaggcgaccggggcccccggccgtgcagcccggccccccggcgcatgcccacgccgtatccccctcgcccgtccctcgaggcgccagaggaatccggccccggggcctgtagccggcgcccacaccggcccgccccgacccgcccgccgcggccccagcgcgcgtcccctcccccggtccggcgcggcctgggcctcggccggtgcaggcccgcgggcgccccgcggccaggccaggcgagctcaggcctgccgcggcctaccccgtcgggcgccgccgaaggccccccaccgcctcacctggatgcgggcgggcgggcccggggctgctccggggcgggcgggaggcggcggcggcgcggcgctaacggctccgctcggcctcggtagcggtggcggcggtggcggcgacggcgacggcggcagcggctcctcctcagcgcgcacgacccgctccggcccgcggcccggacacgccccccccgcgcgcgagcccattggccgacgtccgccacggcgcgctgctcattggccggcgtagctgtcgcggcgctccggggcgcgcgggagaggcgggacttccggtcggcgccgcctgcgaagtgctccgcggccggcggagacgcgggcagccagcgatggccgcggagggggcgaactgggttccggccctcggaggctgacggaaggcggtggctgaggagcggcgcctctggttgagcgctcgccgtgtgtcccgcacctgtctgtcctgccgccgcccggtaaggtaggaaaggtcagcgcgccggggttacgggtacagaacctgggttcgaatcccggccccgacgtttccgcactacgtgccgttgggcaggagctgacgtcaccttgccgggcctcagtttccttctctggtgcgctgaggaggcggggcatggaacgtggtcagcgcttcatcggtgctggctctttgagcaagccagttcccgaaggctcagcatctcattcattcattaaaatgtcattgagcgcctactgtgtgtcaatcactgtatgggcagtgagcagaaaaaaaatacctggtcttattgggctaacattctaaaccagcgctggcctagaatgccctagtagaaatacatgcaagctacatgtttaatttttttttatgtaaagatgggctctggttctgttgcccaggctggtctcgaactcctggactcaagcgattctcctgcctccgcctcccaaagagctgggattacaggcatgcctgcactctgcctaattttttcttttttttttttatgatctgaaaataatagtctttttatttttatttatttatttatttatttgagacggagactcgctctgtcgccaggctggagtgcagtggcgtgatctccgctcactgcaacctccgcttcccaggttcaagcgattctcctgcctcagcctcctaagtagttgggcctacaggcgctgcgccaccacaaccagctaatttttgtatttttagtagagacggggtttcaccgtgttggccatgatgatctgtatctcttgacctcgtgatctgcccgcctcagcctcccaaagtgctgggattacaggcttgagccactgcgcctggcctacaattttgtttttctttttttttttttttttttgagacaggatctcactctgtcacccaatttggagtgcggtggtatgatcacagctaactgcagcctcaacttccccagctcaggcaatcaatcctccggcttcagattcctgagtagcttagactacaggatgtgccactatgcctggctaatgttttatttttttgtagcgatgaggtcttgctgtattgcctaggctggtctcaaacttctagacttaagtgatcctcctgctttggcctcccaaagtgttgggattacaggcgggagccacggtgcccagcctgtttctttttttaatcatattttcttagaagttttttttttttttttttttttttttggagacagggtctcactctgctgtgcaggctggaatgcagtggtgtgatctcagctcactgcaacctctgcctccctattcaagtgattctcgtgcctcagcctcccaagtagctgggatcacaggcgtgcaacatcacacccagctaattcttgtggttttagtagagatggggttttgccatgttggccaggctggtctcaaactcctggcctcaagtgatccacccacctcggcctcccaaagtgctgggattacaggcatgagccaccacccggcctaggaaagctttttagagattgggtctcactgtgttgcccaggctggagtgcagtggctgttcacaggtgcaatcatcccacaggtttaactcctgacctcaagcagtccttctgcctcaggctcccaagtagctgggattataggcacgtgccaccacacctagctcaattaaatgttaaatttaacatttaattgttaaattttatagtagccagcattctgggtcatcacggtgcaatagaagtataaacaaagcaggccaggcacagtaggtcacgcctgtaatcccagcactttgggaggccgaggcgggcagatcaccaggtcagtagttcgagaccagcctggccaacatgttgaaaccccagtctctactaaaaatacaaaaattagctggacgtggtggcaggagcctgtaatcccagctactcgggaggctgaggcaggagaatcgcttgaaactggaaagtggaggttgcagtgagccgagatcccgccactgcactccagcctaggtgaaagagggaaattacatctcaaaaaaacagtataagcaagccacagatttgtcagcgaggtatgtaatttaaattggtacattgttagccatgtttaaaaataagtaaaaagaaacgggtgatgttagttgtaatgtgttttatttaactcagtaggttgaatatgttattatttaaacatgtagtcaatattttaaaatacaggatgttttgcatctgttatctttccaaaatagaagatactttgtgtcctttttctttcctgcatgctttttttttcttatttttttgagacagagtctcactctgttgccaaggctggagtgcagtggcgggatctcggctaactgcaacctccccatcccgggttcaagcgattctcctgcctcagcctcccgagtagctgcgattacagacatttgccaccatgcccgggtaattttttgtgtttttagtagagacagagtttcaccatgttgcccaggctggcctcgaactccttaccttaagtgatccacccgccctggcctcccatagtgctgggattacaggcgtgagccaccgcgcctggcccctgcctgcttttgaaatctagtatgtatcttatactccacagcacagcacagcaccgcacatctccagtcggactggctacatttcaagggctcaaccatcacgcgttaccagtggctactgcatcagactgtgcagtgctagatggggagtcagaagagaaaccaagtgatttccatgtcaagtggtgaacaggctaagaagaaaagtaaattggggaaagagcatggggaatgtgggggttgctgtttgaaagaggatggttgggaaggctgaagagctgtcattcgcagagggacccaaaagaggtgagagcactgaacaaatagttacattcttcattgtctgccgcagtgctgtccagaagagcttcccacgataatgggcatgttccatatcagcaccgtccaattcagtagcccctggctccatggggttttctctctttgtttttttctgtttgtttttttttttaagacagagtctcactcttttgccaaggctggagtgcagtggtgtgatcttagctcacagcaacctctgcctcctgggtttaagcgattcttctgcctcagcctcctgagtagctggaactacaggcatgcaccaccacgcctggctaatgtttatatatatattttttgctttgttttgttttgttttgagatggagtcttgttctgtcgtccaggctggagtgcagtggtgtgatctcggctcactgcgagctccatctccctggttcacgccattctcctgcctcagcctcccgagtagctgggaatacaggcgcccaccaccacacccggctaattttttcatgtatttttagtagagacggggtttcactgtgttagccaagatggtctctatctcctgacctcgtgatctgcctgccttggcctcccaaagtgctgggattacaggcgtgagctgcagcgtccgacctatatttatatttttatttattattattattattattattattattattattattattattattattttgagatgaaatattgcactgtcgcccaggctggagtgcagtggtttgatctcggctcactgcaacctccgcctcctgggttcaagtgattcttgtgcctcagcctcccaagtagctgggaccgcctgctaccacacctggctaatttttttgtatttttagtggaaacaggatttcatcatgttgaccaggtcagtattgaactcccaacttcaggtgatccaccaacctcggcctcccaaagtgctgggcttacaggcatgagctgttgcacctggcctccatgtgtgttttgtagggttttttttttttttttgcacttggcacatggttggtaccattaaagaactgactttctggccagacaacggtggctcatgcctgtaatctccagcactttgggaagccaaagtgggaggataacttgaggccaggagttcaagaccagcctgggcaacatagcaagcccccatctctaccaaaaataaaaaaataagccaggtgatatggtgtgggcctttagtctcagctgcttgaaaggctgagttgagaggattcctcaagcccaggagttcgagactgcattgagttgtgatcatgccacaacatttcagcctgggcaacagagcaaaaccccatgtcaaaaaaaaaaaaaaaaactgagcgtaagtttttaattaattcaaatttaaataaccatatagggctagtcgctcctatagtggacagcatagggttggtatagtgttgacaagtcctctgaattaagtgggtccttcatggcaaatgctttatggacatcctcctgtgaaatcctagaaataggccaggtgtggtggctcacgcttataatcccagcactttgggaagccgaggcgggcagatcacgaggtcagcagttcaagacaagcctagccaacatagagaaaccccatctctactaaaaatagaaaaattagccaggcatggtagtgggcgcctgtaatcccagctactcgggaggctaaggcaggagaatcgcttgaacctgggaggtggaggttgcagtgaaacgagatcacgccactgcactccaacctgggcaacaaaagccaaactccatatcaaaaaaaaaaaaaaaagggaaaaggaaacgttttaaactgagattggggtgatgggcaacagagtgagactctgtctcaaaaaaaaaaagaccttattttttagaaaaatttagacccagcacagtggttcacacctgtaatcccagcactttgggaggctgaggcagcaggatctcttgaggccgggagtttgagaccaacccaggtaatatagcaagacccccatctctagtaaaaatttaaaaaatttgctgggtgtggtggcacacacctgtgctcccagctactggggaggctgaggtgggaggattggttaagcctgggaggtcaaggctacagtgagctgtgattgcaccactgccctctattctgggtgacagagtgtgaccctatctcaaaaaaaaaaaaaaaaaaaaagaaaaaagaaaaattttagatttacagaaatacttccaaagtagtagtagagagttaccaggcctggtgcagtggcaggtacttataatcccagctacttgggaggctaaagtgggaggatctctgagcccaggagttgcagaccagcctgggcaacatagccagaccctgtcctttttttttttttttttcttttttttttgagaccgactctcactctatcgcccaggctggagtgcagtggtgtgatcttggctcactcctatctgcgtcttctgggttcaagcgattctcctgcctcagcctcccgagtagctgggattacatgcgcccaccaccatacccagctaatttttgtatttttaatagagatgggttttcactgtgttggccaggttggtctccaactcctgacctcaggtgattcacctgccttggcctcccagagtgctgggattacaggcgtgagccaccagaccctgtgttaaaaacaaacaaaaaaacagagttaccattattctctattagtaacatattttagttacaaatgagtaacatattggtaacaaattaataatgataatttgttgcagttaatggaccaatactgatactttgctattaactgaaggtcagagtttatttagtcttcctttgtgttgccctagtatcttttttctctcccaggatcccacccaggagactatctcactttttttttttttgagacagagtctcgctctgtcacccaggctggagcgcagtggcgcgatctcggcttactgcagccttcacctcctgggttcaagtgatcctcccgtttcagcctcctaagtagctcggacttcaggcacctgccatcatgcgtggctaatttttgtatttttagtagagacggggtttcgccatgttggccaggctggtcttgaactcctgacctcaagtgatccacctgctcggcctcccaatgtgctgggattacaggcatgagccactgcgcctggccagtccatctcacttttagttctcttatctcattaggctcttcttggctatgacagattctcagatttccctagtttttgatgatcttgacagttttgaggagtgccggtcaggtattttggtaagagtgtccctcttttggaatttatctggagtttttctcataagatacacgtttttggcagcaagatcaaggtaataaagtatcaatttaatcacaccatatcaaggatacatcctatcaaatttattatttatttatttaaagagacagggtcccggccgggcactgtggcttacgcctctaatcctagccctttgggagacagaggcaggtggatcacttgaggtcaggagttcgagaccagcctggccaacatggtgaaaccctatctctactaaaaaagtataaaaattagctggatgtggtggtacacacctgtagtcccagctgctctggaggctgacgcatgagaattgcttgaacctgggaggcggaggttgcagtgagccaagattgtgccactacactccagcgtggggattacaggtgtgcaccaccatgcctagctaattttgtatttttcagtagtgacggggtttcaccatgttggccaggctggtgttgaactcctgacctcaggtgatccacccgtcttgttctcccaaagtgctgggattagaggcatgagccaccgtgcccagtccttttttttttttttttttttttttttttttttaatactgtggaaggaagtcactatgcgtagcccacacctaagttgtggaaggttatactctatttatttaagggtagactgtctacataaattttttttaattttagagacagagtcttgctgtgttgcccaggctggagtgcagtggtgtgatcatggctcactgcagcctcaacttcctaggctcaagagatccttccacctcagcctctctagtagctgggactacaggtgcacgtgatcacatctggctactttttgtatttttttgtagagctgggatctcactatgttgttcaggctagtctggaactcctggcctcaagcactcctcctgccttggcctcccaaagttctagggttatgatttgcatcgctacatctggccctacataaattattattattttttaagcttgtccacagctgaaacataagttttctagaatccttccacgtgggagatttatctcgctctcccccacttactaggtcattgaattatatcaggatggaatgctggatatttatttatttatttattttactctggagatggagttttgcccttgttgcccaggctggagtacaatggcatgatctcggctcaccacaacctccacctcctgggttcaagcgattctcctgcctcagcctcccaagtagctgggattacaggcatgtgccaccatgcccggctaatttggtatttttagtagagatgggatttctccatgttggtcaggctggtctcgaactcccgacctcagatgatccgcctgccttggcctcccaaggcagtgattaccgggattaccggcatgagccactgtacctggcctggatgtttattttatgctttgtgttataacccaatactactgtattttgtcggtcaaattgttccagctttggccgtctaccactctttaatttggctcctgtggccctttgacatatccccatcaatgtgtttttcagtggtttttttgtttgttcgttttattcgaagcagttccttaaactttgtggcaacacaaaatgctgcaggcctatcttgtgtatttctgcccttcgtcctagaagcagccatgtctccaagggggccctggttccttttagtagagaatgatattgaaaaccaggatctggggtactggaagtgctcattgctactggaatgttgtttctttagatctttagatcaccaatagcttttttgtttgtttttttgagacggagtctcgcattctcgcctagcctggagggcagtggcgcgatcttggctcactgcaagctctgcctcccgggttcacggcattctcctgcctcagcctcccgagtagttgggactacaggcgcccgccaccacgcctggttaattgttttgtatttttagtagagacggggtttcaccatgttagccaggatggtctcgatctcctgaccttgtgatccacccgcctcggcctcccgaagtgctgggattacaggcgtgagccactgtgcctggcctttttttttttttttttttttaagacagggtctcactatgttgtccaggctggaatgcagtggtgccatcttggctcactgcagcctcaacctcctgggctcaagccatcctcccacctcaacgtcccaagtagctgggactgcaggtgtgtgccactgtgcccacctaaatttttgtattttttgtagagacagggttttaccatgttgcccagcctggtctctaactcctgagctcaactgatccactcaccttggtctcctgaagtgctgggattacaggcgtgagccaccaaacccagcatcaatagctcttttcttttctttttcttttttttttttgtttttgtgaaagggtctgcactcaccagcagtgtgaccttgggcgagtcatttaatctctctgagttttagcttcctcatctctaaaatgggggtgggccagatgtggtggctcatacctgtactcccagcactttgggaggctgaagtgggcagatcatttgaggctaagagttcaagaccagcctggccaatatggtaaaaccccatctctactaaaaatacaaaaattagccaggcatggtggtacacacctgtaatcccagctattctggaggctgaggcaggagaatcacttgaacctgagagggagaggttgcagtaagccgagatggcgccactgcactccagtctgggcaacagagtgagactctgtttccaataaataaaaataaaataaggccggtgtggtggctcacgcctgtaatcccagcacattggaggcaaaggcaggcagatcatctgaggttgggagttcgagaccagcctgaccaacatggagaaaccctgtctctactaaaaatacaaaattagctgggcgtggtggcgggtgcctgtaatcccagctcctcgggaggctgaggctggagaattgcttgaacccaggaggcagaggttgcggtgagccgaggtcgcaccattacactccagcctgggagacaagagtgaaactccgtctcaaaaaataaaataaataaaatgggggtgatcacagtacaggtgatccttgaacaacctgggtctgaactgcacaggtccacttacagctggatttacttccacctctgccacctgtgagacagcgagaccaacccctcctcctcctcttcctagcctactccgagtgaagatgatgaagatgaagaccgttatgatccacttccacttaatgaaagatgaatatattttctcttcctaatgatttttttttttttttt

SEQ ID NO: 1249 - DNA, 90506 bp, Homo sapiens
gtcccctccctgggctcagcaacccaggaggccatgacttctgcctgggtcctagggctggagcctcggtgtccccttgtcttctttccttttgcgacttggttttccagtctgtgaaatggggtgggtgcgtccaactccaagccgcctgtctctgccctgggtcctggagcctggaggaggaatgaggtcatgtttgtctaggggctagagcatcttggacggagaaacctcggcaaagacaaaggcccattgtcccccttccccggccttctgccagctccctccccagtcaccagacaaggccagccctgcccacagcccccagaggctgccacgcaccagtatggggtgactcagtgccccctcccttcccattggttgacgatgcctggaatcccaccatcagagctttgtaaggttgctgtgggatgggggagtgggggaggcagaaaaagacaagaaggtggtgagggcctctggcttgcggatttcaaaattagacctttatgatgggcttgggtgggagatcaggcaataataaataataaaaacaacaaatttcacacttgcttttcagtagctttggcatgaaacctttataagcattatctcaatgaatgctctccacacccctaagggaacattgttcgttactccattccaccgacgcagaacactcacataactagtagatatggatggcagcggcggggttcaaactggagtctacgtggttctatagagttctgcagggctaggtgtgatggctcacgcctgtaatcccagcactttgggagtctggggctggaggattgctggaggccaggagttggagaccagcctgggcaacattagcaagaccctgtctctataaaaagttaaaaattagctgggcatggtggcatgtgcctgtaatcccagcactttgggaggctgaggattgcttgaggccagttcaagaccagcctgggcaatatagcaagacccagtgtttataaaaatttaaaagccaggcgtggtggcatatgcctatgatctcagttacttaggaggctgaggttggtggatggcttgaccccagaagttcaaggatgcagggacctgggatcccgccactgcactccagcccgggtgacagagaccctgtctctaaaaaactaatagagctctgcagagcagacccgggggtgggggctgaactagggggacagggaagggggacaggcccatggcctggagctcacagcagtcaggggatcccaacagagatatggacaccttcccactgaggctgtggacaaggctgaggtccttcattgcttcagaatgaagtggttggggccaggcgcagtggctcaagcctgtaatcccagcactttgggaggccgaggcgggcagatcatctgagatcagtagttcaagaccagcctgaccaacatggagaaactccgtctctactaaaaatacaaaattggccaggtgtggtggtggtgcatgcctgtaatcccagctacttgggaggctgaggcaggagaatcgcttaaacccgggaggcagaggttgtggtgagccgagatcacgtcattgcactccagcctgggcaacaagagagaaactccgtctcaaaaaaaaaaaaaaaaagaaagaaagaaaagaaaaaagaaaaaagaacgacgtagttggagcgagtcagttctgctgctgggaaggtggtgctggccccaagaaggaggggctagaggatgctcgaataatttcagtgccttgaaacacctcatgggccacacatgagcagaggccacaggggaacaggggtgacttctgtaattctgaggcccacggagctctgtcagtcattagccatgcaggacaaataacagctcgaacataacgcgtccaaaagtcaactcttggtttcttctccaacctgcccctccctgtgacttccccatctcaggaaatggcaccatcgtctgcctggtggctccggccagaaaactgggaggcatctttggatcgtcccgccctcaccacccacaccccggccaccgccaagactcgtcaattctacctccaaaataaatcccaaatccacttccctctgttctcgctgccacccctgtgtcaagtcaccaccagcttggccctggaggccagcacagcctcctccccgcctccctgcctcctctctaccccctccagccagaataacctgcggaaaatgtaaatcaggccccatctcattctcctgcttaaaccgcccctttccccaagggcttcctgttgcacttgcaccaaaatcgacaccccccaaatggctctgaggttcatcatgacctggtgctgcctcacatcccccaatttcactgtcccccaattcttttcccctggaatctgtgtgtttgcatatgctgttccctctgcctggatgctcttccctgcaattctttccccactggtcccttctcatactttaggtctcagcttggagcttacttcctttcttttttttgagacagtgtctcactctgttgcccaggctggagtgtggtggcacaaccttggctcactgcaacctctgcctcccgggttcaaacgattctcctgcctcagcctcccgagtagctgggattacagttgcctgccaccatgtccagctaatttttgtatttttagtagagatgggtttcaccatgttggccaggctggcctcgaattcctgagttcaagtgatgcacccaccttggcctcccaaagtgctgggattacaggtgtgagccaccacgcctggccagagcttactttcttcagcaacccaaactagatttcccccagtcttttccctcagagcccctcgtgtgtcttcttcatgggaattcaccttaatttataatgacatgttcaccttttgtctctgccaccaaactgtaagaaccatgagggcaggagccttatgcgtctcactcactgctgtgcccatgggaggcactcacatcgttgaatgaatttgcaactgataacagcgtgagagcgtaatgacgtaatataataataacagcattagaccctgtctctaaatgaaaaacattttttcaagcagctagtacttatgcagtgcttctcctactggatctaactcaaacaccctatgagacagggagtattactgcttcccatttttcagatgtggaaactgagcctcagaagatgggttggctggccaggcaccgtggctcacacctgtaatcccagcactttaggaggccaaggcagaggggatcacttgaggtcaggagttcaagaccagcctgaccaacatggtgaaaccccatctctactaaaagtacaaaaattagctgggcattagtagtgcatgcctgtagtcctagctacttgggagactaagacaggaaaatcacttgaacccaggaggcagagattgtagtgagtcaagactgcgccactgcgctccagcctgggccacagagagagactctgtctcaaaataaataaataaataaataaataaataaataaataatgcctggagcccatcttcccttgctgggaagcatcaagtccctcctcatggctgggacagagagcgagaagtggcagggctgtcactggacagacagtgatggtccttccagagcccacaaaggagctgaggctccatcctgcaggacaggagaccgtgaggtcatcaggcagcagaatgacagggcttcctctgtaagctagggggatggagtgagggtggcagggaggctgaggacagcatggatgcctgggaagtctgggcaaatgccgtcagtgatccccggccgcccttggtctggatggtccagatggcctgggccagttgtttgctcttgggggcttccctggcatgaccaagccccctggagaggggcctgggcagcagacagggtgagggctgcctccccaacccagacctgggaacgtccgggctggcagagggcccgctggaggctggtgagaggcccacttaccatgacggataggggccccgtcaggccgcgccaattaggcaagatggagtgccaggacagggctataaatatcttggccgccgactggcccaggaatgtaaatggtgttgctcaacaagcagggaaaaatgttcggttcagacaggatgggttttttgtgttttaaaaacatgttctgctctccacgaagacttcgaggtgggcggcaacgaggccggtgcccgagggctggctccttgtccagtcccgcctggggcaagggcccacgaaatcagtcttgcaggggaagtccctggaagggccagtgcatttgaagcccagagaaggcctgaacctggcttgaaactttgtccctggtcacaggggaccctgggtgagggagcagcctagccatctggtttggggacacgcagcccagtcggctatcaggggcaccagcggcgggtacaatcgtctcccaacactggctcctcttcagaggtctctgccctgttgtgggtgtgtggctggacagggcatcgtgtgtaggttaccggacaggcagagagaagcgagggccgagggagaagggcaggcacttggcgtggctgcagtgtgggtgcactcacccctgcgggagtggtaccgcttctgcagagggcacgggaaaccttacaactgatgcaccttgtaatcgatgacttttttttttttttttgaaatggagtctcgctctgttgcccagactggagtgcagtgacatgatcccagctcactgcaacctccgcctcctgggttcaagtgattctcctgcctccgtctcctgagtagctgggattacaggcacatgtcactatgcctggctcatttttgtatcttttagtagagatggggtttcaccatgttggccaggctggtcttgaacgcctgacctcaagtgatctgccccccttggcctcccaaagtgctgcgattacaggcgtgagccaccatgcccagatcatttttatatttttttaatagagatggggtttcactatattggccaggctggtctcgaactcctgacctcaagtgatctgcccaccttggcctcccaaagtgctgggattacaggtgtgagccgctatgccctgctaatttttgtattgttttaagtagagatgggggtttcacaatgttggtcaggctggtctcgaactcctgacctcatgtgatccacctgcctcagcctcccaaagtgctgggattataggcgtgagtcaccgcgaccagccccaaaggagcacttttgtgggagaccaatgggtgcatgaagccaagggaaagtgcatttgcggaactccaagggtgtgtggtcttgtgcacaatcaagggagtaagtgttcctaaaggtgtgacttgtgtgaccatccaaaggctgccggggcggggggatcccagagagcacaacatggcaatcacgaaaatatgttggtgtcatttctcggtcttcaaaaatgacggacactgctggtcgctgtggcttcctcctacgcgttcggtcactcctgcacatgtccgcagtagtggtgctctcggggaccccctcgccaccccacaataccgctcaccacatggccaaacaggttcgtctttttccatgtgatttcttcttttgctagaacatttataaaacttcttaggaaatttaaggaatgttaaggaagttaaggaaaagttatgaacgcttttccagaggctaaaaaagaattcaatttatttcctactagctagtctagaattttattacatatttatgtaagttttaactttataatctgtctggaggtcattttagtgttagatataaagcgttagcttatttgcttccacctcaaatgcctgccccatttcccattgttgtgtagtgcttgtgttatcatggattgcatttttatgtaggattggttcttatacataatcgctgctttgtaacctattccaacggtgcgtatccctgatctcattccagcatcacgctattaaatgtttgttcccttagactatgttttatggaagagtttatagcacagtagttaagattatgggctttgaagtcaaactggcggagatccacataagacctttgcctcttaataaatgtgtgaccttgggcgagttacctcacagttcctcatctgtaaaatggacttctgggaggttgaaatggtttagttctgtgcctctgcccaaatctcatgtcaaattgtaatccctaaagttggaggtgaggcctggtaggaagtgattggatcattgcggggggatttcccctttggtgctgttctcgtgacagtgagtgagttcttgtgagatatggtggtttaaaatgtgtagcacctccctctctctctcttccccttgctacggccatgtgaagacgtgcctgctttcccttcacccttctgccgtgattgtaagttttttgaggcctccccagccacgcttcctgtatagcctgtggaaccatgagccaattaaacctcttttccttataatcacccagtttcaggcatttctttatagcagtgcaagaataaactaacacagaggcctgcagtatctccctcacacattcagaacaaattgagaactagatatagacatcagatggctgataataaggctgataaaacatcagccttattattgagtagaggtggttgctatccactgccacaacttgtatttagcattgcactggagttcctagccaatgcaataagacaggaaaaggaaatgaaagggataatgatggaaaaaaaaacaagacaaaaaacaaagcctcagtgggcttcctgacatttgcccctgctttagatagactcaagccccctagtcacaggtagtaccagaccccctagatcttcaccacacacacactttctcagataaaccctatgcccagaaaattactatggagcacagcagaaaatactgagagaggagacacaaggatggaaagcaaggacaggagtgttcctttagcaaaagtcctttcacatatgaggtagaggtggtgatggagactcccccagcaacaacctcatctagggccgtagtgagcacaggttggtaatctctgtgaagcacttggcttggtgcttgccacacttgtaggtgtacagtaaatgctgttcttaatatcagtatgtgcaaggtcttacttcatttcatttctcctcttgtcctggaattctaaaacagttgtcattggtgttttcttttaaatgaaatgtaggatcgtttggtgatgttctaagaaaaaatatttccagctgagcacagtgactcacgcctgtaatcccagggctttgagcctgaggcaggaggatggctggaggccaggagttcaagattagcctgtgaagcatagcaagaccccgtctctacaaaaaattttcaaattagctgggcttggtgatgtgcacctgcagtcccagctactcgggaagctgagggaggaggatcacttgagcccagaaagttgaagctgcagtgagccatgatcaccccactgcactccagcctgggcaacagagtgagaccctgtctcaactttcctccaacccttggctgccccccactccttaccctacatcagcatgtaaatgattctgggggatagggtaggaattaatcccaaacagaaggaactagaaggatagcctgcaaaactcagagaaagggaagcttgcactttagtacaaagcttgcactacagaggagtcaagggtcaagtgcataatgagagtggcagggcctggccgaggtgggcagggagaggtcagtgggttccagggaatttgaggcccatgactaagctgcctcaggggggctgatgggcaggtattataagcaggttgcagaggagaaaagaggctctggaaaagccaggaggtgtagacagccaggtgggctcaccaggtatgacgatgtgggcacaggaagtgaaggttaaagccaagagtggcacagtctcctggggatgctgagcccatgtcccaaggtcggggtcctggttccagtgtccagctctaaccccagccactgtgtgtgtctgggcaagctgccaaccctctctgggcctcagattctctttgtcaaaggacaggcacctctctgtgccatgatgctgtgaacctcttccctgctgatggggtatccctacacccccaacccactcttcctcttccaagacagcctgaggctagtttctctgccctgttttcccaccagtgacccaatatcctccccatcttttttttttttttttttgagacagagtcttgctctgttgcccagtctggagtgcaggggtgtgatcttggctcactgcagcctccgcctcctgggttcaagtgattctcctgcctcagtctcccaagtagctgggattacagatgtgcaccaccacacctggctaatttttgtatttttagtagagatggggtttcgtcatgttggccaggctggtctcgaactcctgacctcagtatctcccccatctctgaaaaggagaaacacttgggtctcctggttcccatgcctccctgctcacagctccatggtccaagaacttctagggtagcagcccctctgttcccctcttcaccacccccccagcccctgttttcattcattcgttagtttagccaatctccactgtccttcttatgtacctgggcttccccagtccttaggaaaacaaagaaaaataagccagagacgcagccacctggagctcatggtctactgggggacctttcatagacaagcccattctttattcattccagaaatgttttctgagtggccgccctatccctggaacaggaaaaccaccggtgggcacacagacccagcctctgctcctggggggcttccaaactggaagtcagagaaccaggaaatcacgacatataggatgtgggagagcccaggccagagttggagataacagaaggcttcctagtggaagtgatgtctgagtgaagacagtagctgagcagacatcagccagccacagtcgcaagagaagagagatgaggaagagagggcttcaggagagggacgccaagtcctggctcagaggggaacaaagtggcttaaggccgggggaagggggagaagatagctggagcagagctggagaaagagagctgggggtgagatgggcgcagtagtctggagccagatatcacagggccctgcgggcacaaaagggattttctgttatcctacagctggtgggaagttactggttttaggcaagtggcatgatgagatttacatttcttttttcttttcttgagacagggtctcactctgtcacccaggctggagtgcagtggtgcaatcaaaactcactgcagcctcgaactcctgggctctgcaacctccgcctcccaggctcaggttatcctcccacctcagcttcccaagtagctgggactacaagcatgcaccaccatgcctggctaatttttttttttttttttttttttttttttttttttttttacttttcatagggatggggtctcactatcttgcccaggtttgaactcctgggctcaagcaatcctcctgcctcggcctcccaatctgttgggattacagacatgagccactgcacctggcaaagatttgcatttctatacatcaagctgggctggacgtggtagctcatgcctgtcattccagcatttttggaggccaaggcaggaggattgctcaagcccaggagttcaagaccagcctgggcaacatagtgaggcccccatccctacaaaaagttaaaaaaaaaaaaattagccagtcatggtggcatgcacctgtggtcccagctactcaggaggctgaggcaggaggatcacttgagcccaggagttggaggctgcagtgagctaggatcacaccactgcactccagcctgggcaacagagcaagaccctgtctcaaaataaataaataccaaaaacaacaatgctatcaggttgggctgcatggaagtcactgctgacctgggtgagagtgtttgggtggcgggtgggggccagagccaggcaggagccggccaaggagtgagcagcaggtgagaagtagaaacacgtgtgcagacagctctttgaagagtttggccgtgacagagaggtgagagatggggcagccagaggtgggagtggggttcaagaaggggtttcttttattttgttcatggaatgcttaaatgccaacgagaaggggccaataaaaggaggcgtggctggaaccctaaaggtggttcgtgggctgagacgtctgagcaggtggaggggagggaaggggaaccaagcatgggtggggtcaccctttggcagaagtggcctctcatccacagggagatggccatagacttggacatttggagacacaagggtaaggacagtcccctagagctagcctgaggctgaggacaaaaggtcagaaattctcagacagcgctgggcgcggtggctcacacctataatcccagcactttgggaggctgaggagggcagatcacttaaggtcaggaactcgagaccagcctggccaacatggtgaaaccccatctctactaaaaatgcaaaaaaaattagctgggcgtggtggcgcacgcttgtaaattacccctgctactcaggaggctgaggtgggagaatcgtctcttgaacccgggaggcagagtttgcagtaagccaagttcgcaccattgcactccagcctgggtgacagagcgaggctctgtctcaaaaaaaaaaaagttctcagacagtgaagggggtatggaggattgctgtgcaagagctcaaacagagggaagcccaaaaccagctggggtctgggccacaagtcatcatgagccgggctcagaggacacggtagacctggagccaggtctcagtctggagttggagttaagacgtaggccaggtgtggtggctcgcgcctgtaatcccagcactttgggaagctgaggcgggtggatcacttgaggccaggagtttgagaccagtctggccaacatggtgaagcctgtctctactaaaaatacaaaaattagccaggcaaggtggctggcacctgtaatcccagctgctcgggaggctgaggcaggagaattgcttgaacctgggaggtggaggttgcagtgagctgagatggcaccactgcactccagcctgggtgacagagcaagacttcatctcaaaaaaaaaaaaaaaagactcaatctgggatcagagagggctctgcccagagtcaggagcagatggtgaaggcaaggccagagccccccacccctgaggtccatcctgagctcagggtccaatccctggtggtcctgaggttgaagataagctccctgagctgctcacccttcgggtggccgacctggcccagcttctgtccaggaacctcctcagccccgatcccaaggggaaatgccagcccagaccccactcttcctttaggccaggagggccccccaaaacccaggcccaccctccccagcagccgggccacgagccgagtcccgccctacccagtccagggtgagaattccggccacacgcccctgtgatgtggtcacgttggaaaaatgttaatcaaatattctcctccgtgtttcttttctttcccaggctgaattcctagaagacaggaatttatggtgtgagagctccagtccccgcagacccactgccaaggtcaacagcacgaggcgggcatccctgccaagtggggagtggagtcgtggctttaggagttggttgcaaggaaaaaccaaagtacgtgcattaaaaaagaaaaaaaaaaaaaagaaatcccttctctccctcaagttcccaaactggggcttaaacaaggtctcccagcatggcccgggcaggcctctggtctgggaacagagtctcccttggagatagggcctgcgacgctgtcacgggggcgtccctcgggtccctggagggtctggaagttgctccttctctcagaccaaagctcagcagctcagcctcacggggcggcgggtgggggggggcgggggcgggggcaggatctccgtggtgaccccacctctctggccaacccagggcagttgacatgaacacaacacatatcatcctgggccctgtcaccaagccccctgaggtgggagcctgcttcatctcatctcgcctctgccatcttggttctggggtcttgactctccagagagcaagctcctcgcagactcgggcaccaaggtctctggcagcagagagactggggatgctgcctgtagtagcggaggggaggtgaggagggggctggagaccacccagactcaaacccagatgacccgatgctgggaagatagccttggccccagccccgagccccgcaggtgtaactgagcatccacgtgtcacccatctgcctgacacgtgctgagttccactgtgtcccgggcacctggaaaaaggggaaaccaaggcagaggaggcctcaccgccaagtggggcatggaggaaagactgatgaaaaaatggaggtgactgtcacatgagaaccagggggctggagggactgtgggtccccggaggagagagcggccgccctggggctgcaggggaggacgctggtttgagaaagctttctgaagggagttgcaccctgagaggggccagagttcaccaggcggacacgcagtgggagagggggcttgcttggaaggaacattccagctgaggccaaagcatgtgcaaaggcccagaatgtttataccttggtaagacttttcatataaataagttctcaaatccaaaaaacaaaacggcctctggcaagccacatgtctgggtttcttgcttggaaaaggaagccctgccctgccccaagcctgggaccacgagaaagtggggcctgacacttctcaggtccctgcccccttccctggcagccacacagacagcaccacaccgtgcaccccccaagagagtcctcaagccctgttctgtctgtcccctcctcactgcctcacaccaacagcctcctcaccgtcacctcactcctgctgggcgcctcctcaggcccaagcaccaactccagcctgttctctgccctgtaccaggaggctggggagtagacaaggggcagcctcctggagtccagggtccttccagggtctctactccctgaatgcatggggtagagagagtcagaacctccagcttctgttttttgttgttttgttttgttttgttttccccaagacagggtctcactctgttgtccagactggagtgcaatggctcattgcaatctccgcctcctgggtttaagcgattctcccgtctcagcctccctagtatctgggattacagtctcccgccaccacgtctggttaatttttgtatttttagaagagacggggtttcaccatgttggccaggctggtctcaaactcctggcctcaagtgatccacccgcctcagcttcccaaagtgctgggatgacaggcgtgagccactgtacccggcctgttttagtgtttaaatctctttttggccctggagtacagaggttttatttatccagtcccttttattcccatcattcctaacccaccacccacacccacaggcaacctttccaatgcattcaaggtgtgccctttcattcacgtgcgttcttgtaaaacaaggatcactcatggctactaatggggacggatcttccttttggggtaactcacatgtctcagaactagatagaggtgagtgtgctaaatgccactgaattgtaccctttacaagtggttcatggttaactttatgttatgtgaattttacctccatttcttaatatgtgtatcactgttttggaggagttttgatttacccaagtggaactgggctatggattatatttctgtcttactctttcttctcagagtctggtgttttttttatttgttttgtttttttgagacaaggtcttgctctgtctcccaggtttggagtgcagtgtgtgatcctaactcactgcatccttgaactcctgggcttaagcgatcctcccgcctcagcctcctgactagctgggactacaggtgcatgccaccacacccggctaatctttttaaaaaaatgtttttgtagagatagggtctcaatatgttgcccaggctggtcttgaattcctggtctcaagcgatcttcgcacctcagcctcccaaggcactgggaatacatagcaagacctcatctctacaaaaataaacaattagccagctgtggtggctcgtgcctatagtcctagctacttgggaggctgaggtgggtggatcgcttgagcccaggagttcaatgctgcagtgagctaggtcacaccactgtactccagtctgggccacagatggagaacctgtctctaaaaacaaaaacaaacaaaaaagtaagattctgaagttgctagaacaaattgtgggagaagatcttttgacacagaagtgaaggactcctgaaacaaaacctcaaaaaatgcataaaccagaaagcttcccccgccagcctcctgcctcacccagaggaagtggcgtttcctcccggacgccggcctgggcgctgcccacctggtgagtcatgggccactctcttctgaggctggcggcctggcccgcccttcccgtcggtacccaggagggagcacagcctgcaatggccgccttatctcaccctcgcccatggccccgcagacatgaggtcagggccggggatgtaatgagggtgggaggtgggaggcagtggagggtcagggagaggtcagaggtcgctggcaaagctgttgctgcactttggaggtgagggtggggggcaaagcagacccttaagggacctcagccaggccccagggctgggggtggcaagaggttcgtgtcatcacagtgtggccgggtcaggggaacagggacaggtgccccaggccaggggagagagggccccaaaccccagccccttccagaatcttatctccaggggagagagggacccagattaggattttctatctaagacagtccacacccctaccccttccagaatcttatttccagggaagggagggccccagattagaatctccgatctgagcctgtcctcactcccaaccccttccagaatcttctttccagaggagagagggccccagattatgattttcgatctgagacagtccacacccctaccccttccagaatcttctttccaggggagagaggaccccagattaggatctccgatctgagacggtacgcaccctctaccccttctagaatcttctcttgtttctccaatggccctttgaggccaatccccttctggccaaaacacacggccagacaagaaagccattgagagaacaagcaagggtgtgtctgtgcccactggggtgtccccagagctctttgggcatctgtgtcttacccctttcatcatccaacaaagggtgactcaacaccagcaccagccccgcgccttcgtcccgggagggctgagtccttctgcggcgttgggtctgggtcccagggcttgccagttctgccgatgcctgtcacctgggtgcaagcctgtgtgtgggcccacatgtgtgcctgcagatgtctctgcatgtgacatgtgcatgccaagtgtccagctgtctatcccttatgcttagtctctgagtctgggctgactgtgctgatggcactttttccaaaggttcctggtaactgggacaagtcagtgtgtcctccagcttgttgtcaggggtccctgggcagtgctaggcagcagcttttggatgggcagtcagtcggtcaacatatgtttattttggggtgtatataggcggtcctgggggcttgctgtctcatctgcctccatccaccggtctgcagggactgcaaatgaggacatagttgtcccctctggccggtgttgctgtgtgtctctgtagttaaaggtgtaccctggagcccttccccttccctgggtgcctggtttgtggggtttctgtcctgggttagcagggggcagggggacctaatccatggtcaatacctccctccacctcactccccagcagaaaacccaaatgtgcatggagaaagagcactggctcaactgtccccaaagtatagagacagatgattaatagatgcatacatacatgtgtatatgtatgtatacacacacatccatccatccatatgcatacatacacacacatccatacatgtacatacacagatatgatatcacatagaataaaatactccaactgacgtctgaacttttaattaattttaatttttttttttttagtattagcattattattttttgagacaggctctcactctttcacccaggctagagtgcagtggtgcgatctcagctcactgcagcctccacttcccaggttcaagcgatcctcccacctcagcctcccaagtagctgggactgcaagtgtgctccagcatgtgtggctaatttttgtattttttgtagagacagggtctcattaacttacccaggctggtttcaaactccagggctcaagcaatctacctgcctcggcctcccaaagtgctaggattacaggtgtgagccacagtgcctggcctgaacttttaaatcaagattttatttatttataattattttatttcattattttattttatttttgaggcggagtctcactctgttgcccaggctggagtgcagtgacacaatctcagctctctgcaaactccacctcctgggttcaagtgattctcctgcctcagtctcccaagtagctcggattacaggtgcccgccaccacacccagctaatttttgtatttttagtacagacggggtttcaccatgttggccaggctggtctcaaactcctgacctcaagtgatttgcctgcctcagcctcccaaaatgttggaggttacaggcgtgagccaccccgcctgacctaagatattatttatacagagacatgcacacagcgtatgtgaacttgcatcagatcgaatgggaattttcacaaaccacacacattgctgttgacagcactcagatcaacatgccagcccctctgacccccatttcccttattcccctcccagcccccaatctccccctaagaatagccattgctctgacttcagcatagattccttttgtcattttttgatttgatgtaaatagaatcctagattatctacccttacgtttcagattcatcaaagctgttgcatgatttactttattttatattattttagcctgtgcattcccacgactctgcccctctcccgccgagttctcaggagcccaccactgggaagaaaatcctaggggaggccaggcatggtggctcatgcctgtaatcctagcactttgggaggccgaggtaggaggattgcttgaggccaggagttcgacaccaccgtgggcaacatagcaagaccctgtctcaccaaaaactacagagaagagtaaccaggcttggtggcatgcgcctgtagtcccagctactcgggaggctgaggtgcgaggattgcttgagcccaggaggtcgaggctgcagtgagctgtgattgcaccactgcatcccagcctgggcaacagagcgagactctgtcaaaaaaaaaaaaaaagagagagagagaaagagaagggaaggggaggggagacagagagagagagaaagagagaaagaaagagaagagggaaggaagggaggaagagaggaaggaaggaagggaaaaattctaggggaagactttgcaaggaaacaaacatctctagctctgtgaagctgtgatccaccaagacaggatatggcctctggggcttctgttgagctcccagatctatgcctcgggcaatggggaatgagagaccacagggatgggtcttaagcttccccagaccttccttcgtccttccaggaatgcgccaagcaaaagcaagctaagagcaggtgctgggagcaaacagctgccttgcaggcaggacgaggagcctcttaagtctgcagccctattggaaaggctggaaggagagagctcccatggatggagaagcagcctcagatccccaaactgtctgcacctccctctaagacaggatggtgtccgtgggacaatcgacccatgtgctctcttcccaagccctgggtctgtaccatgcctagggacacagatgtgggccacattccgctgtccagacaactttcttcttctcctctaaggcccagattgagtgacacctcccctgtgatgccaggttgaccctctgtccccatctcccctagacccctgcagctccttctccaggaccgctggtgcccgcgcccagttccgtttcttacgtaagaggtgatgcccccagggtcattccagggtgcaaatctgtctatgtcaccctctgtggaaacctcccatggctcccagtgacctccactaacgcactcctactcctccgttctgcaggatctgggccccctggcctggtttctttccactctgccctcccaagctcccactccaagcctcgcctgctatttcttgtctttgtactttttggattggggccagctgattgcagtgctccctgcccgcctttaaactagcaaagttctctttgtcttcaaagactcggctgaaaaatgcctttcctccaggaaaccttccttgatggcccaggcagggctggtgcctcatctgacctctcatactccccacgcatgggcccacagggtctgggctggcacagggccctggatgtgtccctccatggagagatgtcagggagccctggccagatggcccaaatgatgaatgtctcccagggatgtgccagcctttcctccacactgggccagcaggtgtcaaggcagtggtgatgctttgggaccaaagccaaccttggatagctcctctgatttgagcttcctctgagccctcaactgcccccctaccaggatcccacagcctcctaatagagctccccacctgcctcagctcattctccacttggcaagcagagagcacctgctcacatgcagatctgtgatgctccctgcctcaaactctccatggctccccagtgcctcaggacaaagtcttggtctggttcccagtgtctgctgccccatccccagccctcactctatcagagaaaatagggcaggtccccaaactgtcacccccttgagcccttgtcccccacattgcctccacctggagaactcattctacccagccactggccaccagcactctataaaccattcctgttctctctgactgctccacatcggtccccctgcagtacctcttgccacccgtcctgggccatgagacactttggggcactgcttttcacttgtctatcacccactccaggctgtggactcagggccgaggctctacttggctcatctccatgcctgggcctggcacacagtaagtgttgaatgaataagtgaacgcgcctattttatagacaaggcacatgagtcccaatacagcagcgacagtgactctgggccacagtggagtgcaggcacggggcttctacgagacatcctctgagggtgtgagctggtttctgggccccctgagatgtgggaccatgatccgcccactcccacctcactccaggtcaggccccagcagggaacagcagattcgaccacccctctaggaccaggaggaaggtgacccctggagccatctttggggacctttgagaacacttctagggcctggatcacccagggcacctgttctgcagagccaggagcttctggacaggccccaggctaacctcagggcccctctctgcctccaggcagggcaaaggtgggcagcgccaggagggtgcggtaggagccagaggcgttggggagaggccagcctgatttatgaggcaagcagggatgggatcacttggcaaggtgggcatgcacgacagaccctcagagataagagcccagaggtatgcaagcgatgtaaacagctgggagcgggcaccccagctctcccgtaccagccagagacacccagaccggggaagggcaaagcagccatctcagatggaagaaggccccatggcctcccaggaccgggcctcactcctgctccagccagcccggaccccttgttccacgtcatcatttcaaccgtgcctaactctgcatcctctctcaaggcaaacctagtctcagaatttttcctgggtccttcagggcccaacaacactgcaccagagcaggccaccccacctctcactgacaccaccgcttccatcttccagacctgattgtgtcactttgctgctgggtccctgctgccttcaggatgacacccaagccccttagcctggacgtgagcccctcatgaccagaccctgccagcctctcctcctttgcagttcatcatggccctccttaagctcagccatcctgacctcctgcactttcctgagtgtgcccagcatttcttgccacctctgggcctttgcagacgtgatgccttggctctaatagccttctctgctctgatctgctggtgaactcctatgcaaccttcaaaacccatctcataggtgccctcctccagagtcattcctgcctctctaaggtaaggtaggggctgccttcagctcctgcggcaccctcatcccaatccagtcctctcagtcatagtactcagcattcttgcaagcctgctactctcttgatgggggctctccagggcgaagtcctcaggaatgccctctgcaggtccctgacctccaccttgcgctgttgaggactcagaatctccaagttcatggctgggcgtggtagctcatgcctgtaatcccagcacttcggaaagcagagacaggaggatcacttgagcccaggagttcaagactagcctgggcaacaaagtaagaccccatgtctacaaaaaaagtttaaaaaattagccaggtgtggtggtgtgtgtctgtggtcccagctacatgagaggctgaggtgggcggatcacttgagccccggaggtcgaggctgcaatgagctatgattgcaccactgcactccagcctgggcgacacagcagaaccctgtcttaaaaaaaaaaagaatctccaagttcaaagctaaaggctcccaccttttgtgaagaggccctgcaccaagaggaaaaagatccagcatccaacatagtcctccgctccacacacacactctctgcagtccccgctaactcagccctgggccaacagacaaaagtaccctggctatgacccttcctcctgcctcaagtcaggcggattgcttgaggtcatggtcacggcggccatgtgaggggaatgaccgggcccactgacagaggaggaaactgagtctggaggtggggagacatatctacccacgcctacagcaaacagtgggagagcaagctgtttgactccctaaagcagccctttgtcgagagtaggttgaggacatacccactccggggacacaccagctggtgcctgggcaggacaattggcaaagcatgctcagtcaggggactggcagttgcatgcaaggacctggaatgcaccgctgcctgcccagggctaaggacacacatcggcagggtcataccagttgtccccgtggagcagggagatggatgtacaagctgagcgccctggcaggagacagaaccagggcatgggctgtgtcataggccgggtggccacagacagcctgtgtggacgggaacacagctgcgggcccacgacacagccacgcggcggtgtacccaatgcagacccctgtgattgtgtgcgtggcccagactccactgcagatggtggcagaatgtggccagtgtcaccctggagggagaatagggggttgggagcaggtgggagcacatgacccagtctggggtccctaaaagcaagcaagtcctgagcgcaggttggatttggacaggacagggatgtaggaactacattctacccagggggagtcagggagcagaagcccctccacagggggaggtggaagagagagagccccaggagttcagggacccctaccagagccaagctggagacctccccccaggggctgggcaaacgcacacagccctctgacgccaatcacctctgccaccaagcccagcagccacaaggcaggactgtgcgtgccgccgcaagcccccaccactgcagacagctgtgaccccctcctcgctggcttcccaccggaatgcacgactttggaaggagactgtgtcatccaagaaacattctatgttttccttggtgcgtgctctgggaacggggcaagaacagccgtccacatggccgtttgcatgcttgggcggctgccgggccgagggccacccatgccagtagtgtcctcactccggtggggcctggcctcagcaaagccactccctgcaccacctgcctgggaaacctgggggaacatctctggggctgggatctagagggaaagaatttgcagggaagagaggtcacccccgcacccagcccccagctctgctgaccaagcactgtctttgacagagagacaccctgggagacagatggggtgcaataagcacagccacagccctctgagcctcaggcttcctctccatataatgggctctctcacggctctgagtctcggcagtggtgggcttccttggggacccaatggtggcaagggagagagtgttaaggaccaagcagctgccagcctttccccccactgcccctctggccctcagaaatgcctcccacctaggcagcaggtctgggtgtcactgagcccaatgcatgaggtggctgacatcgtgcacccaccgaccagccagtcctggatttgcccgcagtagagcctgcagagggggtggcaggtggtacctgcccgccagcccccagtcctggccaaccacccacgcttcaggggttaactgcacactccagcccactcctgttttcaatttggacacagtggaccaagcttaaggatttgcacgtttccttgaacatttctcggctggggtccgagtcaggcggattgcttgaggtcaggagttcgagaccagcctggctaacagggtgaaaccccctctctacaaaaaaatacaaaactagccaggcatagtggcacatacctgtggtcccagctacccgggaggctgaggtgggaggattgcttggacccaggaggttgaggctgcagtgagctgtgattgtgccactgcaatccaggctgggtgaccaagaaataatattactttattttctttaattttatttatttatttatttatttatttatttatttatttactttgagatggagttttgctcttgttgcccaggccggagtgcaatggcacgatcttggctcactgcaacctccacctcccgggttcaaatgattctcctgcctcagccaagtagctgggattacaggagtgcaccaccatgcctggctaattttttgtatttttagtagagatggggtttcgccatgttggccaggctggtctcaaacacctgacctcaggtgatccgtccgcataggcctcccaaagtgctgggattaccggtgtgaaccactgtgcccagccagaatattaccttaatcaagcctctagatataacagccagcttctcagaacacaaataatagaattatatattactccggggggggtggatggtgaagctctgcccccaagaccagcagcaccagctgcccctgcctgggtggccactttacaacagcaaatctggaggtcgtcctggcccgtgggctcccaatggagcccgaacagtggctttgacagatgaggaagccgagacccactgaacagagggagtgttcttaaagccagggacacccggcgcagagcccatgtggggcttggggagcccaggggacttgtcccttggtcttccgctgagcagctttgaagagggcgcatattctgggagttagagacccaggttggaatgggcctgtctctgcgtctctgggcctcgagtcccctaccttgggggcacaggtgtgtatctggggccgaggggatactgaggctatgcccttggagactggctctctccagctggcaatctcattcagggattctgggactgaaaatcctccagggctgggcgtagtggctcacgcctataatcccagaactttgggaggccgaggcaggcagatcacttgaggtcaggagttcaagatcagcctggccaacatggtgagacccccgtctctagcaaaaatacagaaattagccagatgtggtggcagccgcctgtaatcccagcttcttgggaggctgaggcaggagaatcacttgaacctaggaggaggaggttgcagtgaatcaagatcatgccactgcactccagcctgggcgacagagtgagactctgtcccaaaaaaaagaaaaaagaaaaagaaaatgacctctcagtgcctaggatggcagcccccaggttcaggccctcagctggaacccctggggctgtgaatgaggtgtgaggaaggcggggcctccaggcagctggagtgcaggagggaagctgggctggacctgggatctctggacccgcgaggcctgcccgacctgcctgccccctgcccagagcgtctaccttggcctggctctcacccagtaggtggaggcccaggggcctggaatcagtcacatccggcccagccgtctaaacaggcctgaggccccagagcccgccgggcccaaggggagcccaaaataacatctgagtcagcatccctgcagacacccccatcagcctgggcccatagggaggggcctagaggcggcccagacggggaccaggccaggtcaggcagccacctgctctggcggggcccagccagcggccagcatggcccagggacattggaattagccaagtggggagagggagattggagaagagaagggggcggccctgcctgaggtgggctccagtgcgagagagacagggctgtctgcagatggtagcagttcagtgcagccagtgtcaccctggggggagaatagggggctgggagcaggtgcaagcacatggcccagtctggggtccctagaggcaagcaagtcctgagtgtgggttggatttggacaggacagggatgcgggaaccacattctacccagggggagtcagggaacagaagcccctccacagggggaggtggaagagagagagccccaggagtttagggacccctaccagagccaagctggagaccctccccccaggggctgggcagacacatatagccctctgaccccaatcacctctgccactacagcccagcagccatggccaggcctgtccgccccatactagccctgccagacacaaaggtggccccagcagaagggactgtctgcactgaggcatccacgtcatcctacccatccctccaggtgagcacagcccccaggagacccagaggagctaagattccaacaccagggcagggcgggcctgagatcagggacaggtcctaggccagagtccttcagcatcagtccatgtgatctcgactcctccccagaggcggccgcaggagcgagctggtccaggccacactgtgtcctcaggtccccgggtgggtggctctggtcagtccctttgctttacaactgtgaggtcgccctgcctcccatggccaagctggggcagagggcggatacctgaatccctgctggcctcccagcttaatccctcagctttcctgagaatggctctgctgttcttggccaagggcctccgctgagcctggcacagcctcggcttggccctcaccagcgagtgagggcttggctggggcccagccagggcggtggacatgattgaagctagaacatggggcctggcgggcggtggaggttcacttggaccccagggagtggctctgccgcagggtcgggactcacctcctggggcccctctcatctgacagaagcttcagggccttctccgagcccacctggtccagaaaacatacagaccctgctccttcactcccctgaaacaaatctgggttttcccacaaggaaagaagcagaaagttgagaacaaaaccctggttctccctcctgttacaggccttgatcgagtctctaccatttccgaggctcagtgcaaagctccacgtagaggatgcagaaatgaattttctatggagccccaggacggggccacacctctttttactgccccagtttctccaaacggccctgaaccagggatctgagcagggctgtagctaagattttgctgagcagctattttgtgcttgcatgcatgcaatgtgcttgagctccctgactccctgccacaccctctctaagagatgaggaaactgaagctcagggagggtaccttgcccaaggtcaaagtgcccaaagtggaacaagagggacttgaacttgcgccatgtggactcagagcctctgcttttaaccacaggggtgtagtgggaagggggtgtctggggaagggcgtgtctggggaagggcggaaggtcctgaggccggctcagagggagacaggcattgcaggtgggcagaaccaggggaggaccgaatggtgctgaatggtgcccgaacagtctccaaggaccatcatagaaacccaggagcccccctggtccatttcattagtgatttgtgttttcacatcttttcatttacaggccttatttggggacctctttctgcaaaggtacttggagagaaacagtacaacctcagaaccccagttacccaccaacttccttttttattttctttttttttttttttttttttgagacagggttcaatctgtcacccaggctggagtgcagtggcacgatctcagctcactgcaacctccaccttccaggctcaagcgatcctccagcctcagccccgccaagtagctgagactacaggcacacgccattaagtctggctaattttgtgtgtgtgtgtgtgtgtgtgtgtgtgtgtgtgtgttttgtagaaatggggttttgccatattgcccaggctggtctcgaactcccgggctcaagtgatccgcccaccttggtctcccaaattgctgggattataggcatgagtcaccacacctggccccaagttccattttttaaaaattttattataatcccaccccaggaacagctggctcaccagatggtaagtgactatcccgtgagatggctccattaagtccatacattgaatattggagtcaagggagaaacgcagaattaggcagacatcagactagattggattcaccatcatattctcaatgctcagcacaggaacagaaattagtagttgctaaatcaatatttgctgaataaacaagtaagtgcctttctgttaaatgggtaatagccaagcttctaaactatcttattatcattattattattttttttcttttagaaacagagactcactctgttgcccagactggagcgcaatgacgtagtcatgactcactgcagccttgagctcctggactcaagtgagcctcctacctcagcctcctgcatggctggagtacaggcatataccaccatacccagctaattgttttgtttgttttttgcagagatgggggtttcgctatgttgcccacgctgatctctaactcctggcttcaaggaatcctcccacatcagcctcccaaagtgctgggattacaggcgtgagccactgcgcccagacaaaccatctctgttaattgatgcctgagtaccattgaatgaatcatttaaactctactttggattaatcctaataagggatttagactagatcagggtcatttaagacacaaagtataggccatacctcccacttcttgctcccagcagacatgacccattgactgtgtgattcccgtctgctgagactggatatcctcagaatccttcttaacaccacttctgatggccattgcccatcaaacacagttggtgacggaacctatctgccatactggttggaatgagctcccccagcccattaaagagagaggcagctgagagaaatccaggctgtagggagagtttagggaggagtaaggagggactagataagatgctcttttttttttcttttttcttttcttttttttttttttttttgagaaggagtctccgtctgtcacccaggctggagtgcactggcacgatctcggctcactgcaacctccacctcccatgttcaagtgattctcctgcctcagcctcccaagcagctgggactataggcatgtgccaccatgcctggctaattgtatttttagtagagacgaagtttcaccttgttggccaggctggtctcgaactcctgacctcaagcaatctgcctcagcctcccaaagtgctaggattacaggcgtgagccacctcacccagccagggctctttaaagattcctaattccgggctgggcacagtggctcacacctataatcccagcactttgggaggctgaggggggcggatcgcttgaggtcaggagttcaagaccagcctggccaacatggcgaaaccccatctctactaaaaatacaaaagttagcggggcacagtgtcaggcacctgtcatcccagctacttgggaggctgaggcaggagaatcatttgaacccagaagatggaggttgcagtgagccgagatcgcaccactgcactccagcctgagtgacagagtgagagtctgtctcaaaaaaaaaaaaaaaaaagaaaagaaaagaaaaagaaagagagattccttattctggtctggggaccctcagagttccatgaatgggtgagcttctccaccaccaggagagggaacacaaaaacccacatggagaaaggatggtggcccccagcttgctgcctgaatcctaacaggcgttggaaccagctctcagcctgaaaaccacaggcagctcagagcttttattaattccaggggctggaggaagggctggggccctcgaaagaggctgtgcagctgacgacccaggagggaagagttttttttccaaacgctgaggccaccacgctttgggaagggtgagggtagacaggccaagtcctggctctggggggatttaaaatgctgtgtcaacgtaggtcatagacctaattgtgaaagggaaaactgtaatgtttctaaaataaagcttaacagattatcttcatgaccttcaggtgggcacagatttcttaaacaggacagatgaagcactaacccctagagaaaagacggatacatttgactttgttaaaattaaggaattgtagtcatcaaaagacagcattaaaagtaaggcaagccaggcagggtggctcatgctcataatcccagtgccttgagaggccaaggtgggaggatcgcttgaagccaggagttcaaggccaacctgggcaacatagcaagacccccatctctacaaacaatcaaaataaatataaataaaggcaagccaaagattgagagaagatctttctcacacagatagctaactgcagaattgtatcaacataaagaactccacgcatcataaggaaatatcaatcctattttcaaaaatgtgcataagacgtaaaaagtcacttcacaaacaaggataatcaaatgcccaaaaagcgtgtgagaaagtgtgcgccatcattactcatcagggaaattaaagttaaaatcacactgggagcccagcgcagaggctcccgccagtaatcacagcacttcgggaggccaagatgggaggatcacttgaggccagaagtttgagaccagcctgggcaacataatgagaccccaagtccaaaaaatttaaaaagtagccgggcgtgttggtgcacacctgtagtcccagctactcgggagactgaggcgggaggatcacttgagcccgggaggctgaggctgcagtaagctatgatagcaccactgcactgcagcctggataacagagcaagaccctgtctcaaaaataaataaaatactcttatgagttgcattagcagttgcgtgagcagatgtcatctggcaaaagtcaacatgacaacatgcacacacagtgcctcacatccacagatatactgacacagagacacacacagacacactcaccctcactgctacatccccagcaggcttcaatctcctctgggaggggcagggggcaggaggaagaccatccaggctgccccggtgatttcaaggagagagcacaaggcagagaaaagcagtgtctgcccagagccaaaagccaaaacctgcatgaggggccagggggaccaccccactgagcatgcttcttcctctgggagctggcaggagagttcaggcagctggatctcttctggataaacaatgtaatgcaaacccagggaatgagagcctcagaccctgcaggagtagaccccggggtgcagagaaagatgcagacaagaacatggggagatggacagagagggagacagagatgcagagaggggtggaggccgggcgcggtagctcacgcctctaatcccagcactttgggaggccgaggggggtggatcacttgaggtcaggagttcgagaccagcctggccaacatggtgaaagcccatctctactaaaaatacaaaaattagccgggcatggtggtaggcacctgtaaccccagctactcaggaggctgaggcaggagaatttcttgaaccagggaggcggaggctgcagtgaatggagactgtgctactgcactccagcctgggtgacaacctgagcgacagagcgaggctccatctaaaaaaacaaacaaaacaaaacaaaaaaagaaaaaagattgagggggataatagcaccactctgcttgtctggagattaaaccagttattgtaatagaggctcccagcatggtgcctgacaaccagtaggagggcagttcaggctgaaagctaaagccatttctcgcctcctccaggaagccctcctggactgaccccatctggcactgcttctgcctgacctcccgccctaatccccattatcactttcaggtggttttttttacaccagtgaattcccatacacagttcagggtagggggacaagggctcccaccaatttgggctcatggaagacgagtaggtagcccagcatgaaccaaagaaagggccggggacaatcacatgccccttgccgggcatcatactcagaccgtctagtaacacagtgtgacttggaaggacctcttaagaagtcagtggaagtgggggcttttctcctaaccaggatattttgaatatgggtctgggaggggcccccaactccggaaacccacccttccagcccaggcacaaacctaaatcagagaggtttgctttcaggagagggcaagggaaggtttgcaatgagcgtgctgatggttgagaaaggaatcagggcatctgcaggtcttagctccaggatattcccttactgcacttggggctgggaggaaggaggaggccccctccctctcccagtttcccacaagtcttctgttatgggctgaattgtgtcaccccaaaattcacgtgttgtcctctgagtcccccaggacctcagaatgtgactgtatttggagatagcgtcttttttttttttttttttttttgagacagagtctcattctgttgcccaggctggaatgcagcagcctgatctcagcctcccaagtagctgagattacagttgtgcaccaccaggcccggctaatctttgtatttttggtagagacaaggtttgccatattggccaggctggtctcaaactcctgacctaaagcgatccacctgctgtggcctcccaaagtgttggggttacaggcgtgagccactgtgcctggtcctgtccttgggattctgaggatctgaacccattgattgtccccctgggagtctggagggcttatggggccaggagcagacatggccccacctgagaaccatgaccccacctgtgatccaagctgggggcccaagacctcagcaccaagctcttatctgcttggcaggagactgacctgtgaccaccaagggggctagggaagtgtgtagcaatagaggtctccccccatccctattcattttttttcactcacacattcactcagctgcattgcagatgcttgctataggaatgacaacagccctcagggtagacagagagaatgatgtgtaaatagtcatggcaaccgtgccttttagactttttgacagtgctgagccgaaaaacaattcatcacgatccagtacacacatgcaaacacataaacttaaacaacggtgtaggccaggcgccatggctcatgcgtgtaatcaggccgaggcgggaggatcgcttgaggccaggaatttgagaccagcctgagtaagatactgagaccctgttcctttttttttttttaattaataactttaaaaaaaattagccagatgtggtgacatgcacctgcagtcccagctactcaggaggatcacttgagtccagggattcgaggctgcagtgagctatgatcgtgccactgcactccagcctggacaacagagcaagaccctgtctcaaaagataggagaaagaaggaaaaagaaaaagcgcaagagacagtgctaaatttgatcacttgcgcttattctattctattcttttctattctatttcactccattcaattctatgacagcccatcccatctgaaaatcctgttcctggccgggcacggtggctcacacctataatcccagcactttgggaggccgaggtgggcagatcgcttgaggccgggagttcgagtccagcctgagcaacatggtaaaaccctgtctctaccaaaaaatacaaaaataagctgggcacagtggttcctgcctgtaatcccagccattcaggaggctgaggtgggagaattgcttgaacccaggaggcggaggttgcagtaagctaagcctgggtgacagggtgaaaccctgtctccaaataaataaataaatgaaaatgtcattcctggcccactaaagtgattccaagcctcactaatgggtcacaacctgaaatttgaaaggcgctgattgagtgaaagtccttcataggagccctgaggtgacccgggccaagtaggaaggaccagcgtcctctgagagtctgttaccggcaggctttaagcagggcacggacacatggggtctgtgctctcagaagctccctgcaggcggctgtgtgggtgggcaggaggacaaaggctgggtgcctggtcagggctgccttcagccttcctgcttttgcgtacaccaccggaaagcaactccctttgggagacgggaacaggattcagctccagcatcgactcctccaggaagccttcctgattgcctcccctcctgcaggctctgaccctccgttcccaggactgcaggtgctgttgtcctctatgcctgtctcccctccccaaacccaatgcctgccagagcaggccactcagaaatgtggagaacagaatgaacaaggaagtggatcaccccaggcccagcaggagcccctggcccagcctcgcctgcctcccacccagcatcctggcagctgccctgcccgccctgcaggacccgcctggcgccacagggatcaggccagctgagggttccgggcatgggtggagggctctgcccagggcggggagcagccgaacgtggtgtggggacggagacgggcaaaaccaggaggaagagagctcccccgacccggcagtgttcccggctcaggcgcttggaagggctcctgagcatggagggctgcgggaggccagggagataagggctcgagggagggcgcttgggtggggtaagagctgtagcagctctgcccactggttcctagagccagctcaggggagcaggcagctcggccctgggtcccacaacatgtgcagcccagggaagagaaggctctgctttccaggtgtggagccgaacagagatcatcgctccaccctaaagcagtgtggctggaggagtgaaatactctagaggcttgagctccaggtcacagtgcctttgggtgaccttccgctggtcatgtgtttcctcaaggatccgtttcctcacctgtgtggcaggatagtttattgagtcatgaatatctgttcttatccaccctataaccctcccctcttgccactttccaagcggctctccacgttgcaagcaaaaagccgccgaaagtcatctttgagatgagagtgagtatcttagactggaagcatctcctgccagcccggagatgacagaatgtcctgcaggccactcccttggaagcacctctggaggtggtccagccccgagcttcccagcctcagattccagcacagtcttggggtgcacacgagcacacaggctccaacaagggagtcagggagtcagggcccctactatctccaggctccatctaagatgcctggattttggtggggggtggaagtggaggaagacagacccagtaactgggatggaattcactgccacctacccgtgtgacattggcttaaattaaattaaacagatctaaggcagacaccaagatgctctttctggtggggccgagtttatagacaggactcctaacccttctgcttgttaaccggcataataatatccccattggaaaatggaagtgtgctttgcaaacggtcaagtgtcaaacaaacaagaggcgtgctctggactcctccatcccgggtcccatgggaagggggtgcacagaggagggccggctcacgatgttcccctctagatggcaacagacagcccgtgaggcactgtaggaacagcacagggcagaacagcccgtccgggacacccacctccccacccccggctcacactggccaaagatccagactgacaaatgactcagacacacaaacgcccggggctaagaggaaacacggcatggcccggaggttgcagggggcagcactcacagggatggggctttctgctatgcctacccctccacccagccatgatcagtggcctgaaatggtgtcatggaccccctcccatgtttgagcacttgctgtataccaaattcttacagatatgtttgtactcttaaatggttatgaagatcctgtcttcataggacgaaaccagggattctaggggtcaattactgttgatgtcaccatccttcattattattagataatctggccaaactcatacactaatcaacatcagtccccatcacaaccacaacaacgactgctgacccttccgaacccactcccagcctggggggttgcagaagcaccgagttccagaatttcagcctccctcccacaacgtccaacgcaccccctcgaagcacagcctgtccttcttttgagctggctctgtgtgatgaagggacacccagcaaatggcccagacccatgggcattcgatctattttcggttgcagtccctttacctctgacacctgtgcctgcgccagaccccttcctttcctggccggccatccgaggggtccctggtggcctctgggaagagaggaactgcagaagtccctttcattttccagctgaggtgctggctctgggccgatgctgccgggcaccccacaggaggtagccgccctctctggctcagtcaccagcacgagggcagggccactcctttggggctgcttgtcacgggtgccctttgccagcctccaaggacatccttccttctctgtccctctcccctgtcctcaagccccgtcccattttgaacctctgcatagcaggattcagattcccttccaagcgcatcagaactaaggctagctctggctgggcatggtggttcacgcctgtaatcccagcacttagggaagtcgaggcgggaggatcacctgaggtcaggagttcaagatcagcctggccaaaacggagaaaccccgtctctactaaaaatacaaaaattagccaggcgtggtggcgcgtgcctgtaatcccagctactcaggaggctgaggcaggagaattgcttgaacccgggaggcggaggttgcagtgagccaagatcgtgccactgcactccagcctgggtgacagagaaagactccctctcaaaaaagaaaacaaaccaccaaaaaagaactaaggctagctcatctcaccagtcctttatgatctaaaccagtgctgtccccggtggcagctgctggccacatgtggctaatggagcacttgaaatgtgacaagtccagattgagacgtaccctcgatgcaaaatacacaccagttttaagacctggtacaaaaaagaatgcaagatatctcaataacttttattttgattggatgttgaaaggattatactttagatatgttgtgttaaatatattactaagaatagttttacttatgttttcttttatttcatatggctactagtaaatttaagatcataggaggggctggatgcggtagctcacacctgtaatcccagcattttgggaggccgaggcgggcggatcacctgagctcaggagtttgagaccagcctggccaacatggtgaaatccggtctttactaaaaatacaaaaattagctggcagtggtggcggatgcctgtaatcccagctactcgggggctgaggcaggagaattgcttgaacctgggaggcagaaattttagtgagcggagatcacgccactgcactccagcctgggtgacagaacgagactccgtctcaaaaaaaaaatctgaactttgtctggatagcgacggagggtgtctgagcaaagcacgatgttctcagagccatccagagactgggaactctgtcctaccaaaatgggtgcacccagaggagctggaagatagagatgccctgtgggtgactcatctggttgccccttggtggcactgagccaggcaacaagcgggaaaggcttgtcaatgataacggcaagaccaacgatcaccaggcagccaggtgcacccggtagccctctgtgggcaattctgcatgtatgaccttatttagtcatacagctaggcaaggaggtgacactaagcatttgagtactgatggggtcttgaatgaacaagtaaatgaatgaatgaatggatggtggccgatgactgtcatctctagttcttacattatgtatcttatgcatcagactacacggcatggatattcagtgcaatggatttgattgtgaattgaggcccccttttgcaatcttgttgcatgttatgttcgtggagctcctgcaatgagcagaggctgctaagcagaagcagcgcacaggctgggggcaggacacagggcccccggcctcaggggagaggtctgttccagccacctcaagtctattcctgtgagtgcccctccacacccctcctggatccccccactgcaaactctctccccctggctccggactctctccccgtcctggaattaataaagactctgtgcagactgcggtttgcaagtctgaaagctggttcctgcccgtgtcactgcctcgagaagagaggggtccagctccccacagtagcccctgccttcctccttcccaggcaggcggaggcacgcagatataccattgacttcccctcccctgcagcaggcacatcctgggcatcgagcttcagaccctgcccctgagcagcccctaaccccaccaacaaagggtggcttgggggggctttcaccccagcataatctccatcagctaccctcaaagcacccccaaataaacacacaccgtaagtaagagctgtacactggctgtgtgcgtacatcttcaagacaattctcccagcatgcccctaccttccaaaattccagagctgctccctccaaagacccagggaaaaggaagggtttgtccagggtcctggggtggccccgtatagaccaaagcctgatagctgtcctagaagcagagtacttgcagagcgagtgacggcaactgtggtattgacaccagtcctagcaccagctgaacacagagcatttttgatctagcagaaatacaagaccacgttgtatttgtctttgcaataatctcttagctaggaatactgatcacctgtagacagataaggaaactgatgctctgtggagaggttttcctaccagaaaggctagagccagaaatttacttctaggtccaccaatacctgcctttgaccaatgcctgcatttgacctttccacgctgagccacccctgctggcactccagactgccacagtgctcctgcctccacaaggggtctttaactcatccctcggagccatcgtggtgcagggaaaagcccacagggcgtgtggcttccatgctgttccctgactggctgtgacctaggacaaggaacaagtttccctctcctattctctaggtctcacatttcttctcctctagcagtagtgggaagtgaggggtgggggacacgaccctcccctgttccatcccacactccaacccccaaaatcccccagggtccccgtccagctcagtcctgggggcagaaatgcagagttctccaggaacgtggtcccagctgtttcagtgcaggccgccccctcctggccaccagcggaatgtcagccttcccagaggggccgggagaacagcagtcgagaagctcccagactggtgtgggcgctagctgtgctcagcgtggggatgggaggtgacccagtgataatgggaagctgggctgcctgtcagtctgcggggggctcccacctccctgttcccccacagggcacctggggatccagcctgatttttaccagaccctgcggcctgcatggggctgggtatagggctgtgaccttgacccatgcagaatagaaccctgtgtgtcgggatcctccatgtgctccagatgcccctggggacagcaccaacatggccttaactcccaagccattcccctgcctctaaccccctggcatctgcaggcatccaccccagacccacccaacacctcctccccagcttcaggcgctaggcagagaccttggcccctgcagaatgcagccctgtccagggtcccctaccttccccccagatccctcccagagcaataccaacccgggcctaccttccaggccattcaacctgcagccccccggcctctgtagacatcgcaccccccaaacccccagacctgcccaatgcctcccctccccagctttgggcagaacctgtctctagccagacctgggggtgttggggagtctggagggccggggtgggggctgaggcgcgggacagctggcccgtatcctcacactgggcccggggcccagccggaggggcgggggcctggccactcgggccttggctggggctgggatttttggcctggccgccaggccctcccttctgcttcctctcccgagggctgtcctggcagaggcccccctcgctctttctggcgggaacagggccagcagcgaaagaacagtcgcagagggaaagcgggaaagagatgggggaaagtgtgtgtgtgtgagtgtgtgcttgtgtgcatgtgtgtgcgtgtgtgtgtcaaggaaaaaagctcgcagtccagcagcccgggcctgggaggcttgtgagccgggcctttcgtaattgtcccctccccgcggccccctcccccaggcctcccccctctcccgccctcccgcccgccctctctccctccctctttccctcacagccgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggtaaggacccctcgcccctgtccccagcgctgcccacagctgcgggccctttgggccaggtgactagacgctcaagggggagaccttcgtccctgggaactgcaaggggtcccaggtgggagcccctcagccactgggtcctcggaactgcccctcccaggagccagccccgtgcccaggaggaacctgtcaaagagacaccctcgactcagaatagtcccagcccagcatccaggctttgctgccctgcgagggctgagggggcccctgctcaggtgcccgggtgcccgccctgtagggggatcagagcatcctgggggagggcccagcgggaacccctgggtctggagacaccacagtctgcacacctgtggacacagctggggtgcacaccagccctggggacagggaacctgggcttgataccagctcaaccgcagtgagctgtgtgacctcagcaggttccttgacccctgggaagccgggatccccccgtcaggaaggtcagggctccgctgaggatgggtttgcaggttgggaagctgctgctgtgttctccctgctgaggcaggcagggactcctggtatgcatttgtgtgtgtgtgtgtgtgtgcatgcacacaggaatgagcgtgctgtgtgctcgtgtgtgtatgtgtgcatgcacaggtgtgcatgtgttcagatgcccggctgtgtcactgaacagggaaagggatttctggaggggtacatatgtctgctcacaggttcatccttaggcaggtgtatgcgtatgtttggaggaggtatatgaagctgctccttagtgtgtgcaaaagtctgccacctgacagacatgtagacatgtacacatgtagacatgggcgatctggcatccaggtgtgacactggtgtggactgtcactgtgtgtgttatggagtgtgtacatctgtgtgtgtgaatgtgtgtgcgatgtggcacgcaagcatggaaaggcgggctggagaaggtgtctgtctcctggcagaggcagtgtggctgagacagaggctggagtggatcctggggcactgctgggccatctgctatgtgccccaacccaggcacagttggttatggggtttgagggtgtgccctgtggggctgctatgccgcggccaacgggggaggacagaagaggctcccgggcatgggaaaaaggagggcatttggtaggggggtctgggtggagtctggtttcctcgggagtcctccttgccatgagaaccaaacgctgagtggggggcgggagggccacggggtggagtcaagggcctgggcaggagctgcagctgtttccgtgagattgaacagcttcctgtgcagggtccgctgctggacctggatgaggccaagggacatgggtacccacaggcgggccccagcaggggcaacgagccagggcctgaaagcagcagccccgggtccgtctcagcctcctccccaggtgtagcccccaaacacccagccacccttcttcccagatggggccaccacctatagggtggcagttcatcatcaaggaaccttgagaattagaaattattatcatcacttgacaaacaaggaagctgaggctccggcaggctaaggcagtccccgggggttagtatcagccagctctctgccccaggtcaaggggcaagggggttaggagtgagctagcaggcaacatttggggaggggaaggcttggggctgagtccttaaagcaggcatgccctaggcagaatcagctctctccttgtgtcctcagtgacaccgctaaacgcccagctggcctcacactttgcagagatcaatctcagctctgtcccaggtggctggacttgctaggtccaaataaggggtgtgtgaactgatgagctcgtgtggggttttgcacagaagtgctactgaagtctgcagaggtcggggagccaacacagggagtggagcgctcagtcacatgctcactgccactcacctggctgtcctgggggagcctggcttctccctcaaggaggagggtgtcacttatgcaagttcagcggctccaaggaaggaaccctgttgcgggggtgggggagcaggaggaggggacaagccgcacagctcccaggctgtttcaaaagtgagcatgagaaattaacccagggataattcttccccatcccccagaaatagtatcagggatttttttttttttttttcctgatttcagaactgaagatggtttggaacagaggtttccttttcttttattttccttttttatttttatttttttaccttttttattttttttaaattgagacagggtctcgctgtgttgtccaggctggtctgaattcctgggctcaagtgatcctcccacctccgcctcccaaagtgcttggattacaggcatgagccactgcctctttttaaatatttttttaattattgttttccgtccttaagtaggaacaggggttttcaacctggctatctattagacttcccacccaagaatccctgcttgctttggttggagagggacctggacacagacttttcaggcttcccaggtgacggtggggtcgccagggccaagaagcactggtttagaggtcgatcccgctctgtgtgtctgccgaggccccggcatgagggcaaatgtgccctgtgtgggaggggacacagtcacccagtggaggacagcttgtttttgaaaacccttggcagccttctgcatgcaaacaacaaacagcttcgtgtggtcttatctgctccccaagccagccccctggactttggtttggcaaagccccctgccaagatcggctggccccaggctcgctcccaaacaggctgcttccagctctttgaacctggagcccagggcccaggcaaatggccctacatgtgacttggggtcagctgggggtcccagaccaggctcttcagctcactggttctccatttccctggctgcaaaatggggagaaacagccctgcctgaagtacctcctagggccagtgagagcttctagcaatgtaatatctggggggaaaaaaagcatcaaataaaaggaccgtgggaatgggcatttttaaaataatctattctcttattcagagtctgctaatttgggctcatggatccttgtaattagtgcacattgctaaggtttaatactccctctcactacttacaccatgttttgtctagtggaggggcagctaatgtgtaaatagatgtgcaatgatgaaagaagcagacaggactcggttgggggtggccagaaggagccttgagaaatccaggaaggcttcccagcagaagtgacatttgagttaaacctaaagagaaaagtaaatggggccaggtgcagtgactcatgcctgtaatcctagcactttgggaggcccacatgggcagattgcttgagcccaggagtttgagaccagcctgggcaacataggaaggcccccgtctctatttaaaaaataaatgaatatttaaaaagaaagaaaaagaaagaaagagagagagagagagagaaaggagagagagagagacagaaagaaagaaaggaaggaaggaaagaaggaaggaaggaaggaaggaaggaaggaaggaaggaaggaaggaaggaaggaaaatgttggaggacctgtctgtggatgaggggtaagtccccagactacaggccctggcaggcagaactgaagagacagaagagcagattctcgattggaggaagccctgtctgcagttagtgctgacagcatttggaggtggtgattttcccatcatgggaggtatgcaagcagaacacgaaggatgtttgtggaaggaggtccagcccaggccagaagactattatgatccctgagagtctaggatcgtgattctaagatgcaagagacaagttccaccctgggctagtcggtgaaacatgccaaaaccacataaaacaagacaagtgttctccaggccaactgcttagggccagctgagcagcacagtcagggagagccgtgggctcgggaaaggcaggcgggagagtctgagctcagccctggtgcgggggtaggacttggacagaggcaaggacattcctggcaggagaaacggcttgtgccaaggagtggagggagaagtgaggatcgccacggggcctggggaagcagctgttaccttttcaaagtcctttccaatttccagctgctgtcattttattctcacctctctcacttgcagagaggcaggaatccttcgtagcccctaaaccttctccatttcctcattgcaaagtggggattaaaacctcgggctccccaggccgtcaggttcaggcatgaagtttggcaaatgccaccatcatcagggtctgaacggtgggggtggagagtggggacagaggagatctgggggaggggaagctaagtcttccccccagaaagtgcctggggtgcaggagggcagaaccccaggagaaaggaagtcagggttcagccaggcccaggggctcaacaagcccaaggcagggggactcccagggcagatggggatgaaacaggttagagctggattcacagacaaccaccctgccacccctctacttaattcacccatcatgtattgagtaactactgcatacctggccctgggccacggactgtgcagtgaaatgggaaaaaatgaaacgtaagtgccactgtctttttatttttgagcaattactgtctgccaggtccagaagaggacatagcctattacttgaacccttttacaacttgcagcaaccttgcaaccttgcagcaaccttgcaaccttgcaacaaccaagtgattatctgccccatgtcacaaaaaaggaaaccgatgttcagagaggttgagtgactttcccaaggtcgcacagatggtaagaagcagcgaaggcagaattagaagccagaggggtctgttctgagcactttgctcttccccccacctccaccacactgttccctgcagtctgctctggagccagagagtagagaggaagggagagaggcacgtgaagaatgagggagagggggagaaagaggaggaaggagagaggccgaggcagagaaagacgcataagagactgttgagagctggaggccggagccagggaaggcatcagaggcccgaggcgggccatgtgtgtgcttggcagcggatgacagggcccaagtgctccttctcagcaggcccagcccccctggggccaccactccgagccttgaggttctgaccagattacttgcacacttcaggcctggactgcagtgcctgaggagccacaagccctgggagggggtggcgccggggtcttggctccggtggctgtgacagctccacagccctgaccctgctgggctgcagctgaggctgacagggccctggggccagcaagcccagctgtgcagcgtcgccaggcctcagaggccagacgtctggccgcgaggcctccctggacacattgcagagacacccgttcccccagccccgcccatgccccacggggctcccggcccctttcagcaaaagcagtaagggagggctgggctggggcgttggcaaggtggcttgtcaagctcagaggggggccttctgaggtggaggcagggcccccggtttgggaccctgtctgttgccatggcgatggctcaggcagggtctggatccagcatcacagcgttccccagtgagagcttcactggtccatggggactgaactcgtgatcctgtctggccggtgaattcgcttttccttaggaaactattcactgtgctcattcatggcgtccccctgcggccccggcgcctcctaagacagcccgtgtcagacggccagagccccacccaagctcggctgcccagtggctgaggacgctgacctcacgccgtcctatcagtgtgggaatggctgcatttgtgctggcagctgcacctccttaatgctcgctgtagcagcccagcctgcccttcccaaagctctggcctctacccggcagctcagctcgggaagggagtgggctgcctggtgagaggtgctcagacccagtgtcttccaccccaggccctctccctgactccagggagaaccaggtaacacagcaagaacaatcatactctaaggactggcagcagggcgcaggggcctgtcatcctagcactttaggaggccaaggcaggaggatcgcttccaggagttccagaccagcctggggaacatactgacaccccatctttacaaaaaaatcaattagccagatgtggaggtgcacgcctgtagtcccagctacttgggagactgaggcaggagaatcgcttgaacctaggaggcagaagttgcagtgagctgagatcttgctactgcactccagcctgggtgacagagcaagactctgtctcaaaaataaagcactggcctgagcttcaatccaggccccgtctctttccagctgtgtggccccaggcatgtcccttaacctctctgagcctgatttcatgtcttaagatgatagtctctgggagcggtggctcacacctgtaatcccagcactttgggaggccgaggcaggcagatcacttgaggtcaggggttcaagaccagcctgcccaacatagtgaaaccctgtctccactaaaaatacagaaattagccgtgcttggtggcatgcacctgtaatcccagctactcaggaggctgaggcagcagaatcgcttgacccaggcagacggaggttgcagtgagctgagatcccaccactgcactccagcctgggtgaaaggccaagactccgtctcagtctcaaacaaaacaaaatgatgatagtaagccctgcccttccaacttcacaggccgatttcaaagagcaagaatgagaacacactttgtaaacagaaactgctctggagacaagcaatgtcattattgccatcagcattattcttgtttccatgtaattgtgggttttgccattgaaagtaatggcaaaaatcgcagttacttttgcaccagcctaatagttctggctcctggaggactgactctacctgtttcctttcaggggtccctggggccattcctggtggagttcctggaggagtcttttatccaggtaacgtacatgaaacttccacacacccaggtcatgcggatgatgctgatgtccataatagatgcacattttgacactacagaaggtaggaacattgacacgcctaccagaagtcacacccacttaaaaatgcaattaacaagacattgatttacagctattaagagcatacaggctggacatggtggcttatgcctgtaatctcaacactctgggaggcagagaaacaaggattgcttgaggccaggagtttcagaccagcctggacaacatagtgagatccccctctctacacacacacacacacacaaatttaaaattagccatgttctgcattgagaaaaatgaaaatgaagtatagaaattaaaaaaaaattagctgggcatagtggtgcacgcctgtagtcctagctactggggaggctgaggcaggaggatcacttgagcttaggagttcaaggctgcagtgagctataatagcaccactgcactgaagtctgggtgacagagtaaaaccctgtctctaaaaagaaaaggggaaaaaaagaaaagaaaaatcaaaagtaatactttcaatacttaaaaagtatttgaggccaggcacggtggctcaagcctgtaatcccagcactttgggaggctgaggcaggcggatcacaaggtcaggagatcaagaccatcctggctaacacggtgaaaccctgtctctactaaaaatacaaaaaattaaccaggtgtggtggcgagagcctctagtcccagctactcgggaggctaaggcaggagaatgatgtgattgaacccaggaggcggagcttacagtgagccgagatcgcgccactgcactccagcctgggcgacagagggagactccgtataaaaaaaaattaaaaaattaaaaaaagcatttgagtgtacagaagtgacctggaagtggggagagacgccagcactcccccagatacatactgacactggactactggccaagcagaagagaaaaccgaggcttgcagagagcaggtcttgcccaaggtcacgtagttaggcagaggtggattcagccatagctgggggtggcagcgggcttgcctggcagaagtaccgatgatctctctttctctttctctccccccacaggggctggtctcggagcccttggaggaggaggtgagctcagaaaccacacttgttcatcactgaaagggcctgggtttcacccgagccacatgcatcctcagacctgagaaccctgggagacccgagcatcaaggactccctcatttcacagacagcatccaggcggtgggaggaggcttctttgagaaccagaacccattggccttcccagtccctcccctagactttatgtctggtgccctctgccttcctatttcttcttttttttggtgggggaggacggggggacagagtctcgttctgtcgcccaggctggagtgcagtggcgtgatctcagctcactgcagcatctgcctcccaggttcaagtgatgctcctccctcagcctcccaattagcgaggactacaggcgcgtgccaccacgcccagcttatttttgtattttttctagagacagggtttcatcatgttggccaggctggtctcgaactcccaacttcaagtgatctgcctgactcggcctctcaaagtgctgggattacaggcgtgagccaccttgcccggccccttgcccggccccttcctatttctttttatcctcaaaaacctccctgccaagccggctgagcaggcaccatcttcttttttttttttttgagacaaagtcttgctcttgtcacccaggctggagtgcagtggcgcgatctcagctcactgtaacctccacctcccaggttcaggtgattctcctgcctcagcctcctgagtagctgggattacaggcacatgccaccacgcctggctaatttttgtatttttagtagagacagggtttcaccatgtttgccaggctggtctcaaactcctgacctcagatgatccgcctgcctcagcttcccaaagtgctaggattacaggcgtgagccaccacccccagcccatcatccccttttgaggctgagactctgggactcagagagtataaaccacgagttagaagtagagctaggttcccaggggctccaagtctgagcgggaggacctggggtgtgtgattccacactgcccacactttgcccgggttgggggttggataagtagtagatggataagctgggccaccccattcactatcttctcttccctctgcagcgctggggcctggaggcaaacctcttaagccaggtaagacccaaggcctcggagcattgagagacagcgagggagctggggagggaggagcctacccagctgggaatgggacaaggaaactaggaacaggacaaggaagccaacgggcaggaggaaggagggaggtgtggacaccgattagcctcccaaggatgagtaggccggggccaggtcccagggcttccaggaacaagaggctggaagcagctccatgtcctccctgtgtgagggcgtctagcatctaccctacatgtgcatgtgtgttcacccagctgtccagagactcctctctgcaaaggagaggctgttagaggcaacatcagggattgctccggttccagtggcctccaagccttacatgaccctcgggagctcagacacagatcctcagccccagacttcccctgagtggtcccctagcccttgaccccagaccaataccccagatcaccctgaccttgatgccattctgagcccttctcctgactccagatggagcactggtctcaagccaaagcttaaccccagcccaagccctgagcctaatcccaggctgaaccctgaccctgctgaccctggtcccacaggacccccaatcctggccttaggccaagccctgaccccaagcccaagctgagcaccgaccatggccccggataagctcccctcctaatctcaggccctttccagctgtgtccagaccacggagttttccagtaagaaggtgtggccggatctatcctggcctcgcccaaggggctgggatctgccacgagggtccactctcagctctggggaatgcacccccaggaaggaaggtggggcaggtccctccgggaaatactggcggataaggagcaggtggaggaaacagcgtctctgtccagattgatggtccctcggcatgagacgctccacatgtgactttggccgccccacaccctgagctgtgttgccctggctcagaagcccaagtctccaggacacagtttagatgtccaagagctcttatgaaatcctgatagttgataatccaagtgcaaatgaatcttcaagacccagattcccctgcgctaaaagtccatctgggttgtgaaacaccagggctggagccaggagaggcgggagaacggggtgcctggggtctacagggctctgcaaggccaggagaccctgggagcttgccacttatccccgccagcacctataccctgtcttcctggagcaggtgagggttcttagcagggtctttgacggtgaagagaggacaggggagatgatagtggtgcagaggtgtggaggtaggtctgtgcttggcctagaagacccaaattgaggaggttgtgcctgcaaagctggagggtacattcattgatcccactaggagcaagagacacatagcaggttgtggttaaacaccagaggaaagacagacaactccctacgaagttccaggatgtgtagttgcaaaagtgaagcttttgttaatgaaagatttaggttagacttctgaaagaacttccagctcagggtgaaggagtcaatccaaaggaaagtcagagcatctccttctgataaaaagggcagtgtttccaggcaaggggctggattccatgacctccccgaagactcagggctacagaagggtcggcagagcccccatggcacccccagggaggcccccacatccgggctgccaggacgtctgggcctgcccaggcaggatggaatggagcacaggcagcgcgtgtcatgcttgggaacaattaatcccttggtgacagagggtgggtggcctggcagctgcttttccacgtgggcgccaccacaggtccaagctggccctgccctgcctcagctctcagcgggggaccaggcagctggaagcctgcacacccaacaccctgagcactagccagaggccagccgcccactgagaggggcacgggcatggacaagaaggaactgggagcacccactgtgtgccctgggtaggttgcacaactaggtgctttctgcacacatgctcactggtcccagcaaggcaggtgatataatggccattttgtagatggcaaaaactaagcctcatcggagaggcaaattgacctgcttgtgctcatggaggctgggtagcagcagcagggtctgaatctagaactctctgactctagaaagaaggaggatggagctggccaggtccctggactcccagctgtggtcagcccctccccgctttctcctcctttccagatgctagaatccttggggcatttggggcaggtgagtgcaaaggaaggagggcaggcagagacagaagtggtcaggccacatgacaggatgctcaggctgggatcatgggaaaaaggaagatggccccagagaagctgcctgccccccactgcagccccagcctcttctcacttcctgtgcagtcctcagcttcccctcccagcccctctgtggacaggaaaggtctgagcatgtcccttgccctctcagagctcaggaaacatgcctggcttgagagaagcgactgccagcgcaggtgggtctggcccgggtgctgggaagtgactcctgcctgatcgccaggcactcccgcccggaggcaaagatgcttcttacatgaggctggctgagtttcagaggggtccagctcccactagtaggaaatgagggacgaggagtggttagtaacggagaccacacccagggaaagccaggggggacctctccagggtacagcaggctccatgtttgggatccatccctggagaggactcacccctgaggctcaggactagcacttgtaggagagatcgtcacataattagaaacaaacctggcatggttgtgaactctgacctgatggcccattggtcctggccaaggcagtggaatgtctcccgcagtgggagacgaagcgattgggcccagatgtggggaggagagagccagagggacccatttggcgtctcataaacatcttagtaggaggctcctgggctgcagggcaggctggatggaaggacagatgggtagtggggacacaggagttccccgatgcaggtgaaggggaggggactgagtcaagagatatctgcaaggaagcagaagagagacctcactggcctggggtgaggtctcgctcacggactctgctctgtcccagcccttgctgaaagccctgctgaatcttgttagccagcagggcttctaggagaagcacaggcctggcccaggcttgttagggatcggtgcaatgacacctgcactgcacatagtagtcgctcactaaactactggtggatgctattttatcaggatcgaccctgagcatcacaggcttagggaccagcctagggacctgagtggctgatcacagcactgccctaactccaggagacatttcccactctgggcctaggaacactgcctacactcctgtctctgtttcttatccacagttcccggagggcttgcgggtgctggccttggggcaggtgagtgctgacacccaagaaagatatcccctgtggggaccagcccctgagctcaacccagggctggtatgcagcacggtcatggaacaagggtgcaggccaggttccgtcctgggcactgacggggactgatgctgataccaactgccccaagcagctgcccaggacatgaggaaatcacagctgagtacctgggttcctttataacatagtagtgaaggctgcatggaggaagccccatggaccaaggaagcccaagggagtcgcttaactcagcaggggttcaggaaggcattctagaggaggtgggtggggaaatttgaccccaaaagatccatgcagttttcaggaaggctgaagtgagaggatcccttgagcccaggaggctgaggcttcagagagctatgatcatgtcactgcactccagcctgggcgacagagaaagacctcatctcttttgttgttcttgttgttgttgagacagagtcccactctgtcacccaggctggagtgcagtggctcagtctcagctccccgcacctggtgcagttgatctcagctcaccacaacctccacctccccggttcaagtgattcttgtgtctcagcctcccaaatagctggaattaccagtgtgcaccaccacgctcggctaatttttgtattcttagtagagacggggtttcaccatgttggccaggctggtctcgaactcctggcctcaagtgatccactcacctcggcctcccaaagtgctgggatgacaggctcaagccaccgtgcccagccacaagaccccatctctaaagggaaaaaaaaaaaaagagccatgcagttttgtcagagctgtctaacacattaacctcggcacacaatctagttctggtacttaggcgcggtggctcacgcctgtaatcctagcactttgggaggctgagacgggcagatggcttgagcccaggagttcgagaccagcctgggcaacatggtaaaatcttgtcactacaaaaaatacaaaaaaaaaaaaatttgccgggcacagtggcatgcacctgtagttccacctacttggaaggctgaggcgggaggattgcttgagcctgggtggttgaggctgcagtgagccaagatcgcaccactgcactccagcctgggtgacagagtgagaccttgtgtcaaaaaaaaaaaaatccattaccggtgagcagtgctcacatggatgtcctgcaggcattgatgtctggcagagagcggaagagcctccaatgtgcttcctgagtggggcacagccaggcagggccagagcgtaggagtcttcataggtgtggtagctcaggacctcaccccatcctcccctccgcagggctcggcgccttccccgcagttacctttccgggggctctggtgcctggtggagtggctgacgctgctgcagcctataaagctgctaaggctggtgagtggtgctctttgggacatgccacaagccctctggcttccgtggggccctccgctttgcaaagaaccttccctcaactcaggcttgggagccgggtgggtgggattgtcagttgcaatctactggggctcagggaggcagctagctgtgcccagtctgaaggtgagttagtaacggggccagacctcaatgctgggccctcagcatgcagccccgggcccttctgcctccccactgttccttacgcaatgcctcacctgtcctggctctgcaggcgctgggcttggtggtgtcccaggagttggtggcttaggagtgtctgcaggtacgatggctatccccgaactccctgggtcaaagttgcaggcctgggtggagccaactctgatgcagccccttctgtgccaggtgcggtggttcctcagcctggagccggagtgaagcctgggaaagtgccgggtcagtgcggaatccctggggctggaggacagagggcagggaggggcagagggcagggaggaacagagccctctccatgccactgcacttggggaggaagggcagggcctggcttcagtcgggcagagaaactagccaggctggtgcctgcgtctgtgaaatggggaggaggggcctggcccacttcccgggcccttctcccgggatcttggggtagaaagagacgggctctgtggcaggctgtcgggcgacagatggggaaactgaggctcaaagaggcgagtcagtgtggaagggcctgcagcgagtcccggcagagctgggggagccccgtgtcctctgactccccatctggtactcgttctgccccaccaagccctttaggaagtgacttcaggttaaacaaaagactgcctgagtctacgcagcagggagggacatctggaagctgttagccagaggtgggctggcccagccatgtaaacaggctccaggagacggagataaatccacacaccgaagagtttgcagatgacttccgaaactcgtgggaggagggttgtggccaccccacgtctgtccctggctgcccctgtcgggcacagaggctgtgggtttgagggccttggagctgcctgggtgggaagggctggggaggggtccctggaggctgagctgctgctagtaactttgctttcttttggccacaggtgtggggctgccaggtgtatacccaggtggcgtgctcccaggtgagagcaaggagggaaacagggactctataggaagaaagcagccaggacgcagtggctcatgcctataatcccattgctttgggagactgaggcaggaggatggcttgaggccaggagtttgagaccagcctgggcatcatagtaaggccctcgtctctacaaaaaaatttagccaggcatggtggtgtgcacctgtagtcccagctactcgggaggctgaggtgggaggattgcttgagcccagaaggtccaggctgcagtgagctacgatggtgccactgcacagcagcctgggtgacagagcaagaccctgtctcaaaacaaagaaaaagaaaaaggaaaagaaaagcagccccctcagcctccctagtacccccctcgcctccccgaaaagcagaggccaccagaagccctgggtcctgacctgagccatttccccaaactccaaagctcaggctaacagacataaggtccctggcagtccgtccatcccctgaaggtcaaccagccttcctgcaccccacccaagccctgatcccaggcacagaccatcatcacagcccgaggcgggcccccgaggacagatcccagtgtgaccagctatttcccaaaagctgtgagtcaccaaggggccacccaatgagtctgccctgcaggagaccctaaagagctgcccctcaccctcctttcccctgccagggcctgaccaccccacccaacatgtgacctcctgaattcccccaaaagcccagatttaggctgttatgtgggatttgctgatggagtggcccttcctccctctctcccccactacgctgaaagccaaggctgcccagccccaggggagacaggagaggtggaagacgctggcatggtcccagctgtagctggatggctgctttgggggtctgggttgtgagcgagagccccagagagcatgggcctccctggtctacgggcgagtggcaccgcgcagcagctgtccctctctttaccttttctgcggagggtggtcgagacggcttttgtgattaactccagcatagagatgaggctgactgaggcaccagctcacatggctgggaaataggattaaaactcagatcttctgaccttgagccagacagggaaggaaagtcagcactaaacaggtcctttctccacccaccccgtgagccgtgcctgtcactgacagtcagtcccaagggaggtcagctgggggacccgaggaggggaggggttcccagcagggcctgcaaggcctgccttcctacactcactgctttgtcccccggcaggagctcggttccccggtgtgggggtgctccctggagttcccactggagcaggagttaagcccaaggctccaggtatgcagctgtctggacagagggctgatggcagggactctccaaccaccttctggccccgggtgtgaaatggggtgggatcctggactggctcagggccctctgggtgacactttttatgttccagccctgggcagcctggtgctgaaaaacctcagagtgtggctgggcacactggctcacacctgtaatcccagtattttgggagggtgagctgggaggatcgcttgagcccaggagttaaagaccagcctgggcaacatagcaagaccttatctctacaaaaacatgattaaaaaattagccggacatggtcacacacacctatgatcccaactattcaggaggctaagacaggaggatctcttgagcccaggagatcaaggttgtcgtgagctatgatcacaccactgcactccagcctgggcaacagagaccccgttcccccgcaaaataagaaagaaagaaaagagggccagatgcagtggctcatgcctgtaatcccagcactttgggaggccgaggtgggcggatcacctgaggtcagcctgaccaacacggtgaagccctgtctctactaataatacaaaaattagctgggcgtggtggcctgcacctgtaatcccagctacttgggaggctgaggcgggagaatcgccagaacctgggaggcagaggttgcggtgagttgagatcaccccattccaccccagcctgggcgacaagagcgaaactccatctccgaaaaaagaaaccccagagttcatgtgagcgcagcatgcgatgactggtctgggaagaactggccattccttgggcctcctggccccttggtgctgtctggcccagtgtccacagttccagggctgtagtgacagctttttatcattacaggtgtaggtggagcttttgctggaatcccaggtgaggcaaggctggtgggagaagcagggtggccagccaggcagaggctctggcgttgggaggggttgggcacccaagatcccatccaagcctgcccaatttctcccacgcctgcagagccaggtcttgcagtggctgtagcacaaagtggcacccatcccaggcctgctccccccactggcatagcagcccaaaattcaaaggagtccagaaaaccctccagcctgtgccaagggctgcaggcccaaactggggcccaggccccaggagggagagaatcccgtagcttcctggaggaagtggcctgtcactgggaatttctcaactgacccatgatggagattcagggagtccctcgaagcaggatggtttctggatgctgtagcaagctccttctgtctgagcagaaagtggagtgggtggcggagggtttggaagggggtgctgggacctgaacttgctctctttattcccacaggagttggaccctttgggggaccgcaacctggagtcccactggggtatcccatcaaggcccccaagctgcctggtaagtcagagggacggttcaagatgcaccactcggccgggtgtggtggttcacacctgtaatcccagcactttgggaggctaaggcgggcagatcacttgaggtcaggagttcaagactagcctggccaacatggcaaaaccccgtccctactaaagatacaaaaattagccaggtgtggtggcataggcctataatcccagctactggggaggctgaggcaggagaatctcttgaacccagaaggcagaggttgcagtgaactgagatcgcgctactgcactccagcctgggtaacagagtgagactctcctccaaaaaaagaaaaagaagaaaaaaaaaatgtaccactcactgcacctccctgcacagaagtcagcctgggtacaggtgtctctggtggcagggaaggggtgttgaagcccctgtatggtcaccagccaaggagagcatgggaaagtcatctgcaggtattgaactcacacacacacgctcatgcacagagacccatagtcccgatctgaagctattaggctggtggaaaggaacacggttcattggaaagatccctctaacatccacccactcgtgctcccgcccctacctctgcaatcagcttagacaataagatgctttccactgaggagggggtgtaaggaaaatactcagactccagggccatgatggggcttgaatttgtagggggatgggtgttccatgggcctcgggggcagaggtgtcctctccctccttcacccagcgcctttgctctcctgggagcagctcaggaccctgatgtgggaggtctcaagctttagcacctgtgggggtagatctgtccacccaggttggtgggagcccagcaaggcatggggcagcccctgagtttgctctgtcctctctccaggtggctatggactgccctacaccacagggaaactgccctatggtgagtgagacccttctagactgtgggcttccagctctttccctctccagggtcctagcaagggtgctgtgcttccagccctgggccaggagagcacctcgctggggcagggttggggtcttggagtgggaatctcagaaggaaagggcatggaatttggactcagcatgggtctccatccctgccctcccacctatcaataatgagaccttaagtgagctgtgttgcttctttgagcctctgtgttctcatctgtaaaatggacataacaactccatacatgtgtttgtatttgttttcactctggctgggggtgacaggtgcagactcaggacagcttgggccccgagggcagagcagggggagggggagggcagcagtggtgatgtctgcacagatgaccatcaagcctctctgttttgcaggctatgggcccggaggagtggctggtgcagcgggcaaggctggttacccaacagggacaggtaaggaaagcctcacgtcacttccagccaagggagcactgatcttccaggctccagagccctggggtgggtgaggttccctcctgaaagcagcagcccaccctgcatccagaccctggtccaaacctggagcaggatcctgggggaggagtggggcagctccatcagcctctgcctactctgaagctcccatgtatacccacatgtcagtggattggctctcttggggctgggaacaagtgggctctggagatacaggagcactgtttcaaggtctctcccctctgcttccttcccccaggggttggcccccaggcagcagcagcagcggcagctaaagcagcagcaaagttcggtgagtgcccctggagtccccacctggtggcctccaggcccctagcctctccattcccattactattgacagcctgcctccaaagtggcccctacatacccccatttactcaaaattttcaacatcacccatctatctatccctccctccaaccattcttccatgcatccatgtatccattcatccttccatcaatctattactttctccatccctccctccatccattcccattcctccatgcatccatctatccatccatccattcatgtactcatctgcccatccatgcatccatccactcatccgtccattcattcatccatccatctctccctccatccattcatccatccatccatccattcctccatgcatccatctatccatccatccacttatctatccattcatctacttatttacacatccatgcatccatccatccatccactcatccatccactcattcatccatccatctctccctccatccattcatccatccatctatccatccatccatccatccatccatccatccatttctccatggatccatctatccatccatctgtccacacatccatccatccatttatccatccacccactcatccatctatccattcatccacccatccatcactacctccctccattcatccatcctccattcctccatgcagccatctatccatccatccatccacttatccacccattcatccatccatcaatccctccctccatccattcttccatccatcaatccctccctccatccattcttccatccatccatccacgcatccatccattcctccatgcatccatccatctatgcacccatccatccatcccctcatccatccatccatttatccatccatcactccctcgctccattcatccatccaccatctatccatctattcccccatatacccattcatccatccaaccattcctccatgcatccatctatccctccatccattcctctaggcacccatccatccatttctccatgcatgcatccatccttccatccatccttccatccatccatccaccatctattcctccatgcatccattcatccatccatccattcctccatgcattcatccttccatccatccatccacccatcaattcttccctccatccattcttccctctatccatccactcatccatccattcttccctctatccgtccactcatccatccattcctccatgcatccattcctccatgcatccatctatccatccatccattcatccatccactcatccatccatccatttacccatccatccactcaatccatccatccatccatccatacatcaatccatacatcaatccacccatccatcactccctccatcgattcttccatccatccatctgcccattcttccatgcatccctccatccattcctccatgcacccacccatccatttctccatgcatgcatccatccttccatccattcatccatccatccatccatccatctattcctccatgcatccatccacccatccatccatttctccatgcatccttccatccatccatccatccatccatccatccatccactcacccatctatccatccatccatccatctacccatcaattcttccttccatccattcttccctctatccatccactcattcatccattcttccctctatccatccactcatccatccattcctccatgcatccattcctccatgcatccatctatccatccatccattcatccatccactcatccatccatccatttacccatccatccactcgtccatccatccatccatccatccatccatcaatccatctatccatcactccctccattgattcttccatccatccatccatccatctgcccattcttccgtgcatccctccatccattcctccatgcacccatccatccatttctccatgcatgcatccatccatccatccattcctccatgcatccatgcacccatccatccattcacccatgcattcattcattcattcattcattcattcattcattctttcctccatgcattcatccatgcctccttccttccctccctcactgcctcctcccacccatccatatcagagatcagggacaaacaagagttctcttagagaatatagccactgttgtgggagtcaagaaacgggaggcatttttttctacctgaggaaagttagaaaggcttcccagagaaagtgacatgtgatttaggccttaaaaataaagatggagcttaccatgtggttaaaacaggaaagaggaggccaagcagagggaatgggtaccacggtggttagaaagataattttaggtggtgcatatataagcatttaaaatatttaatagttatgtatcaatttaatgtgtactataaaaatgttaactcactgctcaggtcagtgagttcttggctagcatggctgcagatggaacgtggtattcctgtgcccgtgcagtgggtggagtgggcatctgtcccctgccccaggtagtgcccacctcagggtcagaccactagggctgaagtcctccttcatcctcagccccagggaagccctttccttatctccccaccagcccgagagagcgagaatgtggggagaagcctgaagctgggcctcccagtggaggccccgcaggcccccctcccagcacccgaggctccttggccccagcggctggtggggacggctgcaatgtgggagcgggagagcagggctgtgaggggctgccagagccaagcagccaggcgcttggattacaaacttggctgcatcttcggaacacagggagaggaagtcttgaacattcctgcaggggaccctctggcccagggagcggccacttgtggtttctcagtatgtggcagtgattagaatgggatttgtctgaaaacatacaagtcccttaatgagtgtgttgaaatggacactttgggggagagtcaaggaacagtggagtggggtgggggcctccccagacaggcccatctggagacacccgggccccattcctggataagatcacactggtgaaaacgccggcgtctaagtggccatcctgcctgtcctcaggagggtccttgggaaactacattgcactgtccccatctcaacaggtgctggagcagccggagtcctccctggtgttggaggggctggtgttcctggcgtgcctggggcaattcctggaattggaggcatcgcaggtaacatctgtcccagcagggggcgggtgtgtccttgagatggccacagggcaaggacctcaccctctgtggctgtgttttcaggcgttgggactccagctgcagctgcagctgcagcagcagccgctaaggcagccaagtatggtgagtgcctcccggggtggcaagtccacggctcgggcccctgcatagacctcggagaccctagccgcaaagccagatggacttggcctttgttccttcccaaatatgcattgttcatgcctccttacctttgccccttctgatcactctacctgagatgccatctctattgttttgccctgattaactcagcagagggaggggaccctgcagaggggacatggctcctcccactccatcccctccagggccagcccacaggtgtctgctgcatcaactaaatgggtgcccagtggtgagaattctgactgtgctttaggaatagatcacattctagctatgcacagtggctcacgcctgtaatcccaacaatttgggaggctaaaaccaggagtttgagaccagcctgagcaacatactgagaccccatctttccaaaaagtatttaaaaattatctaggcatggtggcacatgcctgtggtcccagccacctgcaaggctgaggtgagaggattgcttgagcctagtagttcaaggctgcagtgagctatgatcatgccactgcactccagcctgggtaagtgagaatttggttcaaaaaaaaaggaaagagagacagaaagagagagacaggaaggaaggaaggaaggaaggaaagaaggaaggaaggaaggaaagacggaaggaaggaaggaaggaaggaagggagggagggagggaaggaaggaaatgaaggaagggagggagggagagagagaggcaggaaggaaagaaaggaagaaacaaaagagagaaagagaaagaaagaaagggaaaggaaggaaggaaggaaaaagaaaagagggagggagggagagagagagagggagggagagagaaagaaagaaagagagagagagagagagaaagaaagaaagaaagagaaaggaaggaaagaaaagaaaagaaaaagaaagagatcacattcctccagctcactgattcaaatcctagagctctttagggaccctcttagtctctccacatctctctgatgagtaggatccatgcagaggaaatgtcaacccacctgcaatcctgcattcaggaccaactgtcacttccatactctactaaccacccttctagcccctctgaggttcccataggttaggggaacaatgctttttcttccacaggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggtgagctgggctgtgtgtgtgtgtgtgtgtgtgtgtgtgtgtgtgtgtgtattagagagaaatattgagactattgccaaaatttttgcattctccctaacaccataaccatctgcccatacccttgaccacgtctcatcccctcatcttctcttccttgggctataccaatctccttattagcttctaatcagtatcatattttccaattgaccttctggctatcagtgttctctggggggcaggaaccgtgtctttttcaactccatgttcctagcccttagctgagtaggtgttcagtttatggtggataaaacggtaagtgggtggatagatggataagtggatgaatgggtgggtggatgaatgaatggatggatagatgggtgggtggatggatggatgggtggatgggtgggtggatggatggatgggtggatgggtgggtggatggatggatggatggatgaataagtggatggatgaatgggtggatagatgggtaggtgagtggatgtgtgggtggatgggtgtgggatggataggtgagtggatggatgggggcatggatggatgggaggatggatggaagaatggatgaatgggtagatggatgagggatggatggatgggaggctgaatgaaagaacgggtggatgaatgggtagatgggtggatgaatgagcacatggttggaggggcagatgaatagacgggtgggtggaatggtgggcaagcaaatgcaaaatggatggttggctagatggttagatgaatggatagataggcagatgggataagttggcagatagatgagtggacagagagttaggtggttgggtgggtggattgatatccaaggatagacaaatggacagccgggagcagtggctcacgcctataatctcagcactttgggaggccaaggtgggcggatcacctgaggtgaggagttcgagaccagcctggccaatatggtgaaatcccatctccactaaaaatagaaaaaaattagccaggcatggtggtgggtgcctgtaatcctagctacttgggaggctgaggcaggagaagtgcttgaaccggggaggcggagattgcagtgagctgagatcgcgctattgcactccagcctgggtgacaagattgagactccatctcaaaaaaaaaaaaaaagacaaatggacaggtatagaggtgggtcattaggtagatggatgatgggggtggctgggtatacagatgggcaggtgggtggacatcagtgcataaatggatgtgtagccaactctatgttggcatgaaaggagatggcccaacacacagatgggtagacagagggatacatactacacagctctcctccaatctctcctgagcatttgtgtcccttttggtctctccaggggttgtgtcaccagaagcagctgctaaggcagctgcaaaggcagccaaatacggtgagtgctatgctgacagctctgccccaccctgtcctggcctttacttgccagaactaaaggaccctcctctacttgcccagagaagggaagtgacttgcccaaggtcaccgagcaagtcaccagcaggcctcaggacaatgtctcccccatttgtctcccaccacagggccatggggctgagtggcgggaaagtcccaggatggcattcccagtggggacagtgaccctgagcttccctgctctggccaaggccctctcagaggagcccaaaactgcctggggatgtggattctgccaatagtctctctgcatccaacaaagggggtcttcccgaagtgctcagagaggagaggggccagaggaggactgaagagtgtcagtaaagggctgggtgcagtggcttacacctgtaatcccagcaatttgggagaccaaggtaggaggattgcttgaggccaggaattagagaccagcatgggcaaaatagcaagaccctgtctctacataaaatgcaaaaattagctgggcatagtggcatgtgcttgtttgttccagctacttgggaggtcaaggcaggaggattgcttgaggccaggagtttgagaccagcctgggcaacatagcaagaccccataaataaaataaaaataaaaataaaaaataaaataaataaaaaataaatgaaaaattttaatttttttttctttttctttttctttttttctgagatagagtctcactctgtcgcccaggctggagtgcagtggcatgattttggctcactgcaatctctgcatcccaggttcaagcaattctcatgcatcagcctcccaagaagctgggattacagacatgcaccaccatgcctggctaatttttgtattttcagtagagacagggttttgccttgttggccaggctggtctcgaactcctggactcaaatgatccacctgcctcgtggatcccaaagtgctgggattatgggcatgagccactgcacccggccaaaaaaaagaaattttttttttttgagacggagtcttgctctgtcacccaggctggagtgcagtggcgtgatctccgctcactgcaagctccaccttctgggttcaagtgattctcctacctcagcctcccatataactgggattacaggtgcccgccaccacgcccggctaatttttgtatttttagtagagatggggtttcaccatattggccaggctggtctcgaactcctgacctcaggtgatccacctgcctcagcctcccaaagtgctaggattacaggcatgagccactgcacccggccccacattttttttaaaggcttcatggtggaggtgctggggacccaggcatcccagttttctgtcttttatggacaaggcctgggggaaatttacatcctctttcccaatccatcagcatccctcagagcccgcccagcctctctcactgagcttcttttctacttggctcccttccctctgcaggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccgtgagccttagtcacacctggggacatgggttgagaagggatgggggcttcttgtctgctcggctctgcaggggcagtggggactgtagatcgggcttgaatgtgctcagggaggagttgggggagaagaagggaggtcgtatccatgccttacagggcagaagagctttaaacacggctcggaggagacccaggcacggcttctgagggtctctttctttctcgtttccttgtagccgaagctcaggcagcagctgccgccaaggctgccaagtacggtaagtgcccctgccctgcctgtccccaagtcctgctctcccgcggggctcagggtccaacctcagggcaaactggctcccaggcctccaggactgaaatggcctggaccaaggtcacgaggcccctgccccatcttccaaagccacactccactcttactgtccttttcagatgccccctgttaggactgttggtcactggctcatcaccccaccccccacccccagaattgaaggtgtctggcagggttgggtggctgatgcctgtaatcccagcactttgggaggccaaggcaggtggatcccttgaggccaggagttcgagaccagcctggccaatatggtgaaatgctgtctgtactaaaaatacaaaaattagctgggcatggtggcgggcacctatagtcccagctacttgggaggctgaggcaggagaatggcttgaacccgggaggtagaggctgcagtgagcagagattataccattgcactccagcctgggtgacagagcaagactccaactctaaaaataaaaaaaaaagaaaaagaaaaagaattgaaggtgccaggaagccattctcttcttcctccgattctcccacccacccttgctcccccaaaaagtgagtactgggaggggcaaggctgaaagttctccactccccgaggtgctgcaggagcaggagtgctgggtgggctagtgccaggtgccccaggcgcagtcccaggtgtgccgggcacgggaggagtgccaggtgagctgtgtctccagcccagagatgggtttggtttgtctcatggaagggtccctggagttgaccaaggtcgactgcaccattttacaaatgggaagactgagcctagagatgggaagcagggaggggtgtgagagattactctctcaccccttctcttcacacctccaggagtggggaccccagcagctgcagctgctaaagcagccgccaaagccgcccagtttggtaagtccccctcacccccgccactggctcacggagaactgctttctcctgtgccctgctctggggtctgaccgcccagcttcctgttcctttccaccccacttaagctgtcacattctggggtgggccctccttagaccttttggcccactgatgaatgacctctaggagtgtgggtgatgtttctgattaggggagcagggtgagcagtgtgagcctccctgttcctaaagcccctggtgcctcccaggctattggggacctgacctcatgctgagctccagctccccttgagggactccagttctcccccttctccttctctttctccttctccttcttcttcttgtgctcctcttccttcttcttcttcttctttcttctcctcctcctccttctccttctccctcctcctccttctcattcttcttcttctccttcctcttcttctcctcctgcttcttttccttctcctccctcttcctcctcctcctgcttctcctttcttctccttcttcttctttcttcttcttcttcctctttttctccttctttcttcttctttctccttcttcttcttcttcctctgcttctttctcctccttcttctcttctcttccgtctttcttctcctccttttcctccttcttctttcttctccttctccttttttcttgagatagggtctagctctgtcacccaggatggggtacagtgccacaatcatagctcactacagcctcaacctcccagtctcaagcagtctgcctgcttccgccccccaagagctgagaccacaggtgcccaccaccatgcctggctaattttttaatttttttgtagcgacagcggtctcactatgttgctcaggctggtctcaaactcctaggctaaagcgatcctcctgcctctgcctcccaaagtcctgggattacaggcgtgagccaccacacccggcctgcagtacttcttgttccccatctcttgctacatttgagggccaccctggcagccccaggtgcccacacttttctgaacatggcaaatcgtggcagcaccaattgtagagctcaactgtatgtcaggccctgggcatggggtctgtaggccttggccctagggacctgtgggctgaaaggttcagatcagaatctctaggactgaataggccagagagcatttcgactgcaggtctgctgagccccatattctcacacacagcaatctttattatttatttatttgagacggggtctcacattgtcgcccaggttggagtgcagtgatgccgtcagctcgccgcaggcctcaaactcctagcttaagccattattcccccttagtatccctagtagctggggctacagtcacatgccaccatgcccagtttaaaaaaaaaaaaaattgtatgcgatcctcccacattggcctctcaaagtgctgggatgacaggcatgagccaacgtgtctggcctacaaaaatcttacagagttgattttatttttcccattttacagatgtggaaactgaggttcccagagcttaagtaacttgcctacagttgcacagctaaatggtggctgagctgagatttgaacccaaagcctttctgtcttacaaagtcccttatataatgtaaatctgcctccatcagcctcaaatctccaaggggtccttgtcactgaaaaggttaagaactcctggccaaatgcagcagctcacaactataatcccagaactttgggaggccaagtcgggtggatcacccaaggtcaggagtttaagaccagcctggccaacatggtgaaaccctgtctctactaaaaatacaaaaaaattagccgggcatggtggtgcgcacctgtagtcccagctactcaggaggctgaggcaggagactcacttgaactcgggaggtggtggttgcagtgagtcgagatcacgccattgcactccagcctgggcgatagagtgagactctgtctccaaaaaaacaaagttatgaactcctgagcctgcacacacttcatattagggaggaggaagctgaggcccagcaagggaaagtaactgatccagggtcacacagcaaatctatgccagggccgaggctccagccctctttccataagcttctgtcctctttgatcaggtcttggttaatgatcagctcttctcaatcttgcagggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcaggtgagtttcatgagtcaatgagcctgaggggcccccgaagcctccatgggccccgcctccatctctaatccccctctctctccctccctcagctgcagcaaaatccgctgccaaggtggctgccaaagcccagctccgtgagtgcctcgcccacctttctctcctctccccaacgatctcagagctggttaggggcaacagccagggaggaggccgctgcttggatctgggccccttcctctgggactaggctcagctccctgggcaggacacctccttaggggcatgctccctgcctgctgtcgccaccactgccctctgtctgcaggagctgcagctgggcttggtgctggcatccctggacttggagttggtgtcggcgtccctggacttggagttggtgctggtgttcctggacttggagttggtgctggtgttcctggcttcggggcaggtgcagatgagggagttaggcggagcctgtcccctgagctcagggaaggagatccctcctcctctcagcacctccccagcaccccctcatcacccaggggtgcatagtaaaatccttgttaggttctcctaagcatctgggggtaacagatagcgggaggagggcagaccaggccaagggaccccaggctgcccaattgcagagtatctgcctcctcagtagaggggtggcagggctccagactgagaaaaagcctgccctccaaccagggaaggagcaggtagatcagcctggctccccttcagcagtgctctgtggccaggggaccactaggaactccagttcttcaccagctggtgactgagccccactctgtgcccagcctcaggcagtccatgctaggcctggggagagaaggaaggggcagacggaaggtggaggcactgttcagccctaaagctctgtgcctgtacagcttcagggctttgaggaagcaatagaggccaaggaagtcagggagggctctctagaggaggcggcagaactcccaggcacagagctcggctcctgaccactccccaacttttctttctccccagtacctggagccctggctgccgctaaagcagccaaatatggtgagtgcaccccacaaccacttgtggctcccttgccaccacaccatccctgacagcacaggactggggtggtcacaatagaaaaaggcagtttcggccgggcgtggtggctcacacctgtaatcccagcactttgggaggccgaggcaggcagatcacctgaggtcaggagttccagaccagcctgaacaatatggttaaaccccatctctactaaaaattcaaaaattagccaggcgtggtggcgggcacctgtaatcccagcactttgggaggccgaggtgggcagatcaactgaggtcgggggttccagaccagcctgaccaatatggtgaaaccccatctctactaaaaacacaaaaattagccaggtgtggtggcgggcacctgtaatcccagctactcgggaggctgaggcaggagaatcgcttgaacccaggagatggaggttgcagtgagccgagatcacgccactgcactccggcctggacgacagagcgagactgtatctcaaaaaaagaaaagaaaagaaaaagaaaaaggcagtttctaggacacgtttatgacagtttaaaaacctggcccctgcccactaaatgcttatggtgccttcaacccctgtgaccaccaaaaacacccttgaaatcccagttgccccccaggaggcaattccaccatccctaagcttgccctgaccctgacagttacatggtccctgtgtccaggaagggactgggcctgctgtgggtatgaggagtctgggcagtctctgcctccaccccagctctctggcccgagcaaaggagctggtattcctcatctgggcaccccgggcccccgcccgccttcctgtcctgccagcaggaccgctcccaccacgagccagcccagaggacgtggcagtcccacagcctctgcacttggcgctctggcagccctgcctggccagacccacgctgtctgtagcccctgaattcctggcctcctgtgagcagcgttggtgggaggtggaagactcccccagggatccaccaaccagccgggcaggtccacttggggccagtttctacctcggaaaatcctggcttcctcagcgccgacccccagcagccctggcctcctcccctgctcactgctgactgcttggcaggcctgagtcaacagacattgccagggaaacagagtgacgtcatgtggtggagccgcgaagggcgcaggctccccagccacttcccgtccctgaagccctgagcacactgcttaacctctgctctgcctcagcgttctcatctgcaaaatgggaatgacaatagtgcctacctttcctgctgcaatgcataaaaaatgggctgctaagtgtgaagcactcaaaatgttaagtgcctgctgtagatactattaccgttgtttgtttgtttgtttgtttgttttgacagagtcttgctctgtcgcccaggctggaatgcagtggtacgatcttggctccctgcagcctccatctcccgggttcaagtgattctcctgcctcagccttccaagtagctgggattacaggcgcccgccaccacgcctggctaatttttgtatttttcgtagaaacagggtttcaccgtgttggccaggctggtctcaaactcctgacctcaggtgatccactagcctcagcctcccaaagtgctgggattacaggtgtgagccaccgcacccggcttacaaaagaacttttaaggccaggcacagtggttcacaccttcgggaggctaaggcaggaggatcgcatgagcccaggagttggaggctgcagtgaactatgattgtaccactgcactccagccggggtgacagagcaaaaccccatctcaaaatgaaacaaaatatggactggacttcctgtccactgctcctccacagtgtcacatggcccctgccacctgtctgcttgccttgtgtccctggggcagggagacccatcgttcagaaatggaacactcattttccctcctctccccgcaggagcagcagtgcctggggtccttggagggctcggggctctcggtggagtaggcatcccaggcggtgtggtgggtgagttgaaaccccaggaggggcagggtggggagggaatctaaccagtacagagtgcctccctgaactcggtctgtgttcccaggagccggacccgccgccgccgctgccgcagccaaagctgctgccaaagccgcccagtttggtgagcactgggtggaggtgggagctgccgccaggcccccaggcccccagggtgtgggaggagcttctgaccaggcactgtagactcagagtccctgccccagacacctcctggctccactgtgccatcgaaggccaggggagacctcaggctccacctgtgtccccagaggacacctccgccctccacaggccgaggcttcagtcccacctttctgaccagcggagtctaatgctcagctgtctccacaggcctagtgggagccgctgggctcggaggactcggagtcggagggcttggagttccaggtgttgggggccttggaggtgagagttgttctgaaatcagtgagtgtgtgtggtgtgtgtatgcgagacagagatggagacagagacagagacagagactttcgttcccacccctggcacgtctttgctcaagatgtcctcttggccaggtgcggtggctcacgcctgcaatcccagcactctagtaggccaaggtgggcggatcactagaggtgaggagtttgagaccagcctgggtgacatggcgaaacctcatctctaccaaaaatacaaaaataagccgggcgtggtggtgggcacctgtatttccagctacttgagaggctgaggccagaggatcgcttgagcccaggaggcagaggctgcagtgagctgagatggtaccactgcattccagcttgggcagcagagtgagaccctgtcatctaaaaaaaaaaaagaaagaaagaaaagaaaagaggccaggcatggtggctcacgcctgtgatcccagcactttgggaggctgaggtgggcagatcacgaggtcagatcaagaccatcctggctaacacagtgaaaccccgtctctactaaaaatacaaaaaattagctgggcgtggtggcagacgcctgtagtcccagctactcaggaggctgaggcagaagaatggcgtgaacctgggaggcggagcttgcagtgagccgagatcgcgccactgcactccagcctgggcgacagagcgagactccgtctcaaaaaaaaaatatatatatatatatatatatgtatgtatgtatgtatataaattagctgggcatggtgacacacgcctgtaatcccagctactcgggagcctgagacaggagaatcacttgaacccaggaggcagaagttgcagtgagccaagatcacgccgctgcactccagcctgagcaacagagcaagacctcatcccaaaacaaaataaaaacaagaaatgtggcaaacgggagctggggctatcccttgccgccagggtcccagtcctccccctctcctctctctttcaacccacctgaccactgcggtgggagtaaattaggagaatgatggttatgccagttctccaagaaagaaatcaaagcttggagagaaattgctttccctaagtctccaccatggtggccgaccttgtgtggccatttccccctttcttgggctgtcattgtgtctccccctgtaaactagcctgcacagctcttcctgtgagtgccacaagaccagacacacagtaggagcttaacaattaagacttttggggccgggcatggtggctcatgcctgtaatcccaacactttgggaggcttaggtaggtggattgcttgaggccaggagttcaagaccagcctggacaatgtagcaagacccccccccaccaccacctctacgaaatatttaaaaattagctgggcgtggtgtgtgcctgtagtttcagctacttgggaggctgaggcaggaagatcacttgaacccgggagttcagggctgcagtgagctgtgatcaagccactgcattccagcctgggcaacagagcaagaagctggatagatgaaggagagatggggggatagactgggaggatgagtccatgggcagacggtaaagggtgagtaggtcagaagacagggcctagccaggtgcagtggctcacacctgtaatgtcagcactttgggaggccgaggcaggtggatcacctgaggtcaggagttcgcgaccagcctggccaacatggtgaaacctgtctctactaaaaatacaaaaattagccaggcgtggtggtgggtgcctgtaatcccagctgctcaggaggctgaggcaggagaaccgcttgaacccaggagatggaggttgcagtgagccgggatcgcgccactgcactccagcccaggcgaaggagtgagactctgcctcaagaaaaaaaaaaaaaaaaaagacagggcctgacaggtggcattggcattcctgagccgtcatgtgcctcatctccccaggtatacctccagctgcagccgctaaagcagctaaatacggtgagttcccctctgatgccttcctgccagtggcctgcaccccctgccatgcccatcgccaccctcccccagcccagctcaggcctccctctggctccccctacccctgaagatcttgtctgggacattccttaacccagaacccagcagggatatcagggcctcttcccgatgggggtgtcttatcctgaccccacctgcctcttctcaggtgctgctggccttggaggtgtcctagggggtgccgggcagttcccacttggaggtaggggtggccagctctgctacgtagtcctcagctctgtcccgatctagagggggcctgtccatctagcagtggggactcccagagcccatgtccacacaaggacaggagactggggctggtgagggcactttaggattgcagatgtactgggcaaacgggcaagctataaggttggggacagtgccaggctgagctcagggttgaggccatgaggtgccacacctggttgctaggtggcggcatgttgtgttgagaaagccactctggctgtagtgagggggattggctgggcgtggtggctcacgcctgtaatcccagcactttgggaggcctaggtgggtggatcacttgaggtcaggagttcgagaccagtctggtcaacatggtgaaaccctgtctctactaaaaaaaatgcaaaaattagccaaacgtggtggacgcctgtaatcccagctactcgggaggctgaggcgggagaatcactggagcctgggaagcggaggttgcagtgagccaagatcgcaccactgcactccagcctgggtgacagagcaagaccccatctcaaaaaaataataataaaataaaatataaaaaattatatagtgggggggatggagaggaggtgatcccagacagaggtcttgggtgagccagtgcaggcagaaagtgatgaggctggagtcagtttccacccctaccaacccaccaacctgaaatctctcctgcaggagtggcagcaagacctggcttcggattgtctcccattttcccaggtatgccaggctccctgcccctgggccctgccctggagctgcagccacctcctccctcctctcctgtgccatctcctgctcagaagggctgagccagcacccaggggtggaccccacagcctcaggtcacacgaggctggaccccgagctgaatgtagagcctcccctccttcttgctgacctcttataaacacagggaacatttgctttttaaaaacacagttcatggccaggtgtgatggctcacacctgtaatcccagcactttgggaggctgaggagggcagatcacctgaggtcaggagttcaagaccagcctggccaacatggcgaaaccctgtctctattaaaaatactaaaattagccgggtgtggtggctcacgcctgtaatcccagccctttgggaggccaaggcaggtggatcacgaggtcaggagatggaaaccatcctggctgaaacggtgaaaccccgtctctactaaaaatactatagtcttctttttttttttgagatggagtcttgctctgttgcccaggctggagtgcagtggcacgatcttggctcactgcaacctctgcctcctaggttcaagcgattcttctgcctcagcctcccaagtagctgggactacaggcatacaccactacgcccagctaatttttgtatttttagtagagacggggtttcaccatattggccaggctggtctcgaactcctgacctcgtgatccgcccgcctcggcctcccaaagtgctgggattacaggagtgagccaccacgtccggccgtctctactaaaaatacaaaaaattagccgggcatggtggcgggcacctgtagtctcagctactcgggaggctcacgcaggagaatggtgtgaacccgggaggcggagcatggtgtgaacccgggaggcggagcttgcagtgagccgagattgcgccactgcactccagcctgggcggcacagcaagactccgtctcaaaaaaaaaaaaaaaattagccaggtgtggtggtgcacgcctgtaatcccagctactctggaggctgagacaggagaattgcttgaacccaggaggcggaggttgcagtgagctgagactacaccactgccctctagcctgggtgatgacagggcaagacgattgcgtctcaaaaaaaaaaaaaaaaaaaaaaaaaaaccttcagaggcagatgtctgttcctgccccactctctgctcactgccaccaggtggcggtaaggagccatatctggctcaagcagggttaggaactgctccgggccgcgctactagacaatggtgccttacctaatacagactgatgccttgaaacagggttcacccatcagactattcccaggagggggtaggaatcctgggtttgagtcccagctcagacactatgtggataagaccctctctccctctactgggccttgatttacttatctgatgccctctcagatgtatgggtccaccccactccctgagagggccgtctcctgcagacactgactctcccttcatcccatgttccttgatggagctgctcttagcctttccccgaaaggcttcttggagcagtggagccaggagccagtgccaggccccgtccttccccagccaggccccatgacctgcccccttttctgcgagcgttggtttcatccaagtaatatcttgggggcttctcccgccccatctgtccagtggaagttgatggcatggatcaggtctgagtttggcctggggccatgacttggcttctcttggcttcttggagcctccattcgagtgggtcagagcaggcggggattagagccgaaactgagaggggccggactcacagtgatgtgcacctcctcccgtccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaaggaaactgtgtcttagcttccttcgtatgatttaatctgccttcaactcgctggcctggatggggataagggctctgcttcagggaacctccaccacccacagtgtatttgagaggttgcccaaccaaaagcccctgctgctggcttctggggcatcgatctttctccaagtttggcttgtactttaacaatgaggccaggagtttgagacccacctggacaacatagctgtccagtggagaatcactttgtaccatatagctacaaaaaaaaaaaaaattacccaagattggtggtggtgcatgcctgtggtcccagctactcaggaggctgaggtgggaggatcgcttgagcccaggatttcgaggctgcagtgagctatgattgcgccactgcactccagcctgggtgagacagcaagatcctgtctcgagagagagagagagagaaacagaaagagacagagaggaaagatggctgacctaagaaaatgcagaagacagtcaaaggtaaccattttcctccgaaacagtcccctctgaggaagacccactctcatgcgtggccatgtaaggccatttggcttgagaagtttaagaagtgatacccagcagcaggttcagctccacccttactcagatgcacccattcccattctggcccttcctcctccccttgaggccagaaatccgtggggcccgggaatgtgttcacctgcagcccacatccctacctctagaccacgctctggataccagatactggaattcccttccccaaccaccaagcccacttccagggctcactcagcctcaggcctgtgccaccctcctgagagcgggccccgtgctgagtgtgcacacctctaagccagaaatgtggcaacagagctgttcgtggggagtgtgggtggggctcaccatgcagactggagcatatgtgggtttgcatacgaggatccttgcgatcccagaaggagctgggagggaaagagaaagctggtggagggtatgctcagagagagcttcccagaggacagtaaagggcaaaaaacattttaccaggcaaagaatagaacagagaggagggtcaggcctttcaggcagaggacaggacaactagatgtctggtaggagagggcagtgctgaggacttatggaggatgatcaggagggggtgagcggcgtggttcaaggagatgcacaagagggttgctgtaataatccagggaggggtgacacagcctgccctagagtggtgacaaagtagatccatccatccatccatccacccatccacccacccatctgtccacctacccacccatcaacccacccatccacccacccacccaaccattcttccatccatccatgtctccttccacccatccacccacccacccatctatccacccacccatccatccatccatctatccacccatccatccacccaccagtccatccatccattcattacttcactcgacaaaaatatccattgctggtttttcctcaggtctccggcctctaaaagtcagtaagccccagcattcaggcctgtggactccctgtcttggtttctcatagcttgcggttttatttatttatcagagacagggcctcagtctttcgcccaggctggagtgcagtggtgctatcacagctcactgcagccttaaactcccaggctggagcaatcctcccaactacaggcacataccaccatacccagctaatttttaaatttttttatagagatagaatcttgccatgttgcagccaggcgtggtggctcatacctgtaatcccagcactttgggaggccgaggcaggcggatcatgaggtcaggagttcaagaccagcctggccaacatggtgaaacctcatctctactaaaaatataaaaattagccgggtgtggtggtgcatgcctgtaatcccatctacttgggaggccaaggcaggagaatcacttgaacccaggaggcggaggttgcagtgagccgagaccgtaccattgcactccagcctggcgacagagcgagactctgtctcaaaaaaaaaacaaagaatcttgctatgttgcccaggctgctctcaaactcctggcctcggcctcccaaagtgttggggttacaggtgtgagccacctcagctggttgctcgtggctttaaatatttaatacgacctattcattggtgactctccaattgacatctccagcatgaccgctcccctgagcccaggacttgcacatccaaggccaattctaacatctctacctagaaatctcatagacatggcctaggtagcgtggttttccctccctgcctttcccatctcagtaaagggcagccctactcttccagaggttccggcctgcaactctgtaaccatctctgactctgctcttccctcactccccacagcagattcaccagcaaataatacggcaccaccttcagaatatatccagagttggccaggcacactgactcacacctgtaatcccagcactttgggaggccgaagtgggcagattacctgaggtcgggagttcgagaccagcctgaccaacatggagaaaccccgtctctactaaaaatacaaaaaaattagccaggcatggtggtgcatgcctgtaatcctagctgctcaggaggctgaggcaggagaatcacttggacacgggaggcagaggttgcggtgagccgaggtcacaccattgcgctatagcctgggcaacaagagcgaaactctgtctaaaaaaaaaagaatatatccagagtcctaccacgtctcagggctaagccacaatccccagtatctcttgcctgaattactgaaatagctccctgaaccccttagttctcccctggctccccttcggccttctctccactcagcaaccaaagcaatctttttttttttttttttttttttttttgagatggagtttcactctgttgcccaggctggagtacattggcgtgatctcagctcactcaacctctgcctcccgggttcaagagattctcctgcctcagcctcctgcgtagctgggactactggcatgtgccaccatgcctggctaatttttgtgtttttagtagagacaaggtttcaccatgttggccgggctggttttgaactcctggcctcaagcgatcctcctgcctctgcctcccaaagtgctgggattacaggtatgagccaccacatctggcccaaagcaattctttcaaagcataagtcaactcgggtcatgcatctactccaagtcctgcagtggttcctgtctcactcagagacaaagccagaggcctttctatggccaagaagcccctacttgcatggcagcagctctcctgacctcacattctgctattcgagccatgcggtcgccctggccatcttacttttccttgagtgcaacaggtcacccactgccagccttggcatctgctatctcttctgcccaaaacgccctttcatcagctatctgtgtttctggctcactcagctgcttcaggtcttgactcaggtgtcaccttctcagagtgtcctacactgacacctttctaaaattgcaaattgggctggatgcggtggcctgtgcctataatcccagcactttgggaggctgaggtgggaggatcacttgaggccaggagttcaagaccagcctgggcaacatagcgagactccatctctatttaaaacataaataaaattgcaagctgcaccctcctcctctgctcattactccctcacctggctctacctccgttttgtgttttgttttgttttttgagatggagtctcactctgtcgcccaggctggagtgcaatggcaaaatctcacctcactgcaacctctacttcccgggttcaagcaattctcccacctcagcctcctgagtagctcggattacaggcacccgccatcatgcctggcaaatattttttgtatttttatacagacagggtttgaccatgttggccaggctggtcttgaactcctgacctcaggtgatccaccctccttggcctcccaaagtgctgggattacaggcatgaaccaccgcgcccagcctgtctctgccttctttgactccagagcacctgtcaccataaacaaaatatattttacttctttgttttctgtctctctacaccagactgtaaactctaagatgggcactgctttaagaataacacagcctggacacagtggctcatgcttgtaatcccagcactttgggaggccgaggcaggcagatcacttgaggtcaggagttcaagaccagcctggctaacatggcaaaaccccaacaacaacaacaaaaattagctgggtgtggtggtgcatgcttgtaatcccagctactctggggactgaggcaggtgaatcgcttgaacccaggaggcagaggttgcagtgagccaagattgcgccactgcactccagcctgggcaacagagcaagactgtctcaaaaaacagaaaaaaaatttttttaaagaccctatctccaaatacagtcatattctgcagtattggagtaaatgcttcaagatataaattttgaggagacacagttccacccctaagagttacctcatggaaaaagggtctttgtagttgtgattaagtcaaggatcttgagagatagggagattatcctgctgggccctaaatgctacataggtattcttatgagaagctggggctgggcacaatggctcacacctatcatcccaacactttgggaggccaaagcaggaggatcacttaagccaggaggtcaaggctgcagtgagctatgattgtgccactgcactccaatctgggtgacagagtaagaccctatctgaggaaaaaaaaaattggaaaatctagataaaatggataagttcctagaaagccacagcctgccaagactgaatcatgaagaaatagaaaatcagcatagaccaatagtgagtaaggagattaaatcagtaataaaaagtctcccaacagagaaaaacccaggaccagatggcttcactggagaattctaacaaacatttaaaaaattaacaccaatcctcctgaaactcttccagaaaactgaagtagagggaacacttccaatctccttctaagaggccagcattattctaataccaaagacacaagaaaagcaaactataggccaatatcctttatgaacattgatgcaaaaatcttcaacaaaatacaagcgaaccaaattcaatagcagattaaaaggattatacaccataaccaagtggaatttttcctgaaatgttaggatgtttcaacatatgaaaatcaatcagtgaaatataacatataaacagaatgaaagacaattacatgatcatctcaattgcagcagaaaaagcagcaagatccaataaactttcatgataaaaacattcaacagactaggaatagaagcaaaccacttcaacctaataaaggctacagatgaaagcccacagctaacatcatacttaatggtgaaagactgggcttgagtggtggctcacacctgtaatcccagcactttgggaggctgaggcaggcagatctcttgagcccagaagttcgagaccagcctgggcaacatagcgaagccctgtctctacaagaaaatataaaaataagccgggcatagtggcacatgcctgtagtcccagctgttcaggaggctgaggcaggagaattgcttgagactgggaggttgaggctgcagtgagccatgatcatgccactgcactctagcctggaaaacagagtgacaccctgtctcgaaaaaaataaaaaggacttaaagcttttcctctaagattaggaataagacaaggatgcctactcctatcacttctattcagcatagtattggaagtcctagtcagaacaactaggcaaaaaaaaaaaaaaaaaaagaaattaaagatatccaaattgagaagaaagaagtaaaattatctctgttcacaaataacagactcttatatgtaaaaactcctaaagatcgaacatgcccacaaaattagttgtgtttccacatcctcacaatgaacaatctaaaaaggaaattaagaaaacaattccaggccgggcgcggtggctcacgcctgtaatcccagcactttgggaggccgaggcgggcggatcacgaggtcaggagattgagaccatcctggctaacacggtgaaaacccatctctactaaaaatacaaaaaaaattagccgggcgtggtggcgggcacctgtagtcccagctactcgtgaggctgaggcaggagaatggcgtgaacccgggaggcggagcttgcagtgagccaagatcgtgccactgcactccagcctgggggacagagcaagactcaaaagaaaaaaaggaaacaattccatttataatagcatcaaaaagaataaaatactagaaataaacctaaccaaggaagtgaaagatttgtacactgaaaactgtaaaacactgctgaattaaattaaagaagacacaggtaaatataaaaatttacatccatgttcatggatggtaagacttaattgttaagaggcctgtagtactcaaaacaatctacggtttcaacacaattgccatcaaagtcccaatggtattttttgcagaaacagaaaatttcatcttaaacctcatgtgaaatctcaagggactccaaatagccaaaacaattttgagaaagaagaacaaagttggaggactcacactttgtgatgccaaaacgtattacaaagttacagtaacccaaacagtgtgatactggcataatgacagacaaacagaccaacagaacagaatatttataatggctcagaaatattaataaagcctcgtgtatatgattaaatgatatttgacaagatgctaagaccattcggtggggaaagaatagtctcttcaacaagcaatgttagtggccagacacagtggctcatgcctgtaatcctcacacttctgggaggccaaagtgggaggattgtttgagcccaggagttcgagaccgccctgagcaacatagacagatcccatctctctttaaaaaaacaaaaaacataacaaaaaagccaaattttattgggaaaactggatatccacatacaaaagaataaagtggccgggcacggtggctcatgcctgtaatcccagcactttgggaggccgaggcaggcaaatcacaagatcaggaattcgaaaccagcctggccaatatggtgaaaccccatctctactaaaaacacaaaaattagctgggcatggtggtgggtgcctgtaatcccagctactcaggaggctgaggcaggagaatcacttgaaccagggaggcagaggttgcagtgagctgagatcatgccactgccctccagcctgggtgacagagcgagaccctgtctcagaataaagtctgggggccgggcacggtggatcacacctgtaatcccagcattttgggaggctgaggcgggtggatcacctgagatcacaagtttgagaccagcctgtccaacatggtgaaaccccgtctctactaaaaatacaaaaattagccgggcctggtggcatgcacctgtaagcctagctacttgggaggctgaggcaggagaattgctcgaacctgggaggcggaggttgtggtgagctgagatcatgccactgcactccatgggcaacagagcaagaccctgtctcaaaaaaaaaaaaaaaagttcgatccttatcttacaccatatacaaaaaataactcagattaaataactaaatgtaagacccaaaactataaaatgcctgaaagaagacacagcagattgatttcaggattgatttccaacaatctgatttcagacttctggcctccagaactgtgagaaaataaatgtcttgttttcagccaccaagtttctggtaatttgtcatagcagccaggggaaactgatatagtacagtgaataagtaataactctaatgccaggtaaatcggtgctatgaagataaaaagcccgggaggagagttacaaggaatgttatcaccctaacttaggatggttaatggacctggcctcaagtcaaaagccctgtaacaaccacgtacttgggaagttagaacagcagagaggtgcaccacgatttttcttctttttaattagagaaaggggccaggcgcggtggctcacgcctgtaatcccagcactttggaaggccgaggcgggtggatcacctgaggtcaggagttcaagaccaacctggccaatatggtgaaaccccgtttctactaaaaatacaaaaattagccgggtgtgatagcatgcgcctgtaatcccagctactcaggaggctgaggcaggagaattgcttgaacccaggaggcagaagttggagtgagccgagattgcaccattgctctccagcctgggcgacagagcaagacttggtctcaagcaatcctcctgcctcagcctcccaagtagctaggactacagtcacgtgccaccatacctggctaattttttttttttttagagatgaggtctcgctatgttgcccaggctggtttcaaatttctggcctcaagggatcctcctgccttggcctctcaaatggctgggattacaggtgtgagctaccatgactgaccatcatgattttaacaaaactgacaggagaataaaaataagggcaaagtagtagccagaggctaggtcccataagcgcagaagcagggaccttagggt

SEQ ID NO: 1250 - DNA, 114370 bp, Homo sapiens
tcacatgtccaaatcctgccaatccttcaaaacacaggtgacacaccaactcctacaccaaatcttccctaatgcccccatccagagctgattctctttcttaaaccacagtatcaacaccttttgaggcactttcttctacctagtactcagttgtgtacatgtctcatctttcccattaatgagaaaatcatcatgggcacaatctctgtcttggtcattttgtatgccctattttgctacattaattaaacttgtatttcactaaagcatataataaaaagaaaggggcaagaatctaaaagttaaaaaaaaacaggcttttagtatgcattcatttgaattaggtcttgtttacctgcaacaaacgctatgtaagaaaagtacgaaaggtaagatccttccctctccatccagctgcccagggccctggtatgcctcctgaaaaggcaataactatgggttctaagaagtccttggacactgcaacttcttaacacattcaggacattggaactaagttgacaaaaagaatttataagttatattttaaaataaatttatttatgacaattacacaattgcacagtttacatgctgaggcaaaatatgacgttcaatacatgggaagataaactgtataaaactatctgagctgtgaaaagaagtcactgttcggccaggtgcaatgacttaacgcctgtaatcccagcactctgagaggccgaggcgggaggatcacgagatcaagaccatcctggccaacatggtggaaccccatctctactaaaaatacaaaaatcagctgggcatggtggcacatgcctgtaaggtcccagctactcgggaggctgaggcaggagaatcgcttgaacccgggaggtgaaggttgcagtgagccaagattgtgccactgcactccagcctggggacagagtgagactctgtctcaaaaataaaaataaaaaaaaagaagtcactgttcattatcgaccatcacagaataaatattccaaggctacatataatcccaagttactaaagttttgaaggggaaggttggtctggttttctgtttttttgagacagagtctcactctgttgcccagactgaagtgcaatgcagccttgacctcccaagctaaatcaattctcccccctcagcatcgcgagtagctgagactacaggtgcacaccaccatgcctggttttttgttttttttttttagagactgggttttgccatgttgtccaggctggtctcaaactcttgggctcaagtgatctgcctgcctcagccccacaaagtgctgggattacaggcatgtgccactgtgcccagccaactaaagtttctgtagcgtcaaaagtgtttaaggattccacaaagactaaattctcactaagctatgcaaacaaaggtgctaaaccattccaaccaaaatatgaaagaaacatgtagatgttttataaagctagatttcctaagaaatattaatattaatgaaaacttttctcaatatattaatagaaacaagatgtctgcacatttttccagtttatagatgttaaaaattaagtctcaacaaggtctttaatcatatgtgtataatcctaagtgtataacaacttaggaaatttcagtaattattcctacaataatgaatcacataaaatatatatatgtacacatggcagattatgctaccaagatcagaatgttcaaatcagaaggcagttcatcttgttagaaaatttacccagcaataaaaatctgaagccatcgttagatcaagacaaatttcagtgaaaattctatactggatactgaactggaggtggggggttattcttacaaataatactgaaggattacaataatactgtcaaattatcaaatgtgttaatactacattagccattctactggtatttatggcacaaactgccagatgtagtgcaatactgattcttcccttcctccagagtaagagaacccctgatttttgactaggcacatagtaatttccagcacagaatatactttctagcttctcttgcagttatgtgtgaccttgtgattccgttataatcgaagggacacagcagaagcgatatgtacaatttctggaaagtatcttcacaagaagggagtgtgcccagcttttgccttttcctccttcctgctggtgagaatgcagaactgatgtgagaaagtggagaagccacctctgacaaaaaggaaagagttacatgttgaaggctgggtcccctaatgagcatgaaggtagcatactggttcaggactgtctatgagatacatgaaagaaaggaaacttctatcttgtttaagccattgttatttttggtttctaccactcactgctgaatctaatcctatctaacacacggcaaaattatagagaaagagtactatatttattaaactttactttttcaaatgattttttttgttttgttttgtttttggttttttttttttttttttttgagacagagtcttgctctgtcacccaggctggagtgcagtggcgtgatttcggctcaccgcaacctcggcctcccaggttcaagcgattgtcccggatcccgagtagctaggattacagatgcccgccaccatacccagctattaaataattttgaatacatagtttaaacttactaggattaaaataaactcattttggggggccaggcgcaacagctcacatctctaatcccagcactttaggaatccgaggtgggcggattgtctgaggtcaagagttccagaacaacctagccaatatggtgaaaccccatctctactaaaaatacaaaaattaagccaggtgcagtggctctcgcctataatcccagcactttgggaggctgaggcaggtggatcacttgaggtgaggagttccagaccagcctggtcaacatggtgaaacctcacctctactaaaaatacaaaaattagccaggcatggtggcaggcgcctgtagtcccagctacttgagaggctgaggcaggagaatcacttgaatcccggaggcggaggttgcagtgagcagagattgcaccactgcgctctaccctgggcgataagagtgagaatccgtctcaaaaaaaaaaaaaaaacaaaaacaaaaattagtcaggcatggtggtgtgtgcctgtagtcccagctactcagaaggctgaggcaggagaattgctcgaatctgggaggcaaaagttgcagtgagccaagatcgcgcggttgcactccagcttgggcaacaggagcgagactccatcacaaaacaaaacaaccttcttttttttttttttttttttttttgagacggaatttcacacttgttttccaggctggagtgcaatggcgcgatttcagctcactgcaacctctgcctcccgggttcaagagattctcctgtctcagcctcccaagtagctgagattacaggcattcgccaccatgcccagctaatttttgtacttttagtagaaatggggtttcaccatgttggccaggctggtctcaaacttctgacctcaggcaatccgcccgtgttggcctcccaaagtgctgggattacaggcatgagccactgcacccggccaacaaacttatttttgattattcaaataactaagctctaaaatgttttttctacactatatttgaggtataaaattgttattatcaataattttttggccaggcacggtggctcacacctataatcccccagcactttgggaggcagaggtgggcagatcaccggaggtcaggagttcaagacctgcctggacaacatggcaaaacccatctctactaaaaatacaaaatttagccaggtgtggtggtgatcgcctgtaaccccagctccttgggaggctgagacagcagaattgcttcagcccaggaggcggaggttgcagtgagctgagatcgtccagcttggtgacagagggagactccatctcaaaaaataataataataataataacttcctaagtatgccttggggtcaagcgattaagccaaatctcccttatctctacctcaataataccatacgttaatattattcattcatttaacaaatgaatgcctactgtactcttcgcaagcaaggtgcactgaagtgaccaaagcagatgatgggcctcttcctccgggagtttgcaagccagtatcaatgcagccgaggcagtagaagcctctgcttccctcttctctagcctccaagttcatcactcccctgctgtcatcatattcttgcttcaggctacaatatgagagtacaatgtgactagacttcagctttgctctgctaatataatcacacataatcatattcctcaaagatgacactcctgttaccaaaattagcatcagcatcttaccaaaatgccatagcagttatcactgatggtgggtcagttttccacatggcaaatcttatttatcacaagatatctttccctaactgtaccttatggggttctcttatccttacattttgttgttgttgagacagggtctcactctgtctcccaggctggaaagcaatggcacaatattggctcactgcagccttgacctcctaggctcaaacaatcctcccgcctcagccttctgagtagcttgggctacaggcacgtgctaccacgcctggctaatttttaattttttttgcagagacgggggtcttgttacgttgcccaggctggtctcaaactcctggtctcaagggagcctcctgcctcgacctcccaaagcactaggattacagttgtgagccaccacatccagctttatccttaaatttgaaaaatactttgcagttccgccgccccccacccagtcccagggactatactgaaaaatgtcagaatgtagggctgcttaggcagatagccaaatatttttagttactcctcacaggccattacatcaacctcattagagatttgaagccagaccaacaagaggtcttgctctttccctcaattgcctttcttcttgaatctctctaagaggatggaacactaatcggattgggtcaagagtccacagtactgattgaaccctgtgtacaactatgaagatcaatgaagattaaaagttacacaaatcttgattcaagtgcaagatagaaaaaaaagtcacatacatgtaagagtttgtgttcttgttcttggtcatttcactcttacacactctaaaagactaattgttggggtcttctgcaaagccatcaaccaaagagtagtaagacagtgaaatttaggaggatgagagagcccttgactagtcctggagcttaagtaatatgatgtcaccctgtttactacacaaatttacattggtattttggccaaaagcccaaattaataataaagtaatacttctaatttcctacttgccattgttctacttatataaatctccttcagaggccaggcgtggtgggtcatacctgtagtaacagcactttgggaggccgaggtgggagaatcacttggaccctcaagatcgaggctgcaatgagccgtgatcatgcaccactgcactctagaacctgggcaacagagcaagaccttgtctcaaaaaaaaaaaaaaaaaaaaaaacctccttcaggaagctaagccatgatattctgatcatttattaacaccccaaacttcaaactgtactattactctattcacttggtatttaatcacatattgtttttagcatttcctatattcaaggaatagcaaacattttagaattggtacctcaaagagaatctattcaaaccatctagagttcacccattgtctcctgcagatctcctgattattataaacaacaaagagaacatactggaaagctagatctctagatgacaataacagtaataataaaaagaggctgatatttattgaccatttactatgtgccagggacctttttaaatactttatatgaattaattactttggtcctcacaacaaacccacgagtattattattatctcaattttacagatgaggaaactgagacccagaaaggtaaataacctgcccgaagtcacagagttaataagcagtgggctgcagattgagtctagagctcttaacaacttttctgcaatagcataatagttagttaacggtagacaaatactacagcttggtaagttctgaaacttagggccaaaaagatattcaaggaggcaaaagacaacacagatctgcatctccagagagagattttcaaaatttgaggctggaccaaattggtgtttaaacaaagtattgagggagggctgggtgcagtgactcacgcctgtaatcccagcactttgggaggccaaggcaggcggatcacgaagtcaggagattgagaccatcctggctaacatggtgaaaccctgtctccactaaaaaatacaaaaaattagtcaggcatggtggcaggcgcctgtagtcccagctactcaggaggctgaggcaggaaaatggtgtgaacccgggaggcagagcttgcagtgaactgagatcacaccactgcactccagcctgggcgacagagcgagactttgtcttaaaaaaaaaaaaaaaaaaaaaaagtactgagggagaggttaatggatagaatcatgaggaacatcaatatttaacataaactcagcacattttaggtcaaaatgataatacagtaaggtagtatttgtgtatattatagatatacaacatatattacaaaccaaaatacataatgattatccctactccataggaagtagaacataatttaactataattactataggtttatggtagcatctctgttggctgtagctaagatttttcatgctaagtccttaggcaggaatgcaacctataataatgttactacaagagacaataatctgctttaaaatctttcttcagacatgctttccagggaacagacagttgtgaaacgaaagtcagcctaaatagatggaccatatttcaatgactctaagactcataatgtttgttttacatttgtatagtatgccactggaattaggaaaggtctcacagaggttaactggcatttttttcattcttagcagtatacaaaataataattcattttacaaatgatggcatcttggagtcaataaaatgtttttcagaatacatctaattttaagtgtgaacacacatactgctgtagtcacaggaaaactttctgccttcaagagatgtataatctaataaagagaacataattatctctaaaatataaatggaagtaataaacattaatacaagacatgaagtgatcaaatgagtgagaaggttataacaagaactgaagaaaaggtatttaagtggtaggaaataaaagtggccaaaccaaaaaaacttcaggcactgtgtcctgagcacagtttgttgtttttgtttttgttgttgttgttgttgttgttgttgtttgagacagagtcttgctctgtcgcccaggctggagtgcagtggagcgatctcagctcactgcaacctccgcctcccgggttcaagcgattcttccacctcagccttccgagtactgggattacaggtacccgccatcgtgcccagcaaatgtatttttgtagagacaaagtttcaccatgtttgccaggctggtcttgaattcctgacctcaggtcacccatccgccttggcctcccaaagtgctgggattacaggcatgagccaccgcgcctggcctaaagttatttttaaataaaataaatccagacatagtggctcatgcctgtaatcccaacactttgggataccaaggtgggtagatcacttcagctgagaagttcaagaccagcctgggcaacatggcaaaactctgtctctataaaaaatacaaaaattagctaggtgtgatggtgcatgcctatggtcccagctactcaggtggctgaggcaggaggatcatttgagcccgagggggtcaaggctgcagtgagcagagattgcgccactgcactccaacctggatgacagagcaagacctttcctcaaaaaatttaaatttaaattaaaaaaaattaattttacaggtgcatctcaaactgtgttctattaaactagaatagtagtatctatcccatgagtatctcatgagaaagaaacaggtattctttggggtaagggaggaaaatgaaaaacaaaaaccctctatagtataaaatgtttctgaggctttaaagagctcatgtgcattataaacgtatttcaccccacacttaaaatacttgcagcatattaggaagccataaatacagttcgggaaacactgacttgggtaggcaggtaggtagacaggtagtcagtaggcgggcagagtcacagaaaataaaaggagaataagacaaatgtaataaagtgataccacctaaaaaaaggatcataactgactacgagttatgactatgaagtctcttgaaggaaaataaggtgttagaataagctatcaaaatcaacaatagccgccaggcgcagtggctcacgcctagaatccacttgtgtggatatacttccccagcatagccaggtcctgccagagaacatttccagtgcctccccaggcagttcacacagacagacatatgcccacatgctcatctgctcacactccccctgaactgtattcaccccacacacactgagtgccttcatcactgtactcccttgcttcccaccccagaagcaggaagaaggtcaagaatcagacctttggctgggcatggtggctcacacctgtaatcctaggactttgggtggccaaggtaggaggatcacttgagcctaggacttcaagaccaacctgggcaacatgacaagacttgatttctacaaaaaaaaattagccaggtgtagtggtacacacctctagtcccagtcccagctactcgggaggccaaggagggaggataacttgagcccaggagttcaaggctgcagtgagctatgctcatgccactgcactccagcctgaacaacagagcgagaccctctctcaaaaaagaatcagacttctgggagcctagggaacatatacaggtgccaatgaatgtgtccgtgcatgctctgctaagtgtgtgcatggctgcgtgagctagaatgggtttttgtaggaggagctctgccctgctgctgcaggactgtctgaagatgctgcacagccatgcttcctcacaagctctcttttaaggttagtccaggccaaccacattaatattgtcccctttggggtggtatatttattgcaacacacagcctggacattcatatacagggccatggcactagggtaaggcgccacaaactcctcctgctgaggaggcaacaaggtatctggtcgctaaagctgggtgggacccatatccctgacagtattccagtatgtatgaggcactgcagacctggggtttttgttcttaggtgaggcctggctcgtacggcttaaatttctgttctacttttccccaacttgagatgactcggaagactttctgttccttgcaatgaaaaacagcctaaccaaagtccttaaaagtcatgtatataactactttaaaattaagataaaacccatggcttcgacttctgatgcaaatacccaagacaaatagggtatgaggattcctcaaataccgagtggtttatgaattagaggccacatcattttataactaaccatataaggaaaattttcacagttaaatatattgctcacacttgctgacatactggcaaattttaccagttaaaaatatgccgtgtgcagtggctcacgcctgtaatcccggccctttaggaagccaaggcaggtggatcacttgaggttaggagttcaagaccagcctggccaacatggtaaaaccctgtctcttctaaaaatacaaaaattagccaggtgtggtggcacatgtctgtaatcccagctactcgggagactgaggcaggaaaatcgcttgaacctgggaagcaaagttgcagtgagccgagatcgtgccatcgcactccagcctgggtgacagagcaagactccatctcgaaaaataataataataataattttacactggcacagaccactttaccaaaaaaagcatcttatattaactgtactctctgacctagttacctaatgtacagacacacagtacatcttatattacttggcacaccaacaagttagctatacaaatcacaattccaacccaaacttgaagctagtaaatatatttagtatttgaacttgagttgtgttcaaatgttcattaaattggcctatgcaatcttaacaatgttctaacacatatttaaaatgctcatttctcctccattatttaaaaaaaaaacacacacacacacaaactataactctgttagacaagaaaccaaacataagccaaaaggctcggcaaaatcacacttaaataggacaaggagagcttcaacttcagaataattatcaggataccaatcacacaaatatgattcaacaatcacttaaatatcattcaagaggaattcctggtagtaaaaaaagaaatcccgtaattaactagagcacagcattatcagaaactgattatgtaaaacaatagcttttctttcaggatgtgtgtatgtgtgtgtaacgaagttcacagctaggttacactaatgactcacttaaacatttgaattttctgctatcttaacctttaaatcgactgcaaaagtagctgccaaaagtagcttagtaggaaagcatactactctcaaaagaacttggtatgtccaacttattttactacttaaattttttttgatcactgatatttgaaactaatttttaagtaatgaatgcttactaaatccatgataatattcagcatatacaggtttttagaagggcacagattatattcttatatgtgtgtttttacagcacctggaacatttctgttcagtatctgttcagtattacacataattattgcaggacctgacagtgtttactatcctattttttcctttttttttttttttttttagacagagtctcgctgtgtcacccaggatggagtacagtggtgccaatctcagctccctgcaacctctgcctctgagttcaagcaattatcgtgcctcagccccccaagtagctgggattacagccacgcgccaaagtgccaggctaatttttgtatttttagtagagacgaggtttcaccatgttggccaggctggtctcgaactcctgacctcaagtggtccactcgccttggcctcccaaagtgctgggattacaggcgtgagccaccgcactaggccttactgtcctattttttaaaagctttttcgactgaccagtaaatcaaagttgaaaaggtaactggtacattttatttcttgatttggattacctttttgttgtgaattggttctcagttctagtttccttgtgacaaaacactgatggagaatatattgaactgaaatcccctgaatccattcccactgagaaaataatacatttgaactgttcacatttcattgtaaaagatacacaactttagagattactcttgaagttttgaaagtaaagtgaatcagaagtcacattcctagaagcagtcagtctggaacagatgtttatcctacacacccagtcccctttaccactgcaaacctctctaatagttcattacattagaacaactgagatgggccaggatttgtgaaaataaaaatcctttgagacatttattaagcagattatctctgaaactgcaccttagtttacaagcctttgggcaacaatttgaccctcttctatgataatttgtgtacacactcatttcacattttctctggcttccaattttaaattctttatctaatccatacaataagtcaccctatcagactttataagactactgaaaacaacactactgcaatgcaaggccactacatttgcaaaattgccgattttagtgagatttccctccttcaactcctcctctacccctctacctggtttaaatcccaagaaaaacctctgtccagtgctacaattttactttccatagagtaggtttatttgattttttattaatgatactaaaaacttttttaaaagactgctggtgtatatagtttccaatactgggaacagaaataaaccctctggtttaatatttcaagagaaattatctcataaaagatgagaaggtatcattcaaaggagtcctgggaagtcacaaagtgtaaatacttctggtaacagaacaaattaatgtcgaagcacaaccagtaacataataatgcctcaatgcaaccgtgcctgtcaaaggacatctgtattagcagctcggggaagtggcatttgcagaaaggcacaacaactgcgcttaaaagaaaatcattaagcctcagccattaatcccctcccccatcctcttcgtctggatctttccaaacaattaaccagtagaaggtgctattctgcaacccacatgtattcacaccaacctccatccttgggccacagctgggtttatcccaggtggactagcctattccctgtccagtattcaaaggagccccctaaacagaaaaccagatcttttcttataacccttatttacaaaaacaacattgacagctcaattgccagcaaacctgaccatcaaaccatcacaccactaaaaacatgcaaacatcatcttgctaaatattaacctcaatacaacctttataatattaatcaataaaatctatttctatctagaaagactctgctcacattcactactaagactcaagtgaacaaatcactgtccccaacaaaatcagggtcaatgagaaatacaaaagcaatgagagctgaacgtaaggccacaacatataaagagggattttatctttacatatacaaaaaagaaagagcagcagaaaccacggctgcaaaaggaataaagggaggcagagagaagagaagtctctgaacatgtttttgagtgtcctttagtttccaatgcactcttctgcctcacaaggttgcaaaaacggccaggcatgagatgggtggaagaaagctgtaacagaaaagcaccctcccttcccccatcttctctcttctctcccaaaaagagctgtgtttgtctgtgcaaacctagtcccaaatatgggagagagagaatgaatgtgtgtatggaagaacaatgagccctcagcttggtattgtgtgtgtgtgtatgtgtgtgtgtgtgtgtgtatatgtgtgtctgtctgcctctgcctcttttcccttcgacctcaacaacaacagggagagctggaagccagctttccacccatcccaggccatcaaaatcaaaactggttgataatttacagtagtattaactcagcaagcaaatccatggaacaaaatatcaacccaaagatgattttattattgtacagatccagcttctctcccctcccccaacagactgagactaaaaagaccagtgtacactagacaaaaaggtctctctttaaatggaaagcaattatgaaaactgtttcaaatcttagatgcatcaattcctgctatattaaaatgtctattttgtaattcaccaagttcaccctcttactagttatctttttttgcgtttaaaaattcgctgtgaagaaggctatttcacgattcatacaaaactactttctaaatgtaccttaaaaaagcaacagatactgaaacatttaaagcacccagtttctcaaggacccattttacttaaatcaatgtttgaagtctgtaatccagaaaaattgtaagcaaaccttggaaaagagacagaggaaaatgacaattcaacaatgaatcattctgttttcctttcaacaacttctcaagcaaccagtttcaaaggaagcctgcaacacttttcccccctcctagcagacacacatacacacgtgtatgtaaaactacgaatctttccatcatcttaaaaattagtaataaatagaagccaccctccttcagagagcagaactaaaacaggatagtaagaattctattctgctgcaagtgactttgggtttcataattttctaatcacatacagctgagaactagagattgggagcacaaagaggaaatcttcccccaatgagaaaatgatactttaataataaagtcctccccccagcaccccgaaatccacaaacattcaagaaatttacagtttcagtccttgacttccttcccttccagtttcagccaataatgtagtcacatgaaatagtttaacctcaaacaagtagaacaagagcatgaataagaggccaagagagagcaggggtcagaaggcacgcaggaacggtcacctggcccggacaggaccaaagaagtgccctgccctcgcccgactcccctcgacttcggcttcgaccccagccttttcttcctgcctccccccgggcgagtgactgctttcacggccgaccctctctgaccaccaggacgaggggccaaaaaagaaagcacacgacccggcgcgggcaagttggacacttaccttcccctaaagcgctacaccatcaatagtgaggtgttcgcggcccagctccggggaaagtggcggggatggggcgggaggccgcgcggaggctgcggggccgcggggcgcagggccgagaggggcggcccgcggggaggcgacgcggaggggctgagggggcttccctgccgtgacctttcctgcgacttgaacctaggctccctcctcctcggtcgggcagatctttcagaagcaggagcccaggatcatgtctggttttgttttccgagggcgagggggctccctgaggatgatggtgatttttttttttttttaatcctcaactaggagagaaaatgaggcagagacaatgtggggagcgagagaggggaaaaggacgggggaggaggcggggaccgaggcccagcggggcgagcgtctcggggtgtgcgggaggctgaggaggctccggagcgcggagggttgctcgcgagcgtctgtgggaacagcggcacctccgcgatggtggcggagccgcggcggagctgctgcaccgacccgccgcccactccccgctcgggcccggcccacctcgcagtatcgcgcccctccattggtacagcgcggtgtgacgcggccgggggcccggccaatgggaggcggaggaggcgggatctctttttccttttttttttttttttttttttttttttaatctttttaataaaatgagcagagaagaaggcggagagaggccgagccttgacaacgccgcggcccggggctcgagggctcgcgctgcaggcggcggccagaggcggtgggctgggctcccgccgcgggcgcgtctttgtgagagtgcgaggccggccctcctccgccgcccgccgcgctccagtaccgccccccgcgccccccgggctgggccgggctggcggcgcgggcaggtcccgggtggggtggggggaagtccggttgatcttgctgttacccgggtcttaattggccttttcagtcattaggacgcggatccatgttgctgcgggctacagagtgggtgtaaaccattctcatatggactctttcgaaattctgatgagcggcttgtaatatttttcaaatagtgtacatgacaaaagatgaattacagaaagaaaaataaaagtgataagtcgcactgcttatttgaaaagaataaaaagtgtcatgaaggcataaaggagagactgtacaggtacagaagggattttagaaagagcagtgtacaactctataaggtacgtgtgaaaaaaaatctaaaaagaggaaaagaccaaacatcacctctttttctttgaagaatgaagtattgtgtcccacttcccgaaagcctgataatcacagggtctatcatgctgtaaagggagtaggggcaggccaaatgatcatattctagttcatataatttatgggattgaggggtttggaaatttcaattatgattagcagtttttgaaatgcacatcatgtttattgagttctttcacagagcctggcacgaatccagggtgaatcatcaacctattgttggtttgttaatattctgtaaatgcttattggtgtccttataccatacactcttcccgaaggagttaaggtccgtataaaataaggggtagaaaacgtagcacaaaataattcactcatctgtttcaaaagaagtgataattttctccttggaaaatctattcagattataatttccacattgaattattcattttttttttttttctgagagggagtttcactcttgttgcccaggctggagtgcaatggcgcgatctcggctcaccgccacctccgcctcctcagttcaagcgattctcctgcctcagcttcccgagtagctgagattacaggcatgcgccaccacacccagctaattttgtatttttagtagagatggggtttctccatgttggtcaggctggtctcgaactcctgacctcaggtgatccgcccgcctcagcctcccaaagtgctggaattacaggcgtgagccaccgcacccggcccacattcaattattctttaaagaataatttggactaacagatactattggaccatgacccaagagatcttaaaaaaaaaaaaaaaagccatagatccttgccatcacatttctgagtaactttcagcaagaaaaatcctctttgctggagttatgaaatggggaaactagttaatatctctttatatatctgataatgtgagaactgaattttaaaacctaataaattcaataaactgcttccaacattctagatatggataggactatctgacttcctgtttggaaatgatgagggataaagtatatcagttagatggcttcactttccatcaaaatctctatctacaggagcattctttcttttttttcttttttttttttttgagacagagtctcgctctgttgcccaggctggagtgcagtggcacgatctcagctcactgcaacctccacctcctcggttgaagcgattctcctgcctcagcctcctgagtagctgaaattacaggtgtgtgccgccacacccaactaacttttgtaattttagtagagatggaggttcactatgttgcccaggctggtctcgaaacttacaggagcattatttctaataaagattcagctctgtggtagacaaatggacaatgcactgccatccagcagggaggagagaggctctccacgttaggaaataacatttactatggtattagggattggccgtcactttcatttatccataaaaatgtaaatttagaagtccagaaatgccacatagttacaaagcataatatatggtatcagaccacaaaattagcaaactaaacccatttaactgtaacagtcccacgaaagaattgtggtccagccataaagccggagagtactggacctccttccaaggatctgagaagctgataatgcagtaaaataatcttcatcgttaagaacaactattaaactattgattgaaagcttatgttcccagtgccctaagaaacatgttacattctttagcccactttttctccccatgaagtgtattattattatctctttttttttttttttttttttttgagacagtttcgatcttgttgcccaggctggagtgcaatggcgcgatctcagatcaccgcaacctctgacccccgggtttaagcgattttcctgcctcagcctcctgagcagctgggattacaggcatgtgccaccatgcccagctaattttgtatttttagtagagacagggtttttccatgttggtcaggctggtctcgaactcccaacctcagatgatccgcccgcctcagcctcccaaaatgctgggattacaggcgtgagccactgctcccggcttattatctccattttaaaagtcaaggaactggggcttacggaagttaaagaactagctgaagattaaagacgtaaaataccgacttggatttttttcccatattaaatttttaaaagtttccttattctcttttcagcaatatttttaagtgggaattaagtaaataaagtagttattgaatctgaaaatatcaaggactttttttagttattttatgtatcttactacaggtaagaagtgatttttttttaaatatacagagatcacatcagagctgtattaaaggaagatggaaaatggggattatttaataaatgatattgggacaacaagatagctatatggggaaacaaaaaacaacaacacacacccactagattcatattactcctaacacaccccacccccaaaatcacaggtggatttctttatttttttaattgaaattttttttttttggagcccaggaatttgagactactctgagcaacataatgagacccccatctctacaaaaaaattttaaaaattagctgagtgtgatggcacatgcctgtagtccaggctatttgggaagctgaggtgggaggatggcttcagcctgggaggttgaggctgcagtgagctgtgatcatgccactgcattccaacctggtgacaagagtgagaccctgtctcaaaggaaaaaaaaaaaggaagttagcccttgcttatacgtgttgaaaatgtttctccccagtctgcctgtttcttgcattgctatggtgtttttatgccttatagggatgtgaaatatttatgcagtaaaatttattggtgttttttcctttatggcgtctggatttcctgccatgttagaaagagcttcttcaatccatgatttgaaaaagttttagtgttcttctaatacttttgatttcattttttaaaatcataaaaatttggcatagacaaaagaatatacattatgtgtacataggttgagggggataataataaaataaacaccagtaaactcaacctaagaaattgtggtttagtggtttcacttttttaatcatttattttaattttttttagagacaaggacttttttcttttcatatcaagcatggataattcttataattaaaaaaaaccattcaagttctttgaacatacagctggtaactagtcttcataattcaccagcagtactcaagctttagaacatgtaaattattttcccctaaaatgccttaagcagaactagggtgctttagcaggccttgtagcagactgaagcttgtttctaggcattttctatgaaattggcttccaagtttatgtagtgcaaatataagccaataacgagcctcagctatatctcccgttgcactttttcaggttgagcctccagcagcacttctttcttccccactgccagttctccgagctcaccttgcatttacccacagcgggttttcactttataatttattgtaaatcgaaatttctccctctccagttttttccccttgggccaggtaagtaacccctggtagcctttgaaagtccctgcactgaattggaacggagaaatggttgatgtttcagagcacatgtgtgagcaaatacagagagaggtgaaacagcttttcaaaacaaaggatcaaatatcagaaacccttttcctttgtttggctgtgatttattgtggattagcaattaagatttccaattctggccgggcacagtggctcatgcctgtaatcccagcactttgggaggccgaggtgggcagatcacctgaggtcaggagtctgagaccagcctgaccaacatggtgaaaccccatctctactaaaaatacaaaattagccgggcatggtggtgcatgcctgtaatcccagctactcggaaggctgagccaggagaatcacttaaacccagaaggtggaggttgcagtgagccgcgatggcgccattgcaccccaggttgggcaacaagagcaaaactccatctcaaaaaaaaaaaagatttccaattcaactctagaccctattgaattttatttccaccaaggtagaagtgggcctgattaccaacacacttacagatagatctcaagaaaccctgcttcactgggccacgtcggatttatgggagggatgcccttccctttgagtcgcactttgagccacagcatgttgtctggggcactaggatgccgtttggatgagatctaaacccaacatctgacttctgaccacttgtggttattaaaagtctcctagggcttgtgaaagaattaaagggaggagacgctgattttcattgtcttggcccaattccaagtttgataattaggagtcctcctccctctgtcttcctgccatttcactgagacatgcaattccacacttcctgttataaacagctgtccactgttaactgagtgagccagagagccagcaaattccaccctaggggaagctgcatttcaaaataaacatttcctccacatctacttgtaaattacctaggtttaccttggaggaaaggtgttattttctagggataagaagggcataataatggggagttgagaactatccacaaaccctagtttgtctaaacaccaaacaaacaagactaacattgatcacaaaggggccctcagaagaaatctcctcactaaagaaaatacattttagattctaaaattgtctttagggggtccagaatttaattgtataacattgatgtggcaggtgctattagccaccaaaactcacttcttcaatccaaggcatctacacaaacagaataaagaggaaaaactctgtaaccccggaaaaaaaaaaaaaaaaaaaaaaaaaacagaaaaattcacctccgccatccacgctccggtgtcgatgtgacacatgcctggacactcattttagtgcttccctcctctttgttcagcttttccaggcaccttaatttcaaaatatccacattcccattcctttcaatgccaaatatctccttctactactccagtttccagaataaattctgctatggctgggcacagtggctcacgcctgtaatcctagcactttgggaggccaaggcgggtggatcaccagaggtcaggagttcgagaccagcctggccaacatggtgaaaccccatctctacaaaaattcaaaaaattagccgggcatggtggtgggcacctgtaatcccagctgctcaggagcctaaggcaggagaatcgcttgaacccgggaagcagaggttgcagtgagctgagatcatgccactgcactccagcctgggccacaaagcgagactccatctcaaaaaataaataaaataaattctgctacatttgcttttttaaaatcttattaataaaaacagcattttaacatggaagcaaccaagatgtccttcattaggtgaacagataaactgtgatacattcatgcaatgcagtattattccacactaaaaaggaacgtgctatcaagccaggaaaaggcatggaggtgctgggtgtggtggctcactcctataatcccagcactttgagagccaaaggcaggaggatctcttgaggccaggagttagagaccagcctgagcaaaatggtgagactccggctccacaaaaatagtaatgatctttaaaaataaaaataaaaaataaagaaaaggtgtaaggaacattaaaggcatattaccatgtggaagaaaccaatgtgaaaaggctacataccatatgaatccaactatctgacattctggaaaaggcaaaactatgtctaggaaaggcatattctgggaaaggcagtaaagggcttagtggttgcgagggctttgacagggggagggataactaggtggagcacaggagatttttaggacagtgaaactattattctgcatgatactttattggtggatatatgttactatacatttgtcaaaacccacagaatgggccaggcgccgtggctcacgcctataatcccagcactttgtaaagggaggcagaggcaggaggatcatttgagcccaggagttcaaggctgcagtgagctgtgattgcgccactgcactccagcctgggcgacagagggagactctgtctccaaaaacaaaaaggctgagtgcagtggatcatacctgtaatcccagcactttgggaggccaaggcaggcagatcacttgaggtcaggagttctagaccaggcaggccaacatggtgaaaccccatctctactaaaaatacaaaaaagtagcccggtggcacgtgcctgtaattccagctacccgggaggctgaggcaggagaattgcttgagcctgggaggcagaggttgcagtgagccaagattgcaccactacactccagcctgggcaacaaagcaagactctgtctcaaaaataaataggctgggcgcggtggctcacgcctgtaatcccagcactttgggcagccgaggcgggtggatcccgaggtcaggagttcaagaccagcctggccaagatgatgaaaccccgtctctactaaaaatacaaaaaattagctgggcgtggtggcacgcgcctgtaatcccagctactccagaggctgaggcagagaattgcttaaacctggagaggcggaggttgcagtgagccgagatcgcgccactgcactccagcctgggcaacagagcgagactccgtctcaaaaaaataaaataaataaataaataaaataaacgatggactttagtgaataagactgtatcaacattgactcatcagtcataacaaagagaccacactgacaggagatgttaataacaggggtagcagtggggagtgaggggtatacaggaactctgtcctttgggctcaattttgctgtgaacctaaaaccgctctaaaaaatgaagtctattggccaggcgtggtggctcacgcctgtaatcccagcaccttagggattacacacccgtaatcctagcgaggcaggtggatcacctgaggtcaggagttcaagaccagcctggccaacatggtgaaaccccatctctactaaaaatacaaaaaagtagctggacgtgatggtgggcgcctgtaatcccagctactcgggaggctgaggcaggagaattgcttgaacccgggaggtggaggttgcagtgagccgagatcacaccattgcactccagcctggggaagacgagcaaaactccatctcgaaaattaagagtctattaatcaaaaaagcaagagcatttgagttctgtcctttttatggtgaagaatggagacttactcaacatctgaagtacagatttagcatgaggaggttccaacgtggaagccaggcaaagcagagcaatctgacctcaggaagggaagagacagaagtgaggccacgggaaggtcgggactgcagctctcttcccagcgttaatgtcactggtcccctgttctcatcttcccaccccccggcctcctcaccctgcaccacgtggcttttcttgacttcacagccttcttctatttgcacctccctcgtaattgcggcttgcatgtggcttctcacagcctctccggttgttccgcagcttatgactgagcagcttgggcggcttctgccaactcctcatgacttcagtatttcctagttaaaattcctaagaggaagaaacctaattggcccaggtcatcctttcaggccccaccctggcctggccactgaaggctgtcagccatcggtcagtgcacagccaggctgtcccagggagctgcttccccaaaggctcagtaggacagcttgtctgaagatgggcccaggggtgtgacagctctcctgatgtgtcacacaaataccagagtatcaccttagctggggatacattccagacccccacggatgcctgaaaccttggacagtaaaccatttctactatgctttttcctaggcattcacacctaagataaagtttaatttataaattaagcacagtaggccgagcacagtggctcacgcctgtaatcgcaacactctgggaggccgaggagtgggggagtggatcatgaagtcaggagttcgagaccagcctgaccaacatggtgaaaccccgtctgtactaaaaatacaaaaattagctgggcatggtggtgcgtgcctgtaatcccagctactcaggaggctgaggcaagagaatcgcttgaacccaggaggtggaggttgcaatgagccgagatcgtgccactacactccagcctgggcgacagagtgacactcaatctcaaaaaaaaaaaaaaaggaaaatgaaaaaaatttttaaaaaattaagcacagtaaaagattaacaagaggactggggcgtggtggctcacgcccgtaatcccagcactttgggaggccaaagtgcaaggatcctttgagcccaggagttcgagaccagcctgggcaacaaagtgagactctgtctttacaaaaaatacaaaaagttacccagatgtggggacgcacacctgtagtcccagctacctgggaggctgaggtgggagaatcacctgagctccagaggttgaggctgcagtgagcactgatcacaccactccactcctgcttgggcaacagagtaagactctgtctcaaaacaaaaaacaatacagtgcaataaaagttacatgggccaagaaccgtggctcacacttctaatgcctgtaatcccagcattttgggaggctgatgcaggagaatcacttgagcccagaagttcgagaccagcctgagcaacacagggagatcccatatctacaaaaatacaaaaattggccaggcacagtggctgatgcttgttatccctgtactttgggaggccgagacgggcagatcacctgaggtcaggggtttgagtccagcctggccaacatgcgaaaccctgtctctactaaaaatacaaaaattagccgggcgtggtggtgcatacctgtactgtaatcccagccacctgggaggctgaggcaggcgaatcactggaacctgggaggcggagtctgcagtgagccaagatcaggccagtgcactccagcctgggcgacagagtgagactctttctcaaacaaacaaacaaacaaaaagtatccaggcttggtggcatatgcctgtagtcccagctacttgggaggctgaggtgagaggatcccttgagcctaggaggtagaggctgccatgatcacaccactacaatccagcctgggcaacagagtgagatcctgtctcaaaaaggaaaagaaaacttacttgaatgtgattgctctcctttgctctcaaattattatactgtactttactaacctattttcagacacagttgaccacagcacactgaaaacgaggaaagagaaatggcagatacaggtgggactactgtaatgtgcttttggaatgggtggtggcaaaaaaagataagagttacgctagtgtcaactcatgcctgtaatcccatcactttgagaggccaaggcgggtggatcttttgagcccttaagtttgagaccagcctgggcaacatggcaaaacctgtctactaaaaacacaaaaaatagctgggcatggtggtgtgcacctgtagtcccagctactcaggaggccaaggcagaagaatcacttaaacccaggaggcggaggttgcagagagctgagatcgtgccactgcactccagcctgggcaacagagcgagactctgtctcaaaaacaaaaataaaaaaatacaaaaaattagctgggtgtggtggtgtgtgcctgtagtcccagctactcgggaggctgaagtaggagaattgtttgagcccaagaagttgagtctgcactgagctgagatctgccaatgcactccagcttggacaacaggagtgagatcttgcctcaaaaaaaaaaaaaaaaaaaaaaaagataaaggtaaaactgaaccttagcagctattttttaaataatcacctttacagtggacatttgtcctttcttacagagaaaacccaaaagaaggggagaaggggcagaccataagttacagaatgttcacattatcttgatcagtaaaaattctataagaatgacccccgaaacagctgggcacagtggctcatgcctgtaatcccagcactttggcaggccgaggtgggtggatcacctgaggtcaggagtttgagaccagtctggccaacatggcgaaaccccatctctactaaaaattcaaaaaactagccaggcatggtggtgggcacctgtaaccccagctacttgggaggctgaggcaggagaattgtttgaacctgggaggcagaggttgcagtgagccgagacaagatcgcaccattgcactccagcctgggtgacagagcgagactgtctaaaaaaataaaaagaatgatccccgaaacacatccccataagaagcctttcaaaaagtccccatgaccttcaaactagtagcaaattcttactatacccaaggagagtaaagataacaccaagtacacacctgtaatcccagcactttgggaggccgagacaggtggatcatgaggtcaggagatcaaggccatcctggctaacatggtgaaaccccgtctctactaaaaatacaaaaaaattagccgggcatggtggcgggcgcctgtagtcccagctactcaggaggctgaggcaggagaatggcgtgaaactgggaggcggcgcttgcagtgagccgagatcgtgccactgcactccagcctgggcgacagagcgagactccgtctcaaaacaaacaaacgaacaaaaatgttaaatatttcccaagaacctgtgactagattatatctacataatggtctgtatctgtgtgtttgtgaagaattctccccgtagaggtagattcttgtcttcctaagacaaatctgaatcagtcctaagatcacatcatcagtgacttgatgtcctcctccccttcgtccctgtttagattccatggtcagagtcctctctccagtgtgtacacctttatcaacctccccctctcacttcctcacactccctgggcaaaaccacaaccctggtgataattccaatttgctgcctggtaggcatctgcacctgtccagccaaatgaggctggcatcacactaacgagtttcactttcaaattcacaaccacaaacctcacgtggagtcttcacgccccttggcaatcatacaacacttatccaggttaatttctcccttcattttccaagcagttattttataacctctcctttctgctcaaacctccaacacctcctcccttcccctcacttccagttaatggctttctttcggttcactgtgaatgttgacacaatcagcagagaagctgtgtgatctcccccctccccacacctatctatcattctctaaatccccacgctctgggctcctgcctactattatagacaaagcatctctgctattagagcccagccctctgcctgtgcacttgatccagtcccctctgattactcatggatatcactcagaaattatcccctctctctgctacatcagggttttattttttattttttattttttttgctctctgctggatcattcccattagaatatacataagataggccaggcacagtggctcacacctgtaatcccaacagtttgggaggctgaggtgggcggatcacctgaggtcaggagttcgagaccagcctgaccaacatggtgaaatcccatctctactaaaaatacaaaaattagccggtcatggtggcacatgcctgcaatcccagctgcttgggaggctgaggcaagagaatcgcttgaacccgggaggcggaggttgcaatgagtcaagatcgtgccattgcacttcagcctgggcaacaacagtgaaactccatctcgaaaaaaaaaacaaacaaaaagaatatacataagttttttttattcccctataataaggcttctcttaactaagctttagacattatctactgccccatttctttgctcccttttccagcaaaacacctttgaaagaatgatctacatttgctgtatccaattccttgtttcctattctctgtaaaatccaccccaatctcactctaactcaacctctcctccaaaacttttcctatcaaaaggaagagccagtggctcacacctataatcccagcattttgggaggccgaggcaggaggatcacttgaggtcaggagttgaccagcctggtcaacatggcaaaaaccccgtctctactaaaaacacaaaaattagctgggcatggtggcgcatgcctgtaatcccagctactcaggaggctgaggtacgagaatcgaatcgactgaacccgggaggtagaggtggcagtgagccaagattgcgccattgcacccagcctgggcaacggagactctgtctcaaaaaaaaaaaaaaaaaaaaggagagccagctggactccaaaagagagcccatctttctaccgagcccagcccaggtgaccccattttgcctctctcccaggcttgaccactatgccatcatcaagttcccactgaccaccgagtctgctatgaagatggaagacaacaacacacttgtgttgattgtggatgttaaagccaacaacaccaagtcaaacaggctgtgaagaacctctatgacgtggatgtggccaaggccaacaccctgattcggcctgatggagagaagaaggcataaaggcatatgttcgactggctcctgattatgatgctttgaatgttgccgacaaaattgggatcatctaaactgagtccagctggctaattcttatctgatacaattgatcactgttcctgcctcctctttgccagaggggctcttgcaattttgttgagttttacctccagaagcccaactgggttctcacaatgatctgaaaaaaatcccctcatgcttccagcagggggagaggaaaagcagccgttttggaatacacccagaacactctgattttttcaggggattttttttttcttttgagacagagttttgctctccttgcccaggctggagtgcaattgagtgatcttggctcaccgcaaacttcgcatcctgggttcaagtgattcccctgcctcagcctcccaagtagctgggattacaggcatgaacttccacgcctggctaattttgtatttttagtagagatggggttcctctatgttggtcaggctggtcttgaactcctgacctcaagtgatccgcccgccttggcctcccaaagtgctgggattacaggcatgagccaccgtgctcggcccagaacactgttcttaataaggcctgccctgaaaggaaactacagtcatacactgcataagacgttttggtcaacaacagaccacatatatgatgattgtcccagaagataccatatttttactgtacccttttaatgtttagatttgtttagatagggccaggtgcagtggctcacgtctgtaatcccccagcagcactttgggaggcagaggcaggaggatcccttgagccgggaagtggaggctgcagtgagctgagatccagtcactgcactccagccgggaagacagagcaagtctctgtctcagaaaaaagaaagaaagaaagaaagaaaacaaaagaagaaagctttatcagacaaacaaaaattgagaaaattcacatccgtaatcccagcattttgggaagctgaggcagggagggccccttgagcccaggagttcaagaccaccctggacaacatagtgagaccccagcctctacaaaaaattacaaaacttagccaatcatggtggcacatgcctactctggaggtcaaggtgagaggatcacccaagccagggagattagggctgcagtaagccatgattgtgccactgcactccaccctgggtgacagaccaagactcttgcctaaaaacaaacaaacaaaaaaattaaggacatttttgccggcagacctgcttttcaaaaaatgtttaaagtatttttttgtttttgtttgtttttgtttttgttttttgaagtggagtctcactctgtcgcccaggctggagtgcaatggcgcgatctcgactcactgcaacctccacctcccagttcaagtgattctcttgcctcagcctcccaagtaactgggactatagacgtgcaccaccacacccggcttatttttgtatttttagtagaaacagggtttcaccatgttggccaggccgatctcgaactcctgacctctggtgatctgcccgcctaggcctcccaaagtactgggattacaggtgtgagccactgcacctggcctaaagttttttgtttttgtttttgttttcctgggcacagtggcttaatgcctgtaatcctagcactttggaaggtcgaggcaggcagactgcttgagcccagcagtctaagaccagcctgggcaacatggcaaaaactcatctctacaaaaaacaaaaaaatacaaaaaattggcgacatgtggtggtgcacacctgtaatcccagctacccaggaggctgaggtgggaggatcacctgagctagggaggtcaaggctgcagtgagatgagattgtgccattgtacatcagcccgggtgacggagtgagatgctgtctcaaaataaaataaaataaaataaaataacgctgggcgtagtggctcatggctgtaatcctagcgctttgggaggctgaggcaggcaggttgcctaagctcaggacatcgagaccagcctgggcaacacagtgaaaccctgtctctactaaaatacaaaaaattagccaggtgtggcagcgtgcgactctagtcccagctacacgagaggctgagacaggagaattgcttgaactcaagaggcggaggttgcagtgagccgagatggtgccactgcactccagcctgggcaacagagtgagactctgtctccaaaaaaataaataaataaaaaattaaaattaaaaaagtttttaagagagatgaaaaatgacattggtcagaaattcagaaatacatgaagaaaggaggaacattagagaaggaataagtgaagataaaataatcttacatgaagtgacacaaaaaaatctaaggaataaatatatgttgaaggagaaagttaacacacaaaaagacatttatagaatggcaccattcatatgaattataaaaacatactaaacaggctgggcgtggtggctcacacctgtaatcccagcactttgggaggcagaggcaggcagatcacgaggtcaagagatcgagaccatcctggcaaacacagtgaaaccccgtctctactaaaaatattttttaaaaaaattagccaggcatggtggcaggcacctgtagtcccagctactcagaaggctgaggcaggagaatggtatgaacctgggaggtggagcttgcagtgagccgagatcgcgccactgcactccagcctgggggacagatcaagactccatctcaaaaaaaaaaaaaacatactaaacaatgccatatgtactctatggatatatataagtacacacatcttctctaagaagagtgaaaccaacttcaggatcagttacctctggggagggtggcaggaaggcaatgtgagaagaatctttttttttttttttttttgagacagtcttgccctgtctcaatggcacaatctcggctcactgcaaactccacctcctgggttcaagtgattctcctgtctcaggctcccaagtagctgggactacaggcacacgacaccacacctagctaatttttgtatttttagtagagatagggtttcaccatattggtcaggctggtctcgaactcctgacctgaggtgatccacccacctcagcctcccaaagtgctgggattacaggcgtgagccactgtgcctggccgagaagaatcttttggctgtagttgtaatatcttatttatttattttttgagatggagtctcgctctgtcacccaggctagagtgcagtggcacgatcttggctcactgcaaactccgcctcccaggttcaaggaattctcctgcctcagcctcccgagtagctggactacaggcatgtgccaccatgcccggctaactttttatttttagtagagatgagggttcaccatcttggccaggctggtctcaaactcctgaccttgtgatccgcccgcctcagcctcccaaagtgctgggatttcaggcgtgagccaccacgcccagccttatttattatttttgagacagtgtctcactctgtcacccaggctggggtgcagtggtgcaatctcatttcagtgcagcctcacctaactggctcaggtgatcctctcacctcagcctcctgggtagctgggattacaggcatgcaccaccacacccagccatattttatttatttagaaactatctcaggctgggcacagtgactcatgcctgtaatcccagcattttgagaggtggaggtgggcagattgcttgagctcaggagttcgagaccagcctgggcaacatagaaaccccatctctacaaaaaatagaaaaactaggccgggtgcggtggctcacgcctgtaatcccggcactttgggaggccaagacaggtggatcacctgaggtcaggagtttgagaccagcctgaccaacatggtgaaaccccatctctactaaaaatacaaaattagcaaggcatggtggtgggtgcctgtagtcccagctacttgggaggctgaggcaggagaatcacttgaacctgggaggcggaggttgcagtgagctgagatcgtgccattgcactacagcctaggtgacaagagcaaaactccatctcaaaaacaaaaaaaaaaatttttttttaattagccgtgtgtggtggtacacgcctgtgatctcagctactcgggaggtagacgtgggaagatctcttgagcccaggagtttaaggctgaagtgagccatgatcttaccactgagctccagcctgggagacagagtaaaaaaaagagtgtcgtccacgtttatttttaaattttttctttttttttgagacggagtttcactcttgttgcccgggctagagtggaatggcgcgatctcagctcactgcagcctccacctcctgggttcaagtgattctcttgcctcagcctcctgagtagctgggattataggcacccaccgccacccccagctaattttttgtattttcagtagaaatggggtttcatcatgttggccaggctagtctcaaactcctgacctcaggtgatccacccacctcggcctcctgaactgctgggattattggcgtgagccaccaagcctggcctttaaatttttttttaacagacagggtctcactgtgttgttgaggcttgagtggtgcacattttaagaaaaaaaggcgtaagtaactttgtttcccaacgtctaaggcaaggtttctgattctgattccagggattcctcaagtgcccataaacccctggaaattatgtaaaaggaatgcgagggtgtctatgtatatctgtgtatgtgtgtgcacacgggtgtcagcacgtgacatgcacattttttggggagttagagccacagcacttgatggggtttcaaagggagtccatgtctcagaagatggctacaaaccactgctctgaaggcaaggtcatccagggaatggctgcttagagctttcctctctccacggtgtgcggacttgggaatctggccgctcctttttctgctcacaggctgtctttctgcatgctttccactgatgcgagggtggggacttctctcagcccgaaccgtttgctccactgtctcatgacatgaaaacaaatgtgcacgaaacagcccattcattaaaagaatcatgcgaagaatgacctccgcctgcagtagtcatcaaataacagaataattcagggctggaggggtagggaggggacatcaagatgcagagatctcatttgtcttttcattctggcagtttggctcagaatgaccaaatgttcatagaaatatgaaccctgtaacgacggcatttaaaactccaaatattttaatccttgaacatatatgggatgcattgtgttggactaacttcagatctgggtaactaaagatttctctaattggaaataaatagtaaaagaaattatatttgagaccaggtgcggtggctcacacctgtaatcccagcactttgggaggccaaagtgggcagatcacttgaagtcaggagtttgagaccagcctggccaacatggtgaaaccccatctctactaaaaatacaaaaattagcagggcgtggtggcgggtgcctgtagtcccagctactcaggaggctgaggcaggacaatcactcgaacatgggaggcagaggttgcagtgagccgagaatgtgccttcactccagcctgggcaacagagcaagactctgtctcaaaaaaaaaaaaaaaagaaaaaagaaagaaagaaattatatttgagaaaaatacaatctggtctttttccctccaaccatctaaagttcaatactgtgatagccaagttctttcagttagttgcctttgcaggttcatgtttattcatcagctacactttccaaaatcatattatttgtggaggattctgagtagtgaaaattagtagcttgatgtctcatctaaatgccaaaaatatgcagcagaaatacagttaaaaataactttaattgaacaaatgtttgaaataactcatcttttttttttatatatttcatgacacaatgaaaagatatcatggccatttctggaaaaggagatttatctgccaagagccatatgtgctgaccttcaaattcacaagtgctgaaaccgctaatgaccaacaaaagtgtttcctctgagtgggattccatatccccccagacccctactgctgtattctgtttttaccttgcagcaataaaaagtagctcattcttggtttttatctggcaaaatatcacaatttaattaaattattttggtgtgagtccaaaacagtctctccacagtgtcacgaaagttataggttttctgatagatgccaagaccattaagcccactttatgataattatgcacccatgtatcatgctcatctatattttacagttcattatttaacagtgcttatctcaaaggttaaagtctttataggatcatttggctgattcttaacttggctaatttacaaataatctcacaaatatctttttgtcactgatatttgtccacaaagatctgattgagagtatggaatctttacattataaatgcttcactgctttaactagatgctcttccgagtttccttatgacaaataatgaccactctgtcaaataaatgcaatacacattcataatgtggtgaactgattttttaaaccatttttccttcattgtaaattagaaatcaataatctaagttgtatttcctgctcattaatgcacattaataaaagccatcatataaaaaaagaaagctgaaaacatggaaaaaataacaaaagatctttttcataataaaacattttgggttactaatgaaactaattaaaagtacgaaaattctaaaagattcgtataaatgcaataaatcatcctaaagattgaaatgcatgtaatgtttatagggctgtttcctgggccggggaaacacactagggatacactagccagatcgttggaattctagccaatgcctctttcatttcttatagagaaacacaagtcgatttttgatgcttattaaaaaaaagtgattccttgattcatatcttaactgaaaattataacttattaacaaagggtaagaacatcagaactatccataataattggtcttggtctatcacacaaatatttgttcccttcctacacaggactgttttctgggagcaaagaatcactgtggatttagcaaggaccttggaagcccccaggatgctttacactggatttcattagctgcccggtattcctttgaggtcggtaagtaaactgctgcatttctgagaacagaatcgaatgggtcatcctgaattacttcagtctagtactgcagttttcccaacaaagacatagaggcacagcagaagggtgaatccatagttatcaagctggtcttggtagaccagcctgggtgacacagcaagacaatgtttcaaaaaaatttaaaaatttggccaggtgcggtagttcacacctgtaatcccagcactttgggaggccgaggtgggcagatttcttgaggctcggagtttgagagcagcctggccaacatggagaaatctcatctctattttaaaaaatacaaaaattggcagggtgcagtggcacacgcctgtaatcccagcactttgggaggccgaggtgggaggatctcttgaggcctggagtttaagaccagcttggccaacatggagaaaccccgtctctattttaaaaaatacaaaaactagctgggcgcggtggcacatgcctgtaatcccagatactcaggagactgaggcaggagaatcacttgaacctgggaggcagaggtaatgagacaagattgagccactgcactctagcctgggtgacacagcaagacaacgtttcaaaaaatatttttttaattaaaaaattagctgggtgtaagggcacatgcctatagtcccagctacttgggaggctgaggtgggaggatctgcctgaccctgggaggtcaaagctgcagtgagctatgactgtgccactagcctccagcctctgtgacagagcgagaccctgtctaaacaaacaaacaaaaaaatggaagcctataatctgggatgccaaggctggcggatcacttgaggtcaggagttcaagaccagcctggccaacatgctgaaaccccgtctctactaaaaatacaaaaattagctgggcatggtggcacacctgtaatcccagctactctagagtctgagggaggagaactgcttgaatccaggaggtggatgttgcagtgagctgaggctgcactccagcctgagcaacagagccagattccatctcaaaacaaaacaaaaaaacaacaaacagttaaatataacaaaatctctaaacatgggtgaaatttaggtgactgcttaccttttcagtcttccaaccaccaaaggttggaatggccctgggcccagtcctcagctttcttttctttctctacacttgcaacttggatgccaaattcatactcatgactttaactaaagctatatactgaaactcccaagtatatatctctagccctcttcctcaaactccaaattcatggacctacatgcctacataaaatctgatgggcgtctgatatggtttgactgtgtacccacccaaatctcatcttgaattgtagctcccataatcccctatgtcgtgggagggacctggtgggaggcaattgattcatggggttgggtttttcctgtgctgttctcgtgacaatgaataagtctcacgagatctggttttataaaggggagttcccctgcacacgccttcttgcccgccgccatgtaacacatgcctttgctcctccttcactttccgccatggttgtgaggcctcctcagccatgtggaactgtgagcccattaaacctctttttttaaataaataatccagtcttgggtatttcttgtagcagtgtgagaacagactaatacagcatcttaaattgattagggctaaaaccaaagcccagctttccttctctcaaacctgctccttccctgggtttctccatcttggtggatggcagctccctccttccagttgatggagttgttccacaacttcatcatcattgtcgatccccctcttttacacagcctgcatccaacccatccacaaaccccaccttgaaaataggtccagaccctgactactcctgaccaccttgggggctactgccctggttcagattgctatggtctctcacccagcttacagcacccacttcctcatctgtcttcccaccctcccactggctgttctcaccagggatagcaattgttttgcaacttaggcctcggcccagtggctcatgcctgtaatcccagcactttgggaggccaaggtgggcagatcacctgaagtcaggagtttgagaccagcctggccaacatggtgaaacctcgtctctattaaaaatacaaaaattagctgggcgtggtggtgcttgcctgtagtccccgctacttgggagactgaggcaggagaatcgcttgtacctgggaggtcaaggttgcagtgagccaagatcgtgccactgcactccagcctgggcaacagagtgagactgtgtcaaaaacaaaaaaacaaaacacacacacacaaaaatgagaaaacaacaactgaggtcacattttgccctcctcacttcagagtcctccactggctcccatctcattcagggaaaacccagggacgtcaccagggacccacagagtcctacgtgatgtggtcctgtatgtgttttctccaacctcattccccactgatcttgtcctgacccactgttctccagcctcattgatctcctggtgttattcacatagacctcgcctggattgagcaccccaggacgttggcattaccagcctctgcctgagggccctgctgtgtgttgaactgtgtcccctaacaaagctacgtcgaagttgtagccttatttggtgctgtggtctgaatgcttagtcctcaaaattcagatgttgaaactgaatccccagcgtgatagtatgaagtggtggggactttaggaagtgacaggtcatgagggctctgcccttgggaatgagatttgtatcctcgtcaaagaggcctgaggtgggaggactgcttgagcccaggagtttgagactacagtgagctaggattgtgccactgcacttcagcctgggtgacagagcaagaaagttcttgtctcaaaaaaaaaaaaaaaaaaaaaaggtgggaggtgggagggagagcattaggacaaatacctaatgcacgtgggtcttaaaacctacatgagaagttgataggggcagcagaccaccatggcacatacatacctgtgtaacaaacctgcatgttctccacatgtatcccagaacttaaaaaataaaaataaaatttaaaagaaaaaagaggcacaaaggaaactgtgtgccccctcctccaccatgtgaggacacatagaaggtgccatctatcaggagcagcctcttaccagatactaaatctgctagtgccgtgatcttggactttccagcctccagaactgtgagcattaaatgtatgttgtctatagttacccagtctaaggtatgttgttatagcagcatgaatggactaacgcttttttttttttttttttttgagaaagagtctcgctctgtcacccaggctggagtgcagtggcgcgatctcggctcactgcaagctccgcctcctgtgttcacaccattctcctgcctcagcctcccaagtagctgggattacaggcgcctgctaccatgcccggctaattttctgtatttttagtggagatggggtttcatcaggaaaccccagatgttggaagaggcaagaaagatcctccaagagccttcagtgccaggatggtctcgatctcctgaccttgtgatccacccgccttggcctcccaaagtgctgggattacaggcgtgagccaccacacccggccaagacttttttatttttttgggatggagtctggctctgtcacccaggctggagtgcagtggtgcgatctcagctcactgaaacctctgactcctgggttcaagtgattttcctgcctcagcttcccaagtagctgggattacaggcatgtgccaccacgtccaactaacttatttttgttttgttttgtttttgagatggagtctcgctctgttgcccaggctggggtgcagtggcatgatctcggctcactgctacctccacctcccaggttcaagtgattctcctacctcagcctcccaagtagctgggactacaggcacgtgccaccatgctggctaattttttgtatttttagtagagatggggtttcaccgtgttagccgggatggtcttgaactcctgacctcgttatctgcccgctgagctcagccttccaaaggctgggattacaggcatgagccaccgcacccagccaacttattgtatttttagtagagaaggggtttcaccatgttggccaggctggtctcgaactcctgacctcaggtagtctacccgcctcagcctccgaaagtgctgggattacaagtgtgagccaccgtgcccggcctggactaagacattttggaataaggtttttgcaaatgtaatcaagttaagaggagtcatactggattagcgtgggctttcaatccaatgatggtgatctactaaggagagagattgagaaacacagaagagatgcacagaaaagaaggccatgaactgatggaggtggagattggggtgatgcagctgtaaccctaaggcaagtgaccccaaggatggccagcagctaccagatgctgaaagaggcaagagagatcctccgagagcctccagtgcctgctgatgccttgatttcagactgctaggctctagggctgtgagagggtgacttctgtttttttgttgttgttgtttatttgtttgaggtggtgtctcactctgttggacaggctggagtgcagtggcgtgaacttggctcactgcaacctccacctcccaggttcaagcgattctcatgcctcagcctccccaagtagttaagattacaggcgggtgccaccacgcccggctaatttttgtatttttagtacagacagggttttgccatgttggccaggctggtctcgaactcctgaactcaggtgatcctcccgccttggcctcccaaaatgctgggattacaggcgcgaaccacggcacctggcctgatttctattgttttatgacatccagtctgtggtcatttgttacaacagccacaataaactaatagaggtctcgccccaatgtcagatgcttcctactgccactcggagggggcttgcggggagggctctgtggctctgctccacgcctttctctcaggtcaccacagctccaaccgagaggactctcccatagtctgggcaggggcacagggtgatgccctccttccccattctctttccaattctctcagcgtcacgtagactccgctgcttccctaggctttccctgttgagttgtgagaaaagcagatattgcttcttgacccttacattctattattctttctttctttctctttctttccttcctttctttctttctttctttctttctttctttctttctttctttctttctttctttctttctttctttctttctctctctctctctctctccctccctctctctccctccctctctctctctctctctctctctgtctctctctccctctcttttttttttttgagacagagtttccctctgtcacccaggctggaatgcagtgacgtggtctcagctcacttcaacctccatctcccaggttcaagtgattttcctgcttccacctcctgagtagctgggattacaggcacctgccaccacgcctggctaagttttgtatttttagtagagacagagtttccccatattggccaggctggtcttgaactcctggcctcaagtgatcccccctaccttgacctcccaaagtgctgggattacccactgcgcctggccaactttgagtataaatatgggtaggaaaccgtgagaagcataacaacaaagacaccctcctgcaaatgttctcaggaagaaaaagcagtggttggagggatctggggctttatgcatagcttgaggcaaaccagctcagagtcacggggaatcaggagcgatgggtcatctccccgcctccctggtcactggtggagacatggcggaggaaggctacccataaataggccagataacagctgcacacagggagtgtccgggagctcacccagggctgcaggggaaagtggcttcctctcaagctgtgcttagggccagctgtggatgtttcctgaaatcaacatgctaccttgaccagatgatacaaaaatatgtccagacccctttgctcaggtctacacagcaagaacacagggccagatggcagtgccagctcccatctgcactcagcatcgactgctctgaggccccagggggagaacgtatggctccaacacaaacaaagactggccaggacctcagcctgctcctgtctgtgcccttgaactggtgctgctcctcctaggagctccacgtcccccttccctttgctgagagctctgaaggagaggtaaggaaagtgaatcccaaaaggtttacctttgccaaaataattgtttgccaggaacagcctctgtttctaagggccaaggcaattgagttcttaataagtcaccttgtaatctactctaacgaaacctccagatacagtaggaaccccaggacacctccagcctctcctgtttttacaaagaaaggaaccattaagactgaaccaagttgtgtttccagctgaggctcagagaagttaagtgacctggccaaagccacacagccagcggtggcaggaatcagtgctctgagagagtgagcattgatgtttttgctcatcatgcattcaccctttctctagtcacagcgccccattcttctggtgggaaacacccccctcccagtctcagtccattctgttgggcgaggctgagctatctccagaatctaagggtgaccatgtgacccaggcctaatcaatcagtgattccatctcccttggcgatagtgattggttcaaggatacacatgtaacccattttgagccaatgagagtcaggcttagggtttttgctgaaacaattgagagaaagaagctaggggtgctgagctgaacctacagaggtgctggggccaccaagcggagagatggattgaggctgagtcctgatgtcatcgtctcagtctctggacccagccgtgcctgaagccacgtcctttttggtttaaacttccttgaattggtcactgctgtaggttcagcagatgaaagatgctgaaccaactggaccccaaacccacgccctcttccgacactgcgccgccatcagcccagatccaccaacctggctccccccggggagcagacgaggtccaccaacccaggtccccccggggagcagacgagcacgtgggcacggctttgctgttgttttcgcctttggatcaaactagccccagggacttgggaagcatagcagagcccaggaagctctctgcacctttccctctgcgtccttcccagtcacctgctgtatcttccctcctttccaggaaggaggcaattagagacaagtgaaatgtaagcttccatccaccatctcaaaggaggcagaaacatggcttggaacccaaacgtaacacttcacaggctttgtatctggcacacttttgttattcttgtcatcctagggatgttttcttatggtgtccaggaaaaaaaaagaaagaaagaaagcccttatgaagaaaagagaaccaaagtggggagcctgcttatgccagcatctacatagatttccagcatcactgctggtttgataaatgcagctcctctgcccctggctcgtgtgtgaccatgtttttggcaagagctacatcccaaggtctcaagtgctgtctgacgacacatcactgtgtatagttcctgagggactttgctctccgaacctcgtgtgacaataaccctgaggagccccagtccccaccctgccatgtgagtgggacttaggtacaggcaagatttaataagtaggctgtcactgctattttgcagggatcagttaggacaaaggacacccaggcaggccagggcatactttttgggggactcacacatttgaggtcagcagtgaatttctaagtctctatacttttttttttttttgagatggagtcttgctttgtcacccaggctggagtgcagtggcacgatctcaactcactgcaacctccacctcccgggttcaagtgattctcctgcctcagcttcccaagcagctggaactacaagcgcccgccaccacatccgggtaattttttttttctttgcagacaaagtctcactcttttgcccaggctggagtgctgtggtgtcatctcggttcactgcaacctccgcctcctgggttcaagtgattctcatgtctcagcctcctgaatagctgaaatcataggtgcctgccaccacgcccagctaatttttttgtatttttagtagagatggggtttcaccatgttggccaggctggtctcgaactcctgacctcaagtgatccgcccaactcagcctcccaaagagctgggattatagacgtgagccactgtgtctagccttcattttgttgttgttgttgttgtttagttgagacagggtttcatcatgttggccaggctggtctcaaactcctgacctcaaatgagccttggcctcccaaagtgctaggattacagatgtgagccaccgtgcccggccctaggtctctatacttccaggtcatttgaattggggtgacattagtgtggagacatcatctctgtttattggtgaagtaagctgagagtggccttctttcaggaggagggggccaccgcctactgtgagagacccccaacacatagcttccccttagggcagagtaggattggtcaagcctttgttttttcagcaattgtccctgtttctactctggaagtcatatttctctagtatgaggcattatttctgcagtgtctaggccttaggaaggtgttggctagagacttacaagggtcttttaacactgcaggctctttatgccaaatactgcagcccatttcctatggaggttggctggctggctggctggctttgatgttggtggatgagatgaggcccaacattccataaaaacagggaaaaagtgtgaccaagatgaccaagaggagagacccaaggatctgatcactcccgaccccgcctcgggctgcccttccccagaccaggcacccagggcccctgccttgtgtggagtcactgattctccccgaatggccctagagcactccctcaaacaggtgctgtcacttggaatgacagaaatcagtgcaggacacctgtggaaattctcccctgaagttgcagcctgaccacagatgccctccatatgagcacttggcatagaacccactggttccctttaaagcaggtgcacgtgaacttgggtactcaccctgtggctgcctctgccatgctcatttccaaagtggtccccggggctggtcccaggaagtattgttcccggccctggtttgctggtttttctggcttgtggctggccatgccacacacagctgcacctgctctgcggctttgcttcccagtgaggcggaggcaggtactaggtctcactgctgaagatcagagttcagtgctagggcagccagagagggaggggagctgtggccaagcagagaggcagggaggcacagcagctgctcttcccacagctgtttcctcctctgtcctttcatccactgaaagcctgaacaaaagacctcaacacacaagaaatgtgagggaaggagatgttacccaaaaggttcagaaatcaaagtgggaggccgggcgcagtggctcatgcctgtaatcccagcactttgggaggccaaggcgagtggatcacctgaagtcaggagttcgagaccagcctggccaacatggtgaaaccccgtctctactaaaaatacaaaaattagctgggcatgatggcaggcacctgtaatcccagctactcgggaggctgaggcaggagaatcacttgaatccaggatgtaaaggttgcagtgtgctgagatcacgccactgcactccagcctgggcgacaaagctagactctgtctcaacgacgacaacaaaaaagaaatcaaaatgggccaaggaagaagtctcgctttgaccaggtcccatggcctctgctgtgcctcgtcccagcatctgcggtgacacaggagagagtgttgacaaggatgtgctgtccgggaatctccctttatccagtgacagctccattcatctcaccgagctttgcccagagctctgggctggcttcactctggctctgagtccctgtgagccacagggtacagtccacttgcaacagtaaacctgcgccagccagctggggctggagagaaggaagggctgggatggcagccagcccagccaggcagcgtgcagagccagcagctaggggaggccacggaggcccagggtcttggggcagccccactgcgccccctggcggctgaaggaagctcctgggcgcgtctggacctggaccaccagctgaccttctgcacagttaaagagtagctgtgacctggctttcatatgcagaaataaataaataaataaataaataaatagagtagccaggaggagtagccaggatgagggccctgaccagggctccttacatattgtgtctcaccgcacccctagcaggcggatgcaggggcgccctgctctcatggcagggaaagctgagctgcacctgcagaaggttgggggaaggattaaccccctccaaccccccccggtacagaagagctcctctccagccccgtggccctcagccctcaggcattgtatgttctggccaggagtcctggttgtacactggccgacctagagcttcaattttcccagtcctagcctagcctggtgtaagctcagtgaaggcagcagttttaacagtgctaactgcacagcggcgctctttcttaataataacaagaaggacagctgggggtgggtgtgtactgggagtggccacgacctctgagcacactgtctgaaaacaccacattttcaacagtgtttttggttgtttcgcttttttttgagacagagtctcactctgtcacccaggctggagtgcaatggagtgcaatggtgcgatctctgctcgctgcaaccgctgcttcccgggttcaggtgattctcgtgcctcagactcctaagtagctggggattacaggtgtgcgccaccacacccagctaatttttgtatttttagtagagacggggtttcaccatgttggccaggctggtttcaaacttctgacctcaggtgacccgcccacctcagcctcccaaagtgctgggattacaggcgtgagccactgtgcccgtccttcagcagtttttaaggtgatctgttggcagttaagacttagacttttttttttaaagacgctttaaaaaaaaaaaagacaccttttcaacaaacggtactgggacaactggatatccacatgcaaccttatataaaaatgaactcaaatggctcatagacctaaatgaaagacctaaaactattagactcttagaaggaattaacaggtgcaaatcttttggagcttggattaggcaatggtttcttaaatacaataccaaaagcacagcagcaacaacaaaatagacaaagtggacctcatcagaagtaaacactcttgtgcatcaaaggacactattggctgggcatggtggctcacgcctgtaatcctagcaccttgggaggccaaggcaggaggatggcttgcgctcaagctgggctcaagaccagcctgggcaacatagtgagacctcatctctacaaaaaaattttgaaaaattagctggatgtggtggcgtgcatctctagtcccagctacttggggggctgagtgaggggatcacttgagcccaggagtttgaggttgcagtgagctatgactgttccactgtactccagcctgggtgacaaagcaagaacctggctcaaaaaaataaataaataaaagtaaataaaaagttatataaggcactatcaagaaagtgaaaagacaacctacagaatgggagaaaatgtttgtaaatcatgtaactatcagttctatcagaattctacaactcaacaaaaaaacacaagcaactcaattcaaaaatgggcaaagggctgggtgcggtggctcatgcctataaccccagtagtttgggaggccaaggtgggcagatcacctgaggtcaggagttcttgaccagcctagacaacatagtgaaagcccatctctactaaaaatacaaaaaattagctgggcgtggtggtgggtgcctgtaatcccagctactcgggaggctgaggcaggagaattgcttgagcccaggaggtggaggttgcagtgagccgagatcgtgccactgcgctccagcctgggtgacagagtaagaatctgtctcaaaaaaaaaaaaaaaaaaaaagcgaaggaggattgcttgaacctaggaatttgagaccagcctgggcaacattgtgagaccctcgactccacaaaaaaaaaaaaaaaaaaaaaaaaaattagctgagtgtagtggtacatgcctgtagtcccagctacttgggaggctgaggtgggagatcaaggctgcagtgagctacaagtgcgccaccgcactccagcctgggcaacagagtgagaccctgtctcaaaaaaaaaaaaaaagtacttgaatagtcatatctccaagattacaagttgatggccagacacagtggctcgcactttgggagactgagattggaggattgcttgagctcaggagtttgagaccagcctgggcaacatggcaaaaccccgtctctaccaaaaaatacaaaaaaattagttgggcatggtggcgctcacctggagtctcagttacttgaggggctgaggcgggaggattgcttgagcccaggaagtcaaggctttggtgagccctgatcaagccactgcactccagcctgggtgacagagagaaactctgtctcagaaacaagagcaacaaaaacaaattgacagtaagcacatgaaaagatgttcaacatcattagccattcgagaaatgtaaatcaaacccacaatgagataccccttcacaaccattaggatggaatttaaaaacacaaaaaacggctgggcgcagtggctcatgcctgtaatcccagcactttgggaggccaaggcaggcggatcacctgaggtcaggagttcaagaacagcctggccaacatggtgaaacccagtctttactaaaaatacaaaaattagctgggcatggtggcacacgcctgtactcccagctactcgggaggctgaggcaggagaattgattgatcccaggaggcggagattgcagtgagccgagatcgcgtcactgcactccagcctgggtgacagcgcaagactctgtctaaaaaaaacaaaaaacaaaaaacccagaaaataaccattgttggtgaggatgtggaaactcggactccttgaaccctgctggtggaaaagtaacatggtacagccattgtggaaaacagttcagcagcttctcaaaaactgaaacatagagttgccatatacccagcaattccacacccaggtgtagacccgtaagaactgaaaccataagttcacacagaaatttatacacaaatgttcagaggagccttattcataacagccctcaaatgaaaacaacacagatgtccataaaactgaatgggggcaatgcacccgtaatcccacctactctggaggctgaggcctgaggatgcctttagcccaggaattcgaggctgcagtgagctatgattatcactgcactccagcctgggtgacagagtgaaactccatctcaaaaaaaaagacagatcatgccatctcaaaaagaaagaaagaaagaaagaaagaaagaaagaaagaaagaaaaccacaaaacttctctcatttctttcttttttttaattttcttttttatttttgaggcagagtctctgtcacccaggctggatttcagtggtaagcatagctctctgcagcctcgaactcctgggctcaaggcatcctccagcctcagcctcctaaagtgttgggattacaggcgtgagccatcatgcctggcctcctcttcatcctgagcaccaaaacgtcagaactcagaggtcttgccggtaggttgctgtgtgccttatgtgagggacattaaaaccacatggtgtggaccatggggcttattcatgcctggggcacctgctgtgtaccaggcacctttcttcctgcaggattcactacagtcagcaaaataaagtctaatggagcttacagtgtaattaaggaagaagaaataaaaagcagatatataacatttcaggtgatgttaagtaccttgcagaaaataaagcagggtacggggtagagcattggccagggaagggctggggtgtatgtatgtgcatttggggagatggtagccccccttggccttgaaagtgtttctcaaagcctcaaagccccagcatgctaatagtctggaaacccattaaccagcagacacacttagacactgcagaggtcaagacctccccagcactgtggacagagccacagtcaaagccaaacagctccagggtctcctttttaataaggtaccacttcacggccgggcgctgtggctcacacctgtaatcccagcactttgggaggccgaggccggccgatcacgaggtcaggagaccgagaccatcctggctaacacggtgaaaccccgtctctactaaaaaaaaaaaaaaaaaaaaaaaaaaaaaaaattagctggttgcggtggtgggcgcctgtagtcccagctactcgggaggctgaggcaggagaatggcgtgaacccgggaggcggagcttgcagtgagccgagatcgcgccactgcagtccagcgagactccttctcaaaaagaaaaagaaaaaaaaaaaggtaccacttcattcctactaggatggccataattgacacatgcaaaatagcaagtaattagaatgcgaggaaactggaacccgctattttactcgtgggaatggaaaacggtgcagccgctgcggaaagcaggttggtggttcctcaaagtgttaaacatagaatccccacaagacccaacaattctactcataggtattgaccctgaagaatcgaaagcaggggccaggtgcggtggctcacgcctgtaatcccggcgccttgggaggccgaggcgggaggatcccttgagcccaggagtttgagaccagcctgggcaacatagggagaccctgcctctataaaatattaaaaaattagccaggtgatcgcgccactgaactctagcctgggcgacagggcgagactccatctcaaaaagaaagaaaaaagttaaaatgataaatcttgttttctttattttacaacaattaagaaaaaaggacattgtcttgcacagtaacctttccataacagcatcaggaacctggcggaaggctgagacggtggcggagctgtggtccttccttaaaaaggtgcagtcatggtggcagtggggtggccaagagacagcctggaggtaactgtcttcagttagcgccagtctcagaagtggtggctgtgcacaagtgacgatggagggtttttaattgctcctgaattaatgtgcttacttctcacccctggggtgcctgggtttaattactgtcttaggtcacatatgcaaatgagtctgctatcactcctggtcccagtggacagcagcccggattacccagcccttgcacattgcagcaagaccagcgggaagaagctgcagtgcccctggccaggatggcctgttagagctgaatccgatgaaggtgatgtgatgcctgccccctgtgccgggtctagatgaactgaagagttcaaggttgccaggggagtccttgatccttaaagcactgggagaccagctgtcaatggtggagaaaccccggaagccctgaattcatgagtacctgggcatggaggagtttcacacaaaaggaaagaactgggaagccagcaacctgcagaagaggccatggacaaggggtgcagacccaaaaaccttgggggctgggcaggcagggaagagaagcaggcaggagggacctcagctgcctaacggggtggccaactgctgccttctgggaatgcagtgttgtccattttccaatccctcagaatccagaaactagggccaggcacggtggcttatgcctgtaatctctgtactttgggaggcaggaggattgcgtaaacccaggagttggagaccagcctgggtaatacagcaagaccttgtctctaaaaaaaaaagttttaaaattagccaggcatcggctgggcaagatggctcatgcctgtaatcccagcactttgggaggccgaggcgggcggatcacgaggtcaggagtttgagacaagcctggccaacatggcgaaaccctgtctctactaaaaatacaaaaattagccgggtatgatggcaggcacctgtaatcccaggtactcaggaggctgaggcaggagaatcacttcaacctgggaggtggaggttgcagtgagtcaagatcgtgccattgcactccagcctgggtgacatgagcaagactcttgtctcaaaaaaataaaacaaaataaaataaaataagccaggcatggtggcatgtgcctgtagtcacagctactcaaaagactgaggtgggaggatcgcttgagcccaggaggcggaagatgcagtgagtcctgatcacaccaatgcactcagtctggctgacacagtaaaaaaaaaaaaaaaccccagaaattgacgattttacatgaagtcagtttttttagatattggcaattaattaaaataaaacacacacacagagtaggctgcctggggaagggatggggcggggattgagtggcaagggacccaaggaacttttggaagtgctggaaatattcccgttacccaggtgtatttgttaaaatatgtcacactgatacggttaggctttgtgtccacacccaaatctcatcttgaattgtaatccccataattcccataatccccacacgtcaagggagagaccagatagaggtaattgaatcatggagccggtttcccccatgctgttcttgtgagagtgagttctcatgagatctgacggttttaattttatttttatttgttattattgtttttgagatggagtcttgctgtgtcacccaggctggagtgcaatggcacgatctcggctcacagcaacctccgcctccctggttaaagcaattctcctgcctcagccacccgagtagctgggattagaggcgcctgtgccaccacgcctggctaactttttgtatttttagtagagatggggtttcaccatgttggtcaggctggtcttgaattcctgatctcaggtgatctgcccgccttggcctcccaaagtgctggaattacaggcgtgagccaccgcgcccagcgagatctgacagttttataagaggctcttccctctttgcttggcacttctccttcctgccgccatgtgaagaaggtgcctgtgccctttgccttctgtcatgattataagtttcctgaggcctccccagccatgctcaactgtgagtcaattaaacttctttcctttataagttacccagtcttgggcagttctttatagcagtatgaaaacagactaatacacacaccatacgctccaaatggacatctgttattgaatgtcaatgatacctcaataaagttagctaaatagaaaagggaattgggaatgggaaactcacagaagcccaaggagaagtgttgggacctagaatcaatttacatttttttttttgagtaagggtctcactgtatcgcccgggctggagtgcagtggcacaatctcggctcactgcaacctccacttcccaggttcgagtaattctcgtgcctcagcctcctaagtagctgggattacaggtgcacaccaccacgcccatctaatttttatatttttagtaaagacggggtttcgccatgttggccaggctggtctggaattcctggcctcaagtgatccacccacctcagcctcccaaagtgctgggattacaggcctaaacaccttcctcccctttccctatgtcctgcacctcttcttacctaagtgtatcggcacctgattgtccagctgaatcattttattccgcgtgggagcccgagttggtgtgatcgtttatagtactatgtgtgctcacccttgagtggttgtactattgtgttattagcccccttttatggatggaggaactgacacacagttgttgggggaaaagccagaatccagagtcacacagcctggctctgtgttctccgacactgctgcctgcactgcggctgctatcggggagcaggtgctgggaacctgctgcttaggggacagctagtgtggctgcatctacaggccctagtatggaacacattgctaagaagcaggctcctagcacagccccgtggactgtgttggtggcattcagaggccaccttcctgcctcggctgcattcactaaaatgaaaattaccaggactttgtgcttttcagggaaagcctggctgcctcccactgtgtccttgaaagcttggcgttccagccctgcctggttatcaccacctatgaaatccatttacttgttacaccagcggttctcaagtctggctgcacactggagtcagctttaaaaaatactgaagctttgggttccaccctgaggttctgaattaattgacctggggtgagtcctgatatagaagcttcagaagcctcccaggtgattctaatgtggccaagtttcggaatcattgctttaaactttcaacttacctttttttttgaagacagagtctcggtttgctgctcaggctgcagtgatcacagctcacaactcctgggctcaagtgatctctccaccgcagcctcctgagtagctgggactacagggaccatgtcaccatgcccagctaattttttactatttttttttttcagctgggtgcagtggctcacgcatgtaatcccagcactttgggagaccaaggagggcaggtcacctgaggtcgggagttcaagaccagcctggccaacatggtgaaaccctgtctctactaaaattacaaaaattagctgggagcggtggtacatgccagtaatcccagctactctggaggctgaggcacgggaatcacttgaatccaggaggtggaggttgcagtgagccaagatcatgccactgcactccagcctggatgacagagtgagatgctgtctcagaaaaaaccaaaccaaaccatatatatagttttttttcagcccaggctaaccccagacctatcttaaatgtttcactgaggatggctttctcgaaacttattcatgttgcctgtcctgcttcagacaggctccccaggaaaggacccagaggtctgcacttctgctgggctcacatctgccagtcaatgtcaggaatgtgctttgtttctgctgggtcaggaagtttagtcacagttggctttccttatttggggcctctgtgtctccagggtcaatgtggtaaaccgctcagtccagcctgcaatggaaatggctccaaccccagcccagcagcttcctttcagggtggtgtggactggaagggatcctatctacctgtgtttgccatctaacctcaagagtgataaatgaggttcacctcacagtcaggaaatgttgacattaaaccaaactgaaaaatactcatgctaacttgctgccttcgagttgagacaaacaagatgtagaacatgccagtaactgtcagacccaagttccatgatttacttccctccaggatcagttctcagacactggtcatgagaacctggaaagggttagtatctggggttttatgtgggatgattgcattaagttaggcaggagaatgactttgttactgtcattatctggagattaagtatagtttaaggaaatgcatatgggtgtagagctgacaaggggggaaccatgatggctttgatatatcaacttgacgattccccagttattcaatcaaatactaatctaggtattactgtgaagctattttgcagcggtaattaaagctactaataagtagacgttaaggaattatcctaattactctagatctgcccaactccataagcgaggtgtttttttgttttttgagagtcttcctccatcacccaggctggagtgcagtggcgtgatctcagctcactgcaaccttcacctcctgggttcaagcaattctcctgtctcagcctcctgagtagctatgaccacaggcacacgccaccactcccggctaattttttggtatttttagtagagactgggtttcgccatctgggccaggctggtcacaaactcctgacctcaggtgatccacccacctcagcttcctaaagtgctgagattacaggtgcaagccactgcacccagctagtgaggtggtcttaaaaaccgaggtttcaagacagaaatttcacctgtgaaatgacagcttcacccaagcccctggagttccagcctgctgctggccattgtcccttcccactggcagccctgtgaatttcagacgtgcttatccaggccccacaatcagaggccagttattacttttgagaaaggctctcactgtgtcacccagactggagtgcagtggtgcgattttggcttatggcagccttgacctctggggctcaagcaatcctctggcctcagcctgctgagtagctgggaccatagctacgccgacatgcttggctaactttacctctccttattggttctgcttctcaggttaaatcctgacattaacaatgaacaagaatgtccacaagagggctccccagctccctgactgtgcattggaacgcgcaactcaagatacttcttttagggagaaaaatcaagtaatagaatatgggacctcttaaggtgcagatggcaaccacagtttctcatctctttattttttttgagacggagtctcactcttgcccagggtgaagtgcagtggtgtgatcttggctcactgcaacctccacgtcctgggttcaaacgattctcatgcctcagcctcctgagcagctggggttacaggcgcatgccaccaagcccagctaattttttattttttttcgagatggagtcttgcgctgtcacccaggctggagtgcagtggcgcaatcttggctcactgcaacctccgcctcctgggttcaagtgattctcctgcctcagcctcctgagtagctgggactacaggtgcctgccaccacgcctggctaatttttgtatttttagtagagatggggtttcaacatattggccaggctggtctcaaactcctgaccttgtaatccaccagcctcagcctcccaaagtgctgggattagaggcatgagccaccgcacccggcctcatttttgtatttttagtacaggcggggttttgccatattggccaggctggtcttgaacttctgacctcagatgatccgcctgccctggcctcccaaagtgctgggattataggcatgagccactacaactcgcttcatctctcactttttaataaacgtattcttcacaccccgtgttcagcattaccctagaacagtacttgctgcaacattcaagttttccatctgcttaatccaatgcagtgggcagcagctacaaatggcagctaccggacacatgaaacctgaagcttgagaaaccgaggagtggaattcattcatttaaatcgggtcctgaggtcttcttgatgcccttctgccttcctgcccagagctcccatttaatccttctttcacctgctttccccaggaagagaccctgggaagagaacatctcttcccaggatggtcacctttaccctgaagtccttctggtctgaatatggctgtgtaacctagtagctaccatccttaagattatctacaaataggcctgcatttgaagtttcttccaaacaaggtgtccaaacaaagtctcgctctgccttccagcttagactctgttttgaccccactatcctggagggaccgtgtatgtctcttctcttgcctttgcctctggttcccttcccaaggacccaggaaaatgaccccaatggatcctcatccttttctgttacgacaccaaaccttggttctcaaaggccgacaccctttcgccaggggcccctgaacactaaggacagacccagattgttccagacatacacaggcacacggagtattctcatgggtcactgaggctttttattttgagcacaaaaccaccggggatctagcctgtggccaccccggagatgacacgaggctcacatgactctagacacttggtggaaagtgaggcgagaaaaacaatgacttgggccaattacacgactgcaaagctagagctgccaacagggctccagggagcttggcttctgtagaagttctaaggaagcggtacgaactccacggcggtggggcgctaactagcagggacccctgcaagtgttggtcgggggcctcgagctgcctgagctgacacgaggggaggggtctgtgtagccaacaggtgaccgaagggcttgcctgcccacagcttacttggccaaggggtttctgaagttcctgccggcaaacttagccttgctgcccagctcctcttcaattcttgggaaggagaaaggtaaagagatggggaggaaaaaagaaaagtcagacctcaagttttaagttttcccatcctagatgtggtcaaagacacagccccactcctgggaagttgagaacacagaactctccagtttgtccaccttctttaaaccctctaaacttgtgcttctctgagaagccagatatagaaaagtatttagttctcctcatcccaactcaccatgctaggtgccctccacccaccgccccttctcttcctctcctctccccgtcagtgttgcagaggagcaaagtaaaatgtcagcattgccatttcttggaatataaaaattctaatgcttttgttttttaaaaaatattgaagggacaacaaataaatggcatggggagaaaaggagagtgaccttattaaaagacaaaatgtgtgagctgtttggatcttgatgttaaaaaaaaaaaaaaaaaaaaaggccaacacattttggggccaggcacagtgggaggatcacccgaggtcagcttgaccaatatggtgaaaccccgtctctattaaaaatacaaaacaattagccaggcatggtggtgggcacctgtaatcccagctactcgggaggctcagacaggagaattgcttgaatctgggaggcagaggttgcagtgagccaagactgagccactgcactccagcctgggcgacagagtgagatccctctcaaaaaaataaaaataaaattccccagcaaaaaaagaatgggagtttgaggctgcagtgagctatgactgccccactgcactccagcctgagtgacatggcaagaccctgtctcaaacaaacaaaacaacaaaaaagccctgcgtctactgttcacctgcttttttgtatatgtttgaaaatttccaggatacagtttgaatgaaggggtaatatgggagaacttagcggggtggcgggcggggggacaagtctcctggtgttcaggggcttcccaaggacacagacaggaaagggagaccagaacagccccacagcgctcacaagtggaaacccagccatgtgcccttcggccttttcttcctccctcccagccctggctccacatccacaaacaggggttaaatgcgctgaaacagatcatatgaaggagctctctgaaagctctaagaaagtcatgcatcagctgtcaaagggggtcccattctttctcaccagaagagggcagcactgtgtggaacaggctcctgcctctggtggcgctgcagtgggtgggtagggggagtctaggcctaactctgtcctgacctaagcctgctcagggcctggctgtctgcactgtgcacctgcacctgtacatgttcccagagccaggagctcctgggggagggcagtgcctacactgagtgcaggcccccacctagtgaaccacaggccccttgttctcaggagccctccttacctgaggagctggttgtacttggccaagcgctcagatcggcaaggggcaccagtcttgatctaggagaaaagaaaggccatttgcttacagcggacaagctttgcaggcatttctggcagggagagggtgtggtgtcagagagagaatttctagaggatctgatgctaggaaagtgggggccacaacatacaggcagggcgctcatgcccccattctgttcagcctcagaaacaagagcactgactcaggggacatgagcaaaacggggacagacatggagcctcactggttttgggtcttcctaggaagttgaggtcagagaagaaaggaggagacgctcattcttacctgcccagtgcacagccccacaaccaggtcagcgatgaaggtatcttcagtctcccccgaacgatgagacaccatgacgccccaaccattggcctgggccagcttgcacctggaagccaaggaacaacccagatggcatgatcccattttctggttccataacccccaatgccattacccctcggtgccagcaggaaagcagtggaggggctgttaatggctaaagccctccatgcctgggctttgtcaagagcacagaggagaaccctcaccctcccctgaactcttccacccccaggaccttcttagccctcctgtcatagttgaaacactgggttcagcctcccttgatgggagaaagattagtgttctctgacagagctcttcacagaatacaactacttgctatgttgcccaggctggtcttgagctcccgagctcaagtgatcctcctgccttggcctcccaaaatgttgggattacaggccccaattgtttaatttaaaaggctcctgagttcaaacacaaaacctgttaaaattccagcgagtcctacattctggccagcaggattccccatcaccagaacaaaagggcccttttctgattcacaagccgtagctgcgggaaagctgctcgcctgggaagacacttacgcctgaagagactcggtcacggagccaatctggttgactttgagcaggaggcagttgcaggacttctcgttcacggccttggcgatcctctttgggttggtcactgtgagatcatcccccactacctggattcctgcactggctgtgaacttctgccaagctccccagtcatcctggtcaaagggatcttcgatagacaccactaaggaaaggagggacacgcttcatcagtgtgatcctcccagtgtgctccaccgcaatgcccagccttgcttcccccttgacttgctgctcgcctggcctcacaatgcccaaaagcataggatggggacagctccccaactgatccttgaaacaatgtgccccagcctactcctgcagcaggggacaaaagtcacccacaatcctgggtatctatagatctaaaacaaaaaaaatctcactctgtcacccaggcttgagtgcaggggtgcaatcatagctaagtgcagctgtgaaatcctgggatcaaatgatcctcccacctcagcttcctgagtcgctgggactataggggtatgccaacctacccagctacttattttattttatttttttgtagcaatggagtcttgctatgttccctaggctgatctcaaactcctgggctcaagtgatgccgtttcagcctctccaagtgctaggattccaggcgtgagccaccatatgcccagcctcaaaaattttgtttaagacctgtaagaagaggacactttttgtctagggttgtttgagtttagtgccactgaaaatcagaatggagccacagactcagaagtgagaagacctgagtttgggtcttggctcaaccttgaccaagttatttagggtagtggttaaacacacagactctggagtcagatttcctggtctgaattcttgccccaccatttgctgtgtgctctcgggcagattattcagccagccatcagcttcctctcctgtagaaaggtggtcacagtctctatcctgtgcacacacacagcctaaaatgaatattcccagctcacaggaagcatgatacatctcagtaccaagtggctgttctgattctgaaggcttggttccctcacctgtctaatggagcacagactgcctctgctcctgactgtgaacaacttattatgcaatgtcgctgctggcacccgagctccttagctacacaagaacctctgtgaagccctgtgtatgcacaactgggggcaaacccagtggtgaatcccctacgggagctggaagttcagacactccctccccatcccctccttgcagccatcaccagccagccagatgctccagctgccctgctgcaggtcagtggcaggaaagggagatggcactcggggaacactcacctgggtagtccttgatgaaggacttgtacaggtcagccagctggtcaggcgagatgtacctgctggggtcatcgggagacttgaagtccaggtcatacttcccagacctgaagaactcggaggccgctacgtccatgccgatgaccaccttatcagtgtagccagctttcccaatagcagtcttcagcagctccaggcctgggaagagatggtgacaacaggtttggaaaacaggtaggtacagagaaaacttcccttcaacagctgctacacagggactgtaacacaaagatcaacaggtgttcaggccccaaccagtagttctgacatcagttactttttttctgctttggggcaagaaaccatgggtcagagttcttggtgcatacaaaatgggaaattcagctctctttccaagaaagcagcccttctcactgacaaatgctcccaaatttagtgcccaggaacagctgtcctggccaagatacagttacagtaagcagctgagatcagctgtcccaaggcacaggccttaaatagagcagaagcggggtccaagagaaagcccagtggaggcagcccgggatggcaggatcctcccgccaggctgtgccgttgagagctcaggctcagggtctgctgtccatggctaagctgccctgccagcaggacagacggacagacacttggctccccaaactagtaggtatcacttgagcccaggaggcggaagttgtagtgagccgagattgcgccactgcactccagcctgggcgacagagactccatctcaaaaaaaaaaaaaaaaagaaaaaaataagtaaaataaaatgaagctccccttttcctccttaaaaccgtttgaagggtcttgatctttacaaactacaggtggaaagaatagatttccacagtggcaggtgtggacgaccccccaacagagggagctggcgctgcagggctgggtgggggggcggttccctagcgcctttaccttctttattctccaggatgttgggagcaaacccgccttcatcccccacattggtggcatctttcccatatttctccttgatgacattcttcaggttgtggtaaacctctgctccaatgcgcatggcttccctgaagtttgctgcaccgactgggaggatcatgaactcctgcatggccagcttgttgccagcatgagaaccgccattgatgacattgaacgcctggggagagcagagcagagaagcatggcactgggtccagagagccccacagggcagtaagcccctctggtcctaccatcccaatctagctcacagatgagcccaagacttgcttcttgaggagcaccagaggggccagggtgctgtgaaatgctcaccaggtctctgactcatgtttttagagacagggtttcactatactggtcttgcctagaggctggtctcaaactcttgggtttaagtgatcctcctgcctcagcctcttgattagctgggactacaggtgtgcgctactgcaaccagttcacgccaggtctattttgataactgcaaattcatcatcaccaggagaaacacttgtgactatgtcaggtaatgctcacagcctagcaaggaaagtactgctgtcatttcctccccgagcctccattgcagataaaggacctggggcacaggcaagttgagttacctgctcaaggtcacacttaacaaggggcagagctgtgctgggagagtcacatgtgttaggatatcaaggcataggaggtctcgggtccccaacagcaagctgaaacccccaactccttgcttgggaagttccaataaaccactcaccgggactggcaggatgacttcagagttgccagccaagtcagcgatgtggcggtacagggggacccccttctcaacggcaccagctttgcagacggcaagggacacccccagaatggcgttcgcaccaaacttagctagaacagaagagaaccgagtggaatgaagtcatttctgattcaccagcttttctcctgctgtactgccctgagggttgtattctgcaccatctcctcccccatcacacctccatttcactgttactagaaatacaaatagcattctatgtggactcaccactgcttttcccctctaagacagagcccaactccagccaacagtaggaattgctgaattcattataaggagcaaagctcttctgagtaaccaaactgacaggctattgtcacctggttttgcacctgatattcaaaaaaaatttttttttttctttttttttgagacagagtctcactctattgcccaggctgcagtgcagcggcaggatcttggcttactgcaagctccgcccgggaccattctcctgctgggactacaggcgcccaccaccaggcctggctaattttttgtattttttagtggagacggggtttcaccacgttggccaggatggtctcgatctcctgacctcgtgatccacctgcctcagcctcctaaagtgttgggattacaggcgtgagccaccgcacctggccaaaagtgtgatttcttaagagtaaagcaaagaaatgggaagagaccacaggctcatgtagctcatcactaagatcatgggcctcttcctgaaaggttttaaaatcttcaggagacttcatgatcttccccagtaaagacgccacctcaggccactcacatttattttctgttccatccatctcgatcatcagtttgtcaatcttctcttgttctgtgacgttcagtttctacgagggagaggggagaatgaggggttggggccactcttatctgcatagcctttgctcccctaccatggaatctgactttggaactgtgtaatatcaaaatcaattctgtgatgtttgttttataagcaaaaaaagtggaggacaaaaatcagtggggagacaaaaaactgccttctgcttgctttgatggttatcaggcattcacccaacaatgcaacagagatggcactctcagacaatgcttttgtaacaaaaggttaatagtctacccagggagcccaaagtgactttacacccaagagaactgtcaggtatgtgctatgtagaccactgctacccaggaacatggctttcataggcaataaataagcaaagctcactgttcactcaagcaggctgagcccttgaaaggcaggctctgctgctcactcttggctaactgcaaagatggcaaatcttcatcctctgatgggaggcatgatttctgcaggtagtccgaaatcatttagcaaagcgtctaatgatggatcaaaatgaatttttgatgagactataaagtaacaaaactgacgtactgagaactggctcaaagtaatccaataaaaatcagtattactttttaattttttaatttttattttttaagacagagtctcattctgttgccaaggcaggaatgcagtgtcacgatctcagctcactgcaacctccacctcgtgggctcaaatgatcctccaaactcagctgggactataggcatgcaccatcatgcctggctaatttttatattttttttttatagagatgggctttgccatgttgcccaggctggtctcaaactcctggcctcaagggatctgcccacctcagcctcctaaagtcctcctaaagtgttggaattacaggcgttagccactgcacccagccaaaaatcagcattccattttaaactaatatattaataacaaggcattatttttatctatgatgtgcttgatataaaaaaatatgcaaagaaaatcaactctgatcccatcatgctgtatgagcaatttggtgtctttcacagctttgtcaaggcatcactgcaacaggcaggcagttacccaagcacacagcttcagaggtcaattctcactaacagtttggtatgtttctctagggggttaaaaaaaagtcaggggatcctgctcatcgtgtgagtcacactatgcaggggtatgaagggacagagaacaaggtatgtgtggaggtgtccgggagactggcagggggtggtgcagacagaacggtaacaagacattttgtctgggggctggtcgggcagggagtaattacagagtgccacaaaagccaggcctaaaccaacgagtcagggacagagacaacaaaggaactcctccttttccctcgtgtacagaatgaattcatggaggagagggactagattcaagaatagacggaggctgtggctgggcttggactgggcctagagagctttgttatttttattttttgagacagagtctcactctgttgcccaggctggagtgcagtggcacaatctctgctcactgcaacctctgcctcccagcttcaagcgattctcatgtctcagactcccaagtagctgggactacaggcgtgcaccaccatgcccggccaatttttgtacttttagtagagatagggtttcaccatgttggctagactggtctccaactcctgacctcaagtgatccacacacctcagcttcccaaagtgctgggattacaggtgtgagccactgcacctggcccggagtgtttttagacaggggttttcaaaccagtcccatctgatgagcgccacaggaattacggagggacgggccgaagggagggtaaatgagataaaacctgcagagtcgggtgggttgctgggtccccagccctacttcacctccagcagctcttttatgtttgacatactgagatttccagattttacttaacaggaactccactgttaaagtcagtagaattatagtaaataattccaaagttcatgagaaattagtcaccatggacactaccacaaacacccctgagagccactcttaaaatctggatcttaatttcttcaaaggtccagagagttgcaggggggaagaaacctcagggctcgaagtgtctcattcttctgatgcaattccatctgctcccaaaagtggggtgaggcagcgggcaggttagaattatgtcatgcatggattgttctcgtgcgtgacagggaatccaataggcttctacagctctcagaataagctcttccataaacaggaaagcccctgggcctgggagacgctctggtggcattagacacattagttatcaggaggcaggtcctaccttgctaaccagggcaggcgcaatagttttattgatgtgctcaacagcctttgagacacctggaaggaacaatcaaatcaaattactgacattaactttaaaacaggcttgagcagcattgttagagagaaccactgttgaggccgacgcggaagcccaccaagggaccttctgtgggacctcttccccctctcccctttccccccagaatcggaggactttccggcccagtctgagtgctcctacctaggaccccagagggttagagccacacaaaacagcagctggctcagaacgatctgactggaggttagtttgcaagaccatgcactggaaacgccaactgcagactaaaggctgttcaatcagttacctgagtgcacagggctggtgccaggaactcattaatatacttaatgggtctggagacgcctgcccagcagaggatgaagaaggaaaaatgagagagactcagaagagaaccggtgattaaggactgcgagtgagagacagtgagggggcaggaaagcagaggagagcatttcaggggccatgcgttcaatcttccacaaatgcttacttactgagcactcattaccatcaaggcacagcatcatcctgctccggctaagtccccacgtacgccattaaacaacggtcaaatggtaacatgttcgtgtgtgtagagtgcttcttacagcattaaagcgggactgaacacccagcaccaccactgcgacaccagcccagtgtttcacaacctgatttcatcattgtcccctccctgcagcctttttggagttttccgggtgccccactgagaatgcgtgatctagccctatgtgcttttctgtaatttggccacatgttctatctctagaaaggtcaatgttgcacacacactaagtcaatttgaatacagccagaggctagctctgccacagagcagggctcctatgagtcagtcaacaggaaaatcacactaaatgacacacctgcagctcaccattcagggcaggtcattggttagaccttccctggatcctttctagcccgtgaagaggctgatgatctctggagggcccacagaaccctcctgggagatggggaaacttttctttagttaacaggccctgttctcatgcttgggttcctgtcctaaccgtgaaggagtatttcgcagattgggaacaaactgcaatagaagcaagcattggaactctcgacccagagcatgcaggctcgggaaccccggaatccacacaccaactttcctgtccacaaggtggtgcactgcttccatcaacatcatgggtcacagcaggtttacctgccataaacctgcaagtgcaagtgccacccagagaggacaggactgggcaaggccaggaatggggctggaagcagggaggccatgggctgtgggttctaaggcttacccttccccatatagcgagtcttatcattgtcccggagctctagggcctcatagataccagttgaagcaccactgggcacagcagctctgaagagacctggatgagaggaaaaaagatgtagtagcaattcagaaatccagttccagcacaatcccaagtcccctcccgcccacagatgcatttgtcattagggagctgtttcttcctcctaccagctgtgtgaattaaacgctctgggctgttcttcatgcctttcacatgtttatgatcctgtactgcagaacttactgcaaagatgactaattcctctagcagaaagaaagtgttctacagcagagcctacatgccacctggaggtcttgttaaaatgtagattctgacccaggcaaatatgcatccctcacaagctcgcattggtgccctgtggattactccagcagcactgcccaagagaaatccaatgcgagccacacagggcattgaagacgttctggtactttttttttcttttgagacagaatctcgctctatcccccaggctagagtgtatggcgtgatcttggctcactgcaatctccacctcctgggttcaagcgattctcctgcatcaggctccccagcaactgggactacagcagcctgccaccacgcccggctagtttttttatttttagtaaagatggggtttcaccatgttggccaggctggtcttgaactcctgatctcaggtgatctgcccacctcggcctcccaaaatgctgggattacaggcatgagccaccatgcccagacaggtactatattgatgttaagcataaaattagggtaatttaactggctcaggaggagtatctagctcatttgtttcagtttggacaatgctaaatgctattttaggggttctatgcccaactggaaactggcaaacaggatggatgtggggggaaggaataaagataataaaatgcgcagtttaataaatgtaagaactgaaccaagtaatcttgcagatactgaaaccagccatctggtgaaacctatacctgtaacaagggcaatctttggtggaggcaaaagaacagatggtgtcaaggaagatgttgcagagaaaccaacaagatatttctagcaaaggacccagcagtgttccctgctgcactgcagtgtgcgctatcaacaggtcatacttccttcttgaaagctgccctggctccctacatatccaccctacactggatcaggcaaagacaagatgaaaacaagaggcttggagtctacagacttttggtgatgataacgtgttcacgcatgttgaccactctagtggggatgctgacaatgggggggctgcgcatgtgcagaggcagtgggtactcatgggtttatgtacctctgcaccttccgcctgcttctgctgtgaacctaaaactgctctaaaaaagttgatgagacagggagagagagagatgaaaggttctgagcaagtccatcatttcatgttttttgaaaaggattaagacacacaagagaaagttccattcatttcaatttcaaaatgtccaactcccaacaatcttctagcatctggggtcttttgttgcttaaagttcattaatatccaagtagaaagttccacccattgactaagcaaaccactcttactggatgaagggaattcttggcatcctgtgagaaccctcagggttccccataaagccagtgagaaaccccacagtgcttgagagcccacacagcaagcagccaactcaggcattcttttgcccaacgaagtcaggcctcaaggatcctttcttcctgagggggaggggaggtgcaaggggaagggaagggctggggttccactgctaggcctgtgactcacagatggtgactcagctccgactggcagttctctgtgagtttagcaccgctgagtgattctgcctgaagctcctttgccaacctcacccactctgtccatcgcgccatgtgctggaggtaacacagagctacaaaggcactggattttcttcttaaaggaaggagtttcacaattctctaatttttcataagaaaactcctcctatagggattgacagccaggtaaaaatgagagcctccagactattccaaagcctacaggtaaaaactgtccttgatccttgctgaagactgatttctagtcacagagataaaggtgctatattcacacctgctatccctccccttatcaagagataccatcctatcacactgtatcctgcatttggtcacagcaagctgtcagccaacaactagtgatgggcccctttagggacaaggtcttgtggtatcaccttacttccttacttcactgacttaggagccaacttatgtggttttaagccaaggagctggcaggatcaggcggggtggctcacacctataatgccggcactttgggaggcagaggcgggcagatcacctgagtgaggtcaggagttcgagaccagcctgaccaatatggtgaaacccccgtctctcccaaaaatgcaaaaattagccaggtgtggtggtgcacacctgtagtcccagctacttgggaggctgagacagaagaattgcttgaacctgggaggcagaggttgcagtaagctgaaatcatgccactgcactccagcctgggtgacagagcaagactccatctcaaaaaaaaaaaaaaaaaaaaaaagaaaaagaaaaagaaaaaaataagccgagaaacagcaagacactggctccatgcctaaaaattccccaaccctcacagtcaggaatcacaacctactagcatgtgcagacagaaagaaaagctttaacagattttttttttcctaaggctccagcatttgtagaaaatttttaaaatgaagcacggtggaaggaaccatggaaaccaaggaggtggcacataccttttgaggtgaagagatcaacctcaacagtgggattcccgcgagagtcaaagatctccctggcatggatcttgagaatagacatggtgaacttctgtagaagaaacacacagttcatgttttccataagccataatgctgcatttcctcactcattcaaggaatcacttccgaggttcgtggactagagagaatcagcactggactaaatactggatgtaggaaagctggctagggtggggggaaaagcctgctggaaagcagtgagaattctcctaattaagtagttagggcctagctgcggaaggccttaacctttttatgcctagtattccattactggaacgctaagggcgtgggagttacttttatccgactgctcaagtcattgccaaggtctgatttttcacaaaaaaagatttgcaacctctggcataaatgggttaaaccctagcaattgaggtcttgttctgtaagaaaaaagaaaaaaaaaaaaagagagagaaaaagcccacaaacgtgtgtgcccagggagaatcaaatccaaatagaaagatgaatgtgttgctcgacgcagagtggcccaggagctgtctgaaactggctattgtcatgagtgaacaatgagggctggcatgggaatggaaaggaaccaagaacagacatgaaggtcacaagcaaaaccacctagggccaaaaagagggtggcgggaccaggggaaaaccttgcttgtagcagaattaaaacaaaatagtgaatgaagtttggacataattcttcagattaatattcacttagtaggtatttgatcagaaattctgagtttggaagtcaggaacaatgaagtccttggaccgtgtgatcttggctactgccacttcctgggactttccaatttcacagtacttgggtcttcagtgttgttatgtcattaatgataacatctttattttattttagttacttttttaagagatggcggtctcactatgctgcccaggctgctctcaaactcctgggctcaagcgatcctcccctgccttggcctcccaaagcatgctaggatgattataggggtaagccaccaggaccagccaataatgacatctaattatttcttcccaacggggttttataatttgtaaatagaggaaagattctttgaacaccaggatacttcaagggaaggggcttcctttaacaccaccttaaaaaaaaaaatacaagaatttccagcaatgaacaacaaataccaattcctcaaagaaaaacccattcttacttttttccttggcgctctccaaagaaactaactgaacaacttatagaactgaggtgggtgagaggaacttagtgtttaaagccattatctacctgggctcccctccaacatcttctctggaatgtcctgaggtggcaagtggcaggtttttaactttcaaaattatttactgaagtcacttctgtggctttgttgtctatgtaacaatggagttttattcattagccaaaaaaaggtacttactttttactaggttccaaaaaggcaaatttgtttaaacatatttttagatttaattttgcgttttggcaaattatatacccgagtaacatttccatcactgcaaaaagttatctcaggccatttccagtcaatatccccctgccccatctccaggccaccactgtggtatactttgagtatttcagtcatacttttaaaggcaattttattagggtgcctcagtacttttgttttcattttagtgacttaagacgaaagaaagtcttggccgggcgcggtggctcacgcctgtaatcccagcactttgggaggccgaggagggtggatcacgaggtcaggagaggaggctgaggcagaagaatggtgtgaacccgggaggtggagcttgcagtgagtcgagatcgcgccactacactccagcctgggcgacagagagactccgtctcagaaaaaaaaaaaaagacaaacgtcttaggatgtgaaaataaagtgtgattttttttttattttttgagacggagtttcgctgttgtcgcccagactggagtgcaatggcgccattttggctcactgcaacctcagcctcctgtctcagcctcccgagtaggtgggattacaggcgcctgccattacgcccaggtgatttttttttttttttgagacggagtcgcgctctttcgcccaggctagagtgcagtgacacgatctcgactcactgcaggctccgcctccagagtagctgggactacaggcgcccaccaccacacccggctaattttttgtatttttagtagagatggggtttagtagagtaggatggtctcgatctcctgacctcgtgagccacccacctcggcctcccaaagtgctaggattacaggcgtgagccaccgcgcctggtcgatttttgtattttcagtagagacggggtttcaccacgttggtcaggctggtctctaactcccgacctcaggtgatcctgaggaggcccacctcggcatcccaaagtgctcggattacaggcgtgagccaccgcgcccggaccattcacagcttttttagctgcctggatggaaccccgaattagggacacggtaaatgaatggagcagtcagggcccgggtgggcctgaaaggcaagtgaagcaatggaccctaccgcccagagaagcgcacagagcaggggaacattgaacaggaagctttcttaaaatacatccttcttggcctagcgcggtggctcacgcctgtaatcccagcactttgggaggccgaggcgggcggatcacctgaggtcgggagctcaagaccagcctggccaacatggtgaaacaccgcctctactaaaacaacaacaacaacaaaaaaaaaacaaaattagccgggcgtggtggcgcatgcctgtaatcccagctactcgggaggctgaggtaggagaatcgcttgaacccaggaggccgaggttgcggtgaaccgagatccgagatcgcgcaattgcactccagcctgggcaacaatagcaaaactcaaaaaaaaaaaaaaaccaaatcagatcaggcccgatttttggtggccagccggggagccgctcttgcccaacttgggcgaggtcgcctggaggacttgccaatgatctaacggctctgctgtaggttcctcaagaggtgccttctcggagttaaatgagtcaccgcttactaggcagaagcgcgggccgcgagcgcgggcgagaggcgggggctaccggtgggggagggggccgcagcctcgtggccatctccactatcgccgccctcctccattttaggaagggcctggcctgagtggccaccgccgctaagtctgcgtctatcccaaaaaccttacacttggctacgatggaaaagcaacttccactcccaactcccgctgtgctaagcagctcgcgtgtgcagctcccgaccttccctgacagtgactcggccccgcagtcggtaatcacgtgttgatctgcactttcccctccaaagaaatcgggggcccagcacgtgcgcctggcattgcgcccccgccccgggcctcggggtgagcgggggcgccagttcccacccagggaggcggcttgcacgtgcccccgaccccgccacgctgggcctgcgggcgcgccgcctccctcggagggaaaagagccccacaagcccagaaaagccctgcgccgcctgcccgttgctcagcccttccccaatcattacctagccactgggtctcgtcgcctaggagaggaagcggagggtgctgcagacaccgaggtgaacgtaaagccggcgagatctccgtgctccgggtacccacagatactgtccgcgccgcccgcgccgacttcctgcctagctaaggcgagccccacccacttcccgcctccggggcacgccccctcagctccgcctcgccattcgtcgggagagccgtcactcattccctcacctcccggaaaggggtgggactgcgacggctgcagtagcgtggaaaggggggtgacgtcccgcggacttgaggcgggcagatctggggggccccgactccccagcggccctgtagtggtgcgggcgaaactctggccccagataggaccggtgagccgaactggggtgtgcggagccggggctccgggggatggcccggggcggcgtggcgggcatgagagctcggggctccgtcacgtactccgagtcccgcacgcactcagcgtcgctctggggccccacgtccggccctcgaccttgctgacaactttggcggcccgggcctgccgcggccctcctgccccgcccctcctgcctcgcgccgcgatccgagagaccccgttggcgtcgagtcgttgagaggctgcgcgcctcggccccactccggggttggggcgctggccccgccgcagcgctgcgtgtccggggccacgtgcgccgcctgcgcctgcgcgctgccctccagccgcgcccgtctggccgggctccgcctggcacccgccaaggtgaccctgtccctttctccttgctgcggtgagaatcaggccgagacagccaaaggaaggttcactttcctttaattctacctcatactttttgagtgccttctaggtgtccggcgcgcccccacgtgcttccccagtgttaattcattctctctctagtccatgtcatgttgcctctcaaattttacatccctctcattcccatctagggaactagatcaaacctacctggattcttgtgaaccattcatgtgaattatttggaactggaatttcacacagacccggggaatttctcaaagttcaagacgggtcatattccgtggaatacggaaggagttggagtgatttcacttttctgatcaagaactgatagccattaaaactcagctccgcaatatatccccccactccaagggagggctgagatgatcacttcgttttctgttacggctacttttatatttttcaacattactgctggtctgtaagagaactaaaacatctgattttcctcatttccttgtaaagaggtgttcaaatatgtacttgaatttaattatttcttctggtcagctgcaaaacctgcttttcttccttaacccctagcatttttatcctcttagctacagacaggtttccatggcgttggttaaaaattaaggcctattgagaccatagtatttgctttccagtgagtaagaagcaagaactttaggattaaattcagcaaaaagaaaaaaaaaaagagtaaaattttgcaagcagagtttgtgatttcaccagcaacacactaacgtttttggctactgaaaaccactatccccagccccatgactcagcagctaaatcaacagccaacatctcctactggtaaggactctaagaaatcaggcacttggtactctcagagcaattctaaggcgtggccctgaaagggctccaaacaatcttattttacataaaaatggttagagagataaagatactctgctgtggccagaaccagtaaatctagcaggaaatcagaggccgaacatgatcccggactgctgccgttgcaagattcttggaggctgcagcgccacattctgagccagcacttcgacctcacattgtagctaaaatgttaatgattactagagatgtcctgaaatctttttcaaaattcacaggctgccaaatgccctccctgtttccatagctccttaggctttgttagcaggctgtggggttcacatttgcttgtagtcagcacaacggcattgcatttagttattatttctcacttgctgtaagcttgttgagaagttttattggtggtgggcaggtggggaataactgtccaaagctatcagaataccacaccttgaagcactgtaggtaacacatgcatggtgtctgcaggtggccgggatcaagggagagtgaatctgctacgacctgtaactcgcttggattactgattctccctgtgatacgtgtgtaaaaatcactggtcagcttgagaaagggatctttgtgaaagagggtctccagccagatagggaacttcagggttggataaggagctctggggaggtaagataccagatgagtgcagaaggggatgtagctggatggtccctcctcataacagatcatgaggttttggtattcatcactcagtatttcacgtacaccagagactacataaagcgtatataaatctctgtgtacccacatcccgcttaagaaatggaacaccatgctgggcgcggtggctcacgcctgtcatcccagcactttgggaggccgaggcgggcggatgacgaggtcaggagttccaagactagcctgaccaacatggtgaaaccccgtctctactaaaaatataaaaatcagctgggcttggtggcaggcgcctgtagtcccagttactcaggaggctgaggcaggagaaccacttgaacccgggaggcggagcttgcagtgagccgagatcacgccactgcactccagcctggatgacagagcgagacaccgtctccaaaaaaaaaaaaaaaaaaaaagaaagaaagaaagaaatggaaccctagagtccaggcttagtggctcacatcagtactcccagcacttagggaggctgaggcaggaggattgcttgagcccaggagttccagaacagcagaacagcctgggcaacatggaggagaccccagtctctgtaaaaactaaaaaattaggcagatgtggcacatgcctgtagtcctatcccagctgcttgggagactcgggtgggagtgtcacttgagcccaggaggttaagattacaatgagctatgattgtaccagtgcactccagcctgggagataaagacctgtctcaaaggaagaaatggggccggacatggtggctcacccctataatcccatcactttgggaggctgaggggggtggatcacctgaggtcaggagtttgagaccagcctggccaacatggtgaaaccccatctcgactaaaaatacaaaaaattagccaggtgtggtggcacatgcctgtaatcccagctactcaggaggctaaggcaagagaattgcttgaacccaagaggcagaggttgcagtgagccaagatcatgccattgcactccagcctgggcaacaagagttaaaaaaagaaaagaaatggaaagttaaaaaaaaaaaagaaaaaagaaatggaggccgggtgcggtggctcatgcctgtaatcccagcactttgggaggttaaggcgggtggatgacctgaggtcaggagttcaagaccagcctggccaacatggtgaaaccccatctctaccaaaaatacaaagattagccgggtgtggtggtacatgcctgtactcccagctgctcgggaggctgaggcaggagaatcatttgaacccgggaggcggaggttgcaatgagccaagagtgtgccattacactccagccgggcgacagagcaagattccttctcaaaaaaataaaaaaaagaaatggaacattagtaatgtcatttaggtcccctgtatgttctttgaccccagaggtagccactattctaaattttgtgttttattattcccttgcttttttttttttttttttttttttttgagacggagtctcactctgtcgcacaggctggagtgcagtggctgatctcagctcactttaagttccgcctctccggttcacaccattctcttgcctcagcctcccgagtagctgggactagaggtgcccgccaccacacccagctaattttttgtatttttggtagagatggggtttcaccatgttagccagaatggtctcgatctcctgacctcgtgatccacctgcttcagcctcccaaagtgctgggattacaagtgtgagccaccgcacctggtctattcccttgctttttaaaatgatttttttttttttatttttagaaggagtctcatttttttttgcccaggctggagtgcactgatgcgatctcgactcactgcaacctctgcctcctggattcaagcgatcctcctgcctcagcctcctgagtagctgggattacaggcacccactaccacgcccagccaattttttttgtatttttagtagaggcagggttttaccatgttggccaggctggtctcaaactcctgacctcgtgatccacctgcctcggcctcccaaagtgatgagattacaggcatgagccacctcgcccagcctattttatattattttattttatttttgatacagagtctctctctgtcacccaggctggagtgtaggggcacagtcttggctcactgcaacctttgcctcccgggttcaagcgattctcctgcctcagcctccggattagctgggattacagccgcatgccaccacgcccggctaagcttttgtatttttagtagagatggggtctcaccgtattagctatgatggtcttgatctcctgacctcttgatcctcccgcctcagcctcccaaagtgctgagattataggtgtgagccaccgtgcccagccgtattttatttttaaatatatataaaaaaattataagtacagaacacttcacagatttgcatgacgtcctcgcgcggggcccatgctgatcttctctgtatcattccaatttttttttagtatatgtgctggcaagtcatgctaggttggcattcctcagggtgtccaaatgagaggagtaaaggggaggtgattaagcaagaaggcccaggggagctggggaagctgggagcagagttcccctgggcagaggtcatgaaggggcacccaagtgacagccgagggagaacaacttctggaaagtctgtctcagcaggcatcagaggaaagcatctctatttggcatcaaagagctcagcatggcctccctcagggccccagcgcctttatctttgggatggatgtgataatagtctcagggggaggtcggcagtctgggaattactgtttcaagctagaatggacacctagaaggcactaatatccctaaatagtatctgcaggaagttatccagccagttttcttttcacgtgtctctgttccctccctctttttcacaaaattcttaaggttgttgccgaggttctttttttttttttttgagatggagtttcactcttgttgcccaggctggagtgcagtggcgccatctcggttcaccgcagcctccacccaccaggttcaagcgattctcctgcctcaccctccctcgtagctgggattacaggcatgtgccaccacgcccagctaattttgtatttttagtagagacagggtttctccatgttggtcaggctggtcttgaactcctgacctcaggcgatccgccctccttggccttccaaagtgctgggattacaggcatgagccatcgcgcccggccgctgagtttcttaaggttgtcacagcatcacttggaggcaggagtgccggcccctgggaaggcccttgtcttgagaggaggagaggtcaggtaacaattgctgagttccagatggaaaatgaggagccacgttcttcagaaggtagtgatctggcgtgattcaggcgtggggagcagggtttcaccacgccttcaggcacaccacaagataatgagaaaattctccctgcatctatcgcagaccaataaagttgctgggccgggcacagtggctcatgcctgtaatcccagcactttgggagggcgaggcaggcagatcacctgaggtcagtagtttgagaccagcctggccaacatggcaaaaccccatctctacaaaaatacaaaaattagctgggcgtggtggcacatgtgtgtaatctcagctgctcgggaggctgaggcaggaaaattgcttgagtccaggaggcagaggttgcagtgagctgagattgtgccacactgcactccagcctgggcgacacagtgagactctgtgtcaaaataaataaataaaaaaaataatgttgctgaggcctcgttacttgccagacaccaggatgcttgtatatgtaactcatttaatcttgtaagcacgtccatgagcacactccatctgatcgtctccactttccaaggggcagggaggcagcagctgctggctgaggtgccagaggaccaactaacgcagcctggtccccagtcctcgcccccaacctcagcattgtgctcctccaagatgaagattgttcattcccctagtcctcggattccagtaaaatgctacaacaccaccgttagtccaaggaaccttgtcttgatttgcttatctataccacaactacctagaatttagctgtagcagcttcaggatttgcgaaacatcactcaggaagcttttgtgtctgccggattctgtgttctctctagaacaggtttgcagtcaggagaggcagcttgcagtcagaaatgccagttacactgtgtcagcattggagttccaatgataaaatgtccccaaccccatactcaggttgatgttttctggcatttcctaagcagaggggtagaaactttctgattttcggctgggcccggtggctcaagcctgtaatcccacactttgggaggccgaggagggcagatcacttgaggttgggagttcgagaccagcctggccaacatggtgaaacgctgtctctactgaaaatacaaaaattagctgggtgtgatggtgggtgtctgtaatcccagctactcgggaggctgaggcaggagaattgcttgaacccaagaggtggagggtgcagtgagctgagatagcgccactgcactccagcctgggtgacgagagaaactctgtttcaaaaacaagagactttctgatttcacacaaacacgttacagttcccatgaagtgaagtccttggaagtaaagtccccacacctcctgcactggaattctctgactaaatggggtttttgtttgcttgtcttgtttcctggtggtcagggaaatgctgagaagagaatggatttcagcacagcatttctcagagcctcttaggtaattcttggggctaggagagaaatgaagatttctcttacgcattttgaacagaaaagcaagtgggtagatttctaactggctgaatgagtctccttaaggtactgatatcaaaagcaaaggtaggagactggatgaaactgacaggctgagcatggaggctcacacctataattccagcactttgggaggctgaggcgggcagatcacctgagatcgggagttcgagagcagccttaccaccaacatggtgaaaccccatctctacgaaaaatataaaaattagccgggcgcggtggcaggtgcctgtaattccagctactcaggaggctgaggcaggaccacttgaacccaggtggtggagtttgtagtgagctgagatcatgccagtgcactccagcctgggtgacagagcgagactctgtctcaaaacaaacaaacaaaaaaaggtggggcctttggtaggtgattgagccctgccttcatgaatgggattaaggttctcataaaagaggttggagggagctgcctttctcttctgccatgtgagggcacagcatctatggagcaggggcagaaagcaggcctttacttgataccaaatctgtggacgccttgatcttgtgtttcccagcctccagacctgtgagaaataaatgtctactatttgtaaattgcccagtctaaggagctgtgttttggcagccgaagtcatagtcacaggctgcggataaacatgaagttttgtgggaggacattattcaacctactagagcctctgactctgcagggtctctccacatggcttctcatcattcagtagtctgtctagcccagggattgacaagctatggcctagggtccaaattctgtttttataaataaagttttgtgggaacacagacacactcatttcctttcttttttgagacaggtcttgctctgttggccaggctggagtgcagtgctgccagtcatggctcactgcagcctcaacctcccaggctcaagtgatcctcccatctcagcctcccaagtggctgggaccacaggtgtgtaccaccatggccagctaaattttttttttaacttttttgtaaacacggagtctcctatgttgcccaggctccgtttctttacatattgtatatggcagctctcaagctgcaatggcaaaatccagtcgtttcaacagagactgcaaggcccacaaggctgaaaatacttactatccagccctttatagagaaagtgtgctcacctgtggtccagcctagcttctcacatggaagctgtagcccaaaaacaaatgatccaagagggccagtcccagtgtgcaagtgcagatggcctctgcttgctgctgtctcattggccaaaacaggtcccatggtcaagcccagagtcggtggtaggggctacccacgggcctggatagtaggaccccccacaacccaagacagtctaccacgggggtgtgggaggtgctgaaacagggaggctcaataaggagactttctttctttctttctttttcttttttttttgagatgaagtcttgctctgttgcccgggctggagtgcagtggcttgatcttggctcattgcaacctctggcacccaggtttaagtgattctcctgcttcagcctccgaagtagctgggattacaggtgcgtgccaccaagcccagctaatttttgtatacttactagagacggaatttcagcatcttggccaggctggtcttgaactcctgacttcgtgatccagctgcctcggcctcccaaagtactgggattacaggcgtgagccaccgcgcccagcctttctttttttaagacagggtcttgctctgtcactgaggctggagtgcagtggcatgatcacagctcattgcagcttcagcctccagggttcaagtgatcctcccatcttagcctcctgagtagctgggactacaggcatgtaccaccacgcctggctaattatttattttttttggtagagagaagtctcactttgttgtccaagctgatctagaactcttgggttcaagcgattcaccagcttggcctcccaaagtgccaggattatgggcatgagccactgcccagccgatgaggagactcttgccttgtcccagggagagaccacggtggccctgtaggtcttgtaggttgtggcagtggatgtgtgagaagtgattggattccagatacatttgcaagcaaagctgatagttttggctgggcacagtggctcatgcctgtaaatcccagcactttgggaaaccaaggtgtgaggattgcttgagcccaggcatttgagaccagcctaggcaacacagcaagaccttgtctcaacaacagcaacaaaaattagctaggagcggtggcgtgtgcctgtggtcccagctattcaaacagctgagggtgagtatcccttgagcccaggagttagaggctgcaatgtgttatgatcgtgccactgcactacggcttgggtgacagagcgagaccctgtctcttagaagacaaaacgaggctgggcgcggtggctcatgcctgtaatcccagcactttgggaggccgaggcaggtggatcacgaggtcaggagttcaagaccagcctgaccaatatggtgaaaccccgtctctactaaaaataaaaactagccaggtgtggtggtgggcacctgtaatcccagctactcgggaggctgaggcaggagaattgcttgaacctgggaggcggaggttgcagtgagccgagatcacgccattgcactccaggctgggcaacaagagtgaaactccatctcaaaaaataaaaaaataggctgggcatggtggctcacgcctgtaatcccagcactttgggaggtcgaggtgggcagatcacaaggtcaggagatcgagaccatcctggctaacacagggaaaccccgtctctactaaaaacacaaaaaattagccgggcgtggtggcgtgtgcctgtagtcccagctactcgggaggctgaggcaggagaatggcgtgaacccgggaggcggagcttgtagtgagccgagttcgcaccactgcactccagcctgggtgacagagcgagactgtctcaaaaaaaaaaaaaataataataataaaaagtaaaacaaaacaaacaaatgaataaaaggatcactcagagtgtggttgctcacacatgtaatctcagcactttgggaagctgagggaggatcctttgagtccaggagtttgagaccagcctaggcaacatagtgagaccccatcttgtgtctacaagagtttaaaatgttagccgggcatggtggcatgcacctatagtcctagctgctcagaagcctgaggcaggacaaatacttgagcccaggaggttgaggctgcagtgagcggtgattgcgccattgcactctggtctgggcaacagaacgagaggctgcctcaaaaacataataaaagaaagagaatcacgtccagtgtgaagttcgtactctggggaagggtccttggttctaagtaacaaggacacatagggcccctcttagggaagcaggatgtgagggacacaggaacacacctccccaagtccccgtaggaagagagcagacttgagatctgaactccacttactgaaggactattatgcaataaagggaatagacctagtctttgtggctccagagatgaggacgactacagagagcattcccagggaggccgagggcatctcagtttcagagaagaaaccatttccaagatgacatggtgtttccatgtcatcttggttcaggaggggctgttctggagaggctgggggccctctgtaggagggtctggagaattccaacatctgaaggctgcagttcggggctttaccgtaaacacacacacacacacacacaatatacacacactatatatatgcatatatgtatgcatatatgtataatatatatttaaagcaaactaaacttactttccattcgtttaagatctttagaatatctctgagattatttgtgaaacctcaagattaaaaaaataacaacgacaagaaacaaggctaagaatcaacatcccaggctcctgcctcttattctattaaccacagaaattaagttccgcaaagacaaagatgcttctgttacttcccaattagtctgccctgtttggacacagtcccagacctcataccccggagcctacgcacggactcctggcaagagaggcgccatcccaggcccagtgccagggctcctctctcggtcctgtcctcagggtgtccttgggctccttctggacagaggctcttccctctcctgccaggtcctcagatccgaactccctaagcaggggcttatgtcttgccagtgcttcttgtttttctttttcttttttttttttttgagacggagtctcgctctctcaaaaaaaaaaaaaaaaaaatcaaatgggaacacttcagctatgacaggaaatatcttctctatttacatagggcatatgccgagtacatgattttgtaactttatttcatcctcttcatttacctagggtgtataccaagtaaccaatggaaacctctagagggtatttaaaccccagaaaattctgtaacagggcttttgagcccttatgctcagcctgctcccaccctgtgagtactttctttcttttttttttttttgagactgagtctcgctctatcgcccaggctggaatgcagtggtgcgatctcagctcactgcagtctccgcctcccaggttcatgccattctcctgcctcagccttccgagcagctgggattataggtgcccgccaccacgcctggcaaattttttgtatttttagtagagatggggtttcaccatgttagccaggatggtctcgatctcctgaccccaagtgatctgcccgcctcggcctcccaaagtgctgggattacagatgtgagccaccatgctctgccttctacaaaaatttttaaaaattagtgggacatggtggcatgcacccatagtcccagctactctggaggctgagagaggaggctcattggagctggggaggccaaggctgcaacagtaagctatgatggtgccactgcactccagcctgggtgacagagtgagaccctgccttaaacaaacaaacaaattgcacctacttttttttttttttttgagaaggagtttcgctcttgttgccccaggctggatgcaatggtgtgatctcagctcactgcaacctccacctcccaggttcaagcaattctcctgcctcagcctcctgagtagctgggattacaggcatgcgccaccacgcccggctaattttgtatttttagtagagatggggttcctccatgttggtcaggctggtctcgaactcccgacctcaggtgatccacccacctcggcctcccaaagtgctgggattacaggcgtgagccactgtgcctggccctgcacctacattttaacagaattcaggcccctcccataatcctaatcttgtggactttcattagttttgcaaaggtggtcaaaggtggttttctgtccgtgagcaagaagggggttagttttagagagggactattatcatctttgcttcaaagttaaactatagactgaattcctcccgtggttagcttggcctatgcccagggatgagtgaagacagccagcctgtgaggctcgaagcaagatggagtcagccaggctagacttctcactctgtcacaatctgggcaaaggcagtttcaaaaccatcatatcttccagctattctctttgggacccatttatttttactaaaagtcatttgtttttccttaggggtccttcccttattaagccccaatttctaactgcctccttgggtcacatttttctgtgaacttctatacctacatgaataaagatcttttctcttgctaacttgtcgtttgtcaatttaatttgtatactctaagtgctgaacctaataaaggagaagtttttccttgacagtgtcaactggggtagcaatacttctggtttctgatttgtgttgaaatacgattcaagctacacactctaaatttatcttgtcattcctctgaagatcaaggttgatttatttattcttcaacaaacattactgagggcctattaaatgccaggccaggcactgttttaggaatggagaatagaacagagaacaaggcaaagttctcgccttcatggtgtttacgctctggtgcaggaggcagatgacaagccagtaaatgcctagagtggcagcaggtgccgatgctctggagaatattgaaactgtcattgcaaaatcgtagctcagacggtgaaagagatctgacctaaccaactccatcttgcttgtatcctccaagctgttcttgttcattcctgggcataggctgtactgactttggaaggaacttagtttatagtttaaaacaaagaggataacagctctttcccaaaacgaaagaggtggggactagactgcctttataggactaacatattagccacaagtttagaaattaaggtttaggagtcatgcagttggaggctacaagattctgaccgcccctaaactgctcctaagacccgtgcttcagaaacattgcagaccctgccttgatggatcagctggcaccacccagatagataaactagctcacctgatcttgtggcccccacccaggaactgactgagcacaagaagacagcttcaactccctatggtttcatctgcaatccaaccagtcagcactcctggctcactggcttcccccacccaccaaattatcctcaaaaactttgatcccagctgggcatggtggctcacgcctgtaatctcagcactttgggaggccaaggcaggcatatcacaaggtcaggagtttgagactagcctggccaatatgatgaaaccccatctctggtcgggcgcggtggctcacacctgtaatcccagcactttgggaggccgaggtgggcggatcacgaggtcaggagatcgagaccatcctggctaacacggtgaaaccccgtctctactaaaaatacaaaaaattagtggcgggcgcctgtagtgccagctactcgggaggctgaggcaggagactggcgggaacctgggaggcggagcttgcagcaagccgatatcgcgccactgcactgcagcctgggcgacagagcgagactccgtctcaaaaaaaaaaaaaaaaaaaaaaagaaagaaaccccgtctctactaaaaatacacgggcgtggttgtgcctgcctgtagtcccagctactcgggaggctgaggcaggagaatcgcttgaacccgcgagacggaggttgcagtgagccaagatcgcaccactgcactccagcctgggcgacaaaacgagagtccgtatcagaaaaaaaaaaaaaaaaaaaaaaaggtctgatccctgaatgctcggggagactgatttgagtaataataaaagtctgggaagaagaagaggcgagaacgaccccgggaccgaccaaagcccgcgcgccgccgcatcccgcgtacagcacctacatcccgccaccgtcaccgccaccaccatgcccaagagaaaggctgaaggggatgctaaaggaggtaaagccaaggtgaaggacgaaccacagagaaggtctgcaaggttgtctgctaaacctgctcctccaaagccagagcccaagcctaaaaagacccctgcaaagaaggcagagaaggtacccaaagggaaaaagggaaaagctgatgctggtaaggaggggaatagccctgcagaaagtggagatgccaaaacagaccaggcccagaaagctgaaggtgctggagaggccaagtgaagtgtgtgcatttttgataactgtgtacttccagtgactgtacagtttgaaagaccattttttaaatcaagttttataaaaatgcagaattttgttttacttttatttttcttttaaagctatgttgttagcacacagaacacttcattgtttgttgggggaggggcatatgtcactaacagaatgtctccaaagctggattgatgtggagaaagcacctttcccttctagtcttgagagacttcctcttggctcccaggaggagggattccctgactttgacacacatggccaccttggcacaaaagccttgtggtgtggaaaaacaaatttgtttttatgtcctcttctccctttccatctttcagcatagacttaactcctttaatcccaggcatctgttgggacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagagtcggcttgtgaaaagttgttaaacaacatgctaaatgtgaaatgtcaaccctcactctaaactttccctgttcagagcatgagatgaagacttctttgggttttatagcggctttctgatttttcgtagtccattgaagaagggagtttgaaagttgttgtatactgttaacaattgtctgcccatgtcctgcctgaaataccatgattgtttatggaaagtatctttaataaagctggatacagtttggcttggaaaaaaataaaaaataaaactccgatctccctcactactggctctgagtcaattactctttctcttctttctttatttattattttaatttttaattttatcatttttatcattttaactttttattttattttattttgagatagtcttgctctgtcacccagtccggagtgcagtggcatgacctcggctcactgcaacctctacttcccgggtacaagcaattcttctgcctcggcctcgagagtagctgggatcacaggtatgttccaccacacccggctaatttttgtatttttagtagagacagggtttcaccatgttggccagactggtcttgaattcctgaccccaagtgatccatccatcttggcctgccaaagtgctgggattacaggtgtgagccactgtgccctgctgaattactctttctgtattgcaattcccctgtcttgagaaactggctctgtctaggcagtgggcaaggtgaacccactggactgttgcatattagtctgtctcatgggggaagggtatactggtggggcttgtatgaacactacattatgtgattcatataaaacaatttatcaaaataaaattcaaatagtttaaatcttaagacaccttcctagttattttttctaaatagggaagaaaaggagcagctgacttttttactgctttcttttattttcattttattattattatttgagacggagttgcactcttgtcctactcgggagggtgaggcaggagaatcacttgaacctgggaggcggaggttgcagtgagccgagattgcaccactgcactccagcctgggcgacaagaacaaaactccatctacaaaagaaagaaagtactctatgcttgttttaaaaattcagaccgggtgcagtggctcatgcctgtaatcccagaccgaggtgggcagatcacgaaatcaggcgatcaagaccatcctggctaacgtggtgaaaccccgtctcaactaaaaatacaaaaaattagccgggtgtggtggcacctgcctgtagtcccagctactcaggaggctgaggtaggagaatcgcttgaacccgggaggcagaggttgcagtgagccgagattgcgccaccgcactccaacctgggtgaccgagcgagaatctgtctcaaaaataaaaaattaaaacaaaacagaaacacattatatttgtttcctctccctccctacttcacttctactattaacagtctggccaggcatggtggctcacacctgtaatacaggagatctagtgttggtcaaatctctcccctttacctccccatgtatggattctttgtgggaaggaccatactcggtaatcctctctacccccactgcagttaaggtggcaggaatggaatcttggattcaccacatccgagttaaattttggacaccctctgaggaacctgagggaccatcagctcaggagtcccaagatcatccagaccagcctcgatacacctgcgaaccgttggaggacttgcatgtgctgttttggaaggaaacatccagactaaaagggctcctaccactgatcctgaaaaaaaccccttcctccttaaaaaagataaatgaaaacctacgtaatctttatctttaacacttctccttgcccctttgatggaatccttttactatttcattatattactaagcagcatactaaccatactcttcaggataggactatatactgtagctcctgccaggatgaaaatcttaatcacatcaaccttctttctattatccttccttctgacagcaatttactcctacctttaactcagcctggataaaatgatctcgtcttccagagcaccctctttaccttcccatttactctttgtctatctgtcccctctgcttccttggatacctcatacaatcacccctccccttccactagctcctaattacctctataagacgctcaacttaacccagtctctgttaaaccagtccaatccttccctggcaaatgactgttggctttgtatctctctatccacctctgcttatgttgccactcccattccctcaaaaaattgggtctttaccaatttaacctaccatccttgttatgaaggaaaagaccctttccgacttctaaatatgcaatcattagccaacttccccatctctgataggaccaagaataccctaacaggatgtgcaatccaatttttacgttcttacatttccaacctcacctattacacaagcaatgaaaagcccatacatggtcttgttactatgaataccatcttaactttcccctttatgcatccaacgcaacctgttatcaggcctgcccctggggcacctactaccccatcagtgtaattacaccctacaacttcaagccccaactaatcatagtaacttctgagtcactcaaacagctccattcagatggcttgtctgcttctcagcgcctccaaaaatcatcacctcctccctgcttaacaaacagtccaggttttgtaatggcaaacatactccttgcatgaccattcacccctggaccccctgtggcagcgcccccaccactagtgaatgccttctcatcccctcttccaatcactctcttgaatggctcctagtagacacaaaacaattttttctccaatgggaaaatagaacacagggagccactcagtttgctcccaacacccctttccagccgctcactggagctaccttagcaagtactctaggagtatgggaaaatgaaaacaacaaactcacacacctttttaacatacacaaccagttctgtctacccagccaaggtatattcttatgtgcaatgtcaacctatatctgcctccccactaactggagaggcacctgcaccttagtctttctaagtcccaacattaacattgccccaggaaatcagaccctatcagtacccctcaaagctcaagtccctcagcacagagccatacaactaatacccctacttacagggttaggaatggccactgttacaggaaccagaatagccagtttatctacttcattatcctactaccacacactctcaaaggatttctcagacagtttgcaagagataacgaaatctatccttactctacaatcccaaatagactctgtggcagcagtgactctccaaaactgccgaggcctagaccgcctcactgctgagaaaggaggactctgcaccttcttaggggaagagtgttgtttttacactaaccagtcagggatagtatgagatgctgcctggcgtttacaggaaaaggcttctgaaatcagacaatgcctttcaaactcttataccaatctctggagttgggcaacatggcttctcccctttctaggtcccgtggcagccatcttgctattactcgcctttgggcaagtaatttttaacctccttgtcaaatttgtttcctctaggatcgaggccatcaagctacagatggtcttacaaatggaaccccaaataagctcaactaaaaacttctaccgaggacctctggaccgacccgctggccctttcactggcctaaagagttcccctctggaggacactacaactgcagggccccttcttcacccctatccagcaagaagtacctagagcagtcattgcccaatttccaacagcaattggggtgtcttgtttagaggggggattgagaggtgaagccggctgggcttctgggttggatggggacttggagaacttttctgtctaactagaggattataaactcatcaatcagcactctgtctagctaaaggattgtaaatgcaccaatcagcactctctaaaaatgcaccaatcagcgctctgtgtctagctaaaggattgtaaatgcaccaatcagcactcttgtctagctaaaggattataaatgcaccaatcagcactctgtaaaaacgcaccaattagcactctgtgtctagttaaaggattgtaaatgcaccaatcagcactctgtaaaatggaccaatcagcaggatgtgggcggggccaaataagggaataaaagctggccacccaagccagcagtggcaaccagcttgggtccccttccatgctgtggaagctttgttctttcgctcttcacaataaatcttgctgctgctcactctgggtttgcactacctttatgagttgtaacactcacggcaagggtctatggcttcattcctgaggtcagcgagaccacgaacccactgggaggaacaaacaattctggacgcgccacgtttaagagctgtaacactcactgcgaaggtctgtggcttcactcctgaagtcagcgagaccacgaacccaccggaaggaagaaactccggacacatctgaacatctgaaggaataaactctggacaaaccatctttaagagctgtaacaatcaccgcaagggtccacagcttcattcttgaagtcagcgagaccaggaacccaccggaaagaataaattccggacacaacatttcttttttctttgagacagggtctcagtggcacaatcatagctcactgcagcctcaacctcctgggctcaagagatcctcctgcctcagtctcctgagtagctggcacaccgccatgccctgccaattttttttgtagagacaggggtctcactgtgctgcctacactggtctcgagctcctggtctcaagcagtcctccctcctggtcgtcccaaagtgctgggattataggtgtgagccaccgtgcctggcctcttttcttcttttttccctccacatgtgtcttattttttttatttttttattttttgagacaaagtcttgctcttctcccccaggctggaatgcagtgttgccatcttggctcactgcaacctctgtctcccggattcaagcaattctcctgcttcgccccctcaagtagctgggattacaggtgcccaccaccacgcgtggctaatttttgtatttttagtagaagcggggtttcaccatgttggccaggctggtctagaactcctgacctcaggtgatctacccgtttcggcctcctgaagtactgggattagaggcatgagccaccgtgcccggccgtcttttgctttatttttgagacagagtctcactctgctgcccaggctggagtgcagtggtgctatctcggctcactgcaacctctgcctccccggttccagtgatttttgtgcctcagcctcccgagtagctgctgtgattactacaggtgcccaccaccacgcctggctaatttttgtatttttagtagagatggggtttcaccatgttgctcaggtttgtctcaaactcctggccccaggtgatctgcctgccttggcctcccaaagtgctgggattacaggcatgagccactgagcctggcctctatataagccctaagttctaaccgctcctctgagttactcatcactgaatttccgttgcaggtgattcatgagtttccaggaaaggggtgggtgatttccagaatgagggttcctcccctttttagactatataggtaaacttctgggccaggcatggtggctcatgcctgtaatctcagcactttggaaggccaaggctggcagatcacttgaggtcaggagttcaaggacagcctggcaagcatggagaaatcctgtctctactaaaaatacaaaaattagctgggcgtgatgatgtgctcctgtactcccagttactcaggcagctgaggcaggagaagccggaggcagaggttgtggtgagccaagattgtgccactgcactccagcctgggtgacagagcaagaccctgtctcaataaactaaactaaactaaaataaataaataaaggaatagactacataggctaacttctggatgtggctgtggcatttgtaaactgtcatggcgctgatgagagtgtcttttagcatgctaatgtattataattaatgtatactgagtagggaggactaccagaggtcactttcattgccatcttggttttggctggtttgggctgagttctttttttttttttgagacagagtctcactctgtcacccaggctggagtgcagtggcacagtctcagctcactgcaatctccacctcccaggttcaagtaattctcctgcctcagcctcctgagtagctgggatacaggcacgtgccaccacacccagctaatttttgtatatttagtagagacggggtttcaccatgttgatcaggctggtctcgacctcctgaccttgtggtctgcctgccttggcctcccaaagtcctgggattacaggcatgagccaccgcacctgtcctgggctgacttcttgaccacatcctattttatcagcagggtctttatgacctgtatctcatgatatcaatcctgcagacctcatctatcttttttttttttttttttttttgagacaaagtctcactttgtcacccaggctggagtgcaatgacaccatctcagctcactgcaacttctgcctcccaggttcaagcaattctcctgccttagcctcccaagtagctgggattacaggtgtgcaccaccatgcctggctaatttttattttattttattttattttattttattttattttattttattttattttattttatttttaagacagagttttgctcttgtcgcccgggctgaagtgcaatggcaggatctcagctgactgcaacctctgcctcccgggttcaagcaattctcctccctcagcctcccaagtagctgggactacaggcacttgtcaccacactggctaatttttgtatttttagtagagatggggttttaccatgttggccaggctggtctcgaactcctgacctcaaatgattcatccacctgggcctcccaaagcactgggattacaaacatgagctaccgcatctagcctccgagtaatttttatatttttagtagagacagagtttcaccatattggccaggctggtgttgaacttctggcctcaaagtgatccaccctcatcagcctcccacagtgttgggattacaggcgtgagccactctgaccagccaaagacttctactttcatgaacttactgtaaatcttacccttaagtgaaagcctcaacattactgaaacacatacttaccataaatcctgcccttatgcaaattccctatggtatataagccctgggtcttggggtataacattgtagggatccaccatgtcatctggaggctgcctgagacatggtttctgttcgtaagtccctattaaatgtttccttctgatcactgtgtttgtcagcctctttctttggcctctcagctccctgggcctttggaggtaggtttgcatagacctgctcaccgcagaagagtgcttaatatatatattttttttttttgagacggggtctcactctgttgcccaggctgaagtgcagtggtgccatctcagctcacggcagcctccgcctcctgaggtcaagcaattctccctcctcagcctcctaagtagctgggattacaggggtgcgccaccacgcccagctaatttttgcatttttagtatagatggggtttcaccatgttgaccaggctggtatcgaactcctgacctcaggtaatccacccgcctcggcctgccaaagtgctgggattacaggcatgagccactgcacccggccttaatacatttttgttgaatggatgaagtgcttctccataagggatgtttgggttcaattttctggctcccacaaacccaccttctgagtctcagaccctctccttgtccatacctgtccatgcggagataggcggtgtggtgttacgatagatacatactggtttgcatctgcagatccccgttcctaactcccacagtcctgtgataatgttggggcacttgaggcctcaggaaacagaacctctcctctgaacttctcctgttcctctttcacctgtccaaccaggattctaatctgatgtgggtccaaagaccttcattccagagagggtcctgccccataccctagagcaagactgttcagcccaccgtccaggatggctttgaatgcagcccaacacaaattcataaactttcttaaaacattatgagattgtttcacaatttttttttaaagatcatcagctatcattagtgctagagtattttatatgtagcccaagacaattcttcttgttccaatgtggcccaggaagtcaaaagattggtcagccctgccctagaggaaggaatgctgagagagaggccaagaaaagtctgaacagacaggccttgccgggggtttagatcatgagatttttgtccaatcacatttctacacggttatcagtcgtgcccatgtaatgaagcctccataaaaaagccacgaggactgggtttggagaggttctggatggctgaatacgtggaggttcctggagggtggtgagacccaggagagcatggaagctctgcttcccctaaactccaccctatgcatggcttcatctgtatcccttgtgaatcctttataataaaccactaaacataagtaagtgttttcttgagttctgtgagccattccaacatattaatcaaacccaggctgggcatcgtgcctcatacctgtaattctagcactttggcaggccaaggcgggtggattacttgaggtcaggtgttcgagaccagcctggccaacatggtgaaaccccgtctctactaaaaatacaaaaattagccggacatggtgactcacacctgtaatcccagctactcaggaggctgaggcaggagaatcgcttgaacccgggaggcggaggttgcagtgagccgagatcccgcaactgcactccagcctgggagacagagtgagactccgtcaaaaacaaaaaaacaaaaagcaaacaaacaaaaaaacaaacccaaagagggggtcatgggaaccccaaattgaagccagtgactcagaagttccagaggctcagacttgtgactagcattgggggagatagtcttgcagactgagttctcaagccctgggatgtgatgccatctccaggtagatagtgttgaaattgaattgcaggacacccagctggtgtccacccccacacatttggtcacagaagtcttcttctgtgttgactgttgtggtgtgagagtagaggaaaaatgcagtttggatagagtttttttctgacacaggtggtgatcttcaggaacccacctgcacctgtgagattctgaagacgtggacccagccttcacaggcatccaagttaccttccccatgaggacttgttttacagatcacaaaagacatctgcactttgtatggctccagcaggatctctctgatctgtgaggattaatgagccagccacatctctccccagcttcctggaccaatggcgcaaacctagttcagaaacccagcaagttgcctgaggcattagccaggcatccgtggtatgcaagttttggcactggtttgctgtttggatgtttttctccttcaggcggaaatttacaaagcactcatgctccaactaccatggcagagagaggaggtgaagcaaattgtaaaaacttcaacctcagtattgagtttctccttgacttgtgttgaagccaatgatggcaagggatgtggataacctggatgttttctcttgggatccaccctctcacaggtgttcctctgagcactttgcaggatgagaagttgaatagggaggggagaggtcccctctcctcccctcccctctcctctcctttcctctcctcacagggtctcgctctgttgcccaggctggagtgcagtggtgtgatcttggctcactgcaacctccacctcctgggctcaagcaatcctctcaccttagccttctgaggagctgggactacaggcacgtgccactatacatggctaatttttatatttttttttggtagagacggagttttgccatgttgtccaggctggtcttcaactcctgggctcaagcaatctgtctacttcggccttacaaagtgggtgctgatttctctgcagcttatggacacaccataagctgggggcacccatggaagtgctttagcttgtaatctccatcaacatctcccacaagacacctccccaaacttgatctggtttggggagtcactgctgtctggaggaaaacatctctaatttagccctcgagattacacatattaagttcaactaagtacgaactcaaggtatattaaatacaatttccaaacacaccagccatcatgagtgagaatcagcagaaactatgaatgacagacttaggccatctcaggtttttggagtgatcagatacagattattttattaattaattaattaattaattatttttgagatggagtctctgttgcccaggctggagtgcagtggcatgatcttggctcactgaaacctctgcgattctcctgcctcagcctcccaagtagctgggattacaggcgtgcaacaccatgcccggctaatttttgtatttttagttgagatggggttttgccatgttagccaggctggtctcgaacccctgacctcagatgatccacctgccttggccttccaaagtgctggggttgcaggcatgagccatcccgcctggccagatacagattattaagcatagagttgtaaggcaagcgttctgggtctttctctttctctgtctctctctctttctttttttctctctttttctttctttcttcttttgagacggagtcttgttctgttgcccaggctggagtgcagtgccacgattcaggctcactgcaaccttcacctcctgggttcaagtgattctcccacctcagcctctcgagtagctgggattacaggcacccaccaccacccccagctaatttttgtatttttagtagaaacagtgtttcaccatgttggccaggctggtctcaaactcctgacctcaagtgatccacccacctcagcctcctaaagtgcttgggattacaggcgtgagccactgcgccccgccctgggtgtctgtttcgatcttgctgctcctctgagcctcctatacaaagattctggcgctactgcacgccctgtgtttgtgtcctctatgttaaagttctttttcctggctaatgtggtccagacatgttggaagggattctaaagtaacaatcctgtgaccacgtgactgtgagaagaattcttttctaaagaaaaggatcttcatcacataccgacccatctctttcactacctttaataccacctcagatatctctcttttcatttcctgcagcccttattgcttccgtggtgttaggccccttggcattttgtcatatttgtttttttccattttgtagctgactgtctcaccagtcactcctgtctggaggaaaacattcccagtttagcccttgagattacacttattaagttcaacaaagcacagcctcatgatacataatttccaaacacacaaggaagccagccatgatgaatgagaaactatgaacaacagacttaggcctctttaggattttggagaaatcagatacagattattaaataactactcatggatttttttttgggtggggcggtgctgctttttgatttctttctttttttttttttttgagatggagtcttgctctgttgcccaggctggagtgcaatggtgtgatctcagctcactgcaacttccacctcctggattcaagcgattctcctgtctcagccttctgagtagctgggattacagatgcccaccaccatgcctggctaatttttgtatttttagtagagacagggttttaacatgttggccaggctggtctcaaactcctgacctcaagtgatccatgagcctcagcctcccaaagtgctgggattactggcatgagccactgtgcccggccttgatttttttttttttttttttttttgagacagagtcttgctctgtcacccaggctggagtgcagtggcaaaatctcggctcactgcaagctccgcctcccggggttcacgcctttctcctgcctcagcctcccaagtagctgggactacaggcgcccgccactacgcccggctaattttttgtatttttagtagagatggggtttcactgtgttagccaggatggtctcgatctcctgacctcgtgatccgcccgcctctgcctcccaaagtgctgggattacaggcgtgagccaccgcgcccggcgatttctatttttttttttttttttttttttttgagacggagtctcgctctgtcacccaggctggagtgcagtggcacgatctcggctcactgcaagctccgcctcccgggttcacgccattctcctgcctcagcctcccaagtagctgggactacaggcgcccgccactacacccggctaattttttgtatttttagtagagatggggtttcaccgtttttttagccgggatggtctcgatctcctgacctcgtgatccgcccgcctcggcctcccaaagtgctgggattacaggcgtgagccaccgcgcccggcccgatttctatttttaatagagatggggtcttgctattttgcccaggctggtcttcaactcccgagctcaggcaatccttctgccttggcctcccaaagtgctgggattacaggtgtgagccactgtgcccagccaaaaatttttaaaaatgagtttaaaaatgagcagtaagaagagacttctaaaaatgagcatgctttctctgatgcagaaccagggctgagctcacactaaaggcctttccacacttaccacattcataagctttctcaccatgggttcttcgatgcctaaaaaggcttgtactccaaacaaagctttgcccatatttgtcacagttttgaggtctccttttaaaggcgttctgatctttttcatttaatttatccccaaattcacagaattctctgccttcagaatcctggagaacattctctctgagactgctagactcttctgtcaatggttcaatttttgctgtaattccctcctctgaagctggctttccaatcttggtcttgttttcaccatctcgacttggtccctggaccgctgtgaagcctcacacccggcgaacctgccatcgccctgtccactctcacggcacaatcaggagctgtgctatacgctctcctggctctgctttccagggaacagaagtagatataacaatttgaatttctgcattgtaatctgaatcaatgactcctgtctgtacttgcactccttttaaatttaaactagacctacctagtttaagtagtaatcctactgtccccactggcatcatctgattgcagacagcaacattctttaacagtcccattacaaaaggagaacctggtccatattgattaatagcttgcttaaattctctgagtaatttaaaagaaaaaggctcaaatgtagctataatatttccctgatgatctgggggatatattctaacagggaactgccaagcctctatatcaccctctcttctagcttgctgaattcctgtctgaatagaactaagagcagtcattcgaggcgctgcttgaacagtcactggggcaactactttttgcccagtgtcctctggaaaagaaagatctggaggtcaggccactttctgtcttcaaaataaggaggggatgcaggagggtagggatgaacctcttcctcctttgctgctttagctttagctggcaaacaaacctgctctgtcacctcttctgttacttcattatactttccttcctcgtcatcatcagtgtgaaaagcttccaaggaccctgatgcttctgagctcctcttcttactcaccacggggattgcttaagagtactcgggtgtcctccagtttagtttcacgttctccaactgtcgctccggcgaccctttgacccggatgtgagcccccatgttgggcaccgcttgccgagaccagctcagtcgcggagactctaacccggcggcactagaggaattaaagacacacacacagaaatatagagtgtggagtgggagatcaggggactcacagccttcagagcttgactcacatgtttattgacagcaagccagtgataagcattatttctatagattatagattaactaaaagtattccctacaggaaacaaagggatgggccaagacaaagggatgggctctggctagttatcacacaaacaatagcatgagtgatctggtctgaaattccagggctcaaacagtcttcacgctttggcctcctaaagtgctgggattacagatgggagccactgcacccaccaggcctccagtttttgagccaaggccatgctctgtctgggtagccccaagacaatgactaagcatgctgggataccaggcctggtcatttctgcccaacggggctgtactgatggcctgtatttgctccagagctccccgttggattagccaagacggttctgcatcatcgtctgagactctccctgataaatcccgctctctcctgctttttctttcacagctgctacccccaatacacccttttattttaacagtttttggggaataggtggtttttggttacatggataagttctttaatggtgatttctgagattttggtacccccgtcacccaggaagcacacaccatacccaacgtgtagtcccaatacactcttttttgttttgttttgttttttttgttttttgagacggagtctcactctgtcgccaggctggagtgcagtggtgcgatctcggctcactgcaacctctgcctcccgggttcaagcgattctcctgcctcagcctcccaagtagctgggactacaggagcacaccaccatgcccagctaatttttgtatttttagtagagagggggtttcaccatgttggccaagctggtctcgatctcttgaccttgtgatccacccacctcggcctcccaaactgctgggattacaggcgtgaaccacagcacctggccccaatacactcttgcattcctacgtccatctgagtgctcacttcctggaggaccccactgacttaataatcacatcacaagacgtcttacactcatgaactgtccctacattaggcctaaaaacagatgcaatccccggacgcctaaaccaaaccacattcaccgccacacgaccaggagtatactacggtcaatggtcagaaatctgcagagctagccacagttttatacaaccatctggagaggagaggtgggcggggattggatcctataggaccttgtgggccatggtaaggggtttgaattctgttctggttctaatgggaaaccattgcatggttttaagaagggaagggcaatggattcatctttttttttttttgagacggagtctcgctctgtctgttccccaggctggagtacagtggctcgatctttgctcacttcaacctctgcctgctgggttcaagcgagtctcctgcttcaccttcctgtgtagctgggattacaggcatgcaccaccacgcctggcctggattcacctttagaatgctttccctggactgtagaaaataggagtgaacacaagaacctggtggtgatctttcaggagaaagatcctgcttggactagagttgcagcaggtgaagtgggaagcaatggttggattcaggacatgtgtttggagggagagccaacaggcttactgatgggtgggatgactggtatgagctggtatgagctactggtgatagcatttgctgagatggggaagacaaggaggggaatggagctggagaatgaggaaggtggcaggttggagatgcctgctagacctccagggggaggcagagaagttggttgggattacaagtcttggaggtgggaggagaggtcaggctggagacagacatctggggggtgatatttaaagcagcagagctggctgagactgaggagagaatgtgccaccattgagcacagacgtgcaaggaaggaaatgggcgatttcctcatcaatactctactccggtacatacaaaatactgaatgtgtttcaacaattaaaacaatgaggttggccaagtgtggtgggggatggaggggggtggggtgccgcggggatcactttcactcaggagatcgagaccaacctgggcaacacagcaaaatcccatctctacaaaaaatacagaacctagctgggtgggcttggtggcatgcttgtagtcccagctactctggaggctgaggtgggaggatcacttgagcccaggaggcagaggttgcagtgagctgagatcacaccactgcactacagcctggacgacagagccagaccctgtctcaaaacaaaacaaaaaaccaatgaggttgatctacagtgtatgtacatcgtggaaaagtgtccataatacagaaagtgaaaaaatcaaacctctgaaccatgtgtgtaatagtccacctgcgtgtgtgcgtgactgtgcatctggagtctgcagaagggcatgaccacgtggttaacaggtcaacagcggctccctctgcagagggagctggagggaagacaggaaatggagggatttgcttttgcttctctacacattgcttggatattttatttattccttcattttatttcatttcattttgctttgtttttaacaaaaggcatgtattccttgtagtgtacaatttccggagcccacacctgtttgcctgtagctaggactcagatcagatacattaaaggatggccaggcaagaggcagtgacatcctgtgttccctggggcagttcctccctcctccgcctaagaaccacaatctaggtagaccccctagaggggctgggaggatccactcttctttcccttttttaaggggaagggtttgttttgggaggagttcttttgttagtcagagtggcccaagggctccagaggtaaatacaagcactccactctcttcagtctctttttacattgccttccccagtggggtgctaagggctggccagggcatgcttccacaagttcctttgattatttagaaaaaggcttacataattcaacccgaaggactctgagaggtgaatcgagtgtgcaggaatcaactggacagtggccgaacaggaagttcaaaacttgtgaatagcgttgttttgattaattaaccatctcagtctcccagggaggggtctctaaagactgggcagtaaaaaaagcaacaacaacaacaacaaaaaaacaacaaaaacctccccaaactgtgcagtaatgtctttgcctgccctggagggccccttgggtaggttttatatgagctcgggtgtcttgagtgagtccaccatctgggaggcaggcagtgccaactcaggggactgcagtggatgggagactgtgtcaggggtgacccccaggggaccctggtccactggttggccaactttgttgttgtcatctctgaggttgggctgattgaaagtggccgacagccgccccgtccgggaggtgaggggcgcctctgcccggccgcccctactgggaagtgaggagcccctctgcccggccgccaccccgtctgggaggtgtacccaacagctcattgagaacgggccatgatgacaatggcggttttgtggaatagaaaggggggaaaggtggggaaaagactgagaaattggatggttgccgtgtctgtgtagaaagaagtagacatgggaaacttttcattttgttctgtactaagaaaaattcttcggccttgggatcctgttgatctgtgaccttacccccaaccctgtgctctctgaaacatgtgctgtgtccactcagagttaaatggattaagggcggtgcaagatgtgctttgttaaacagatgcttgaaggcagcgtgctcgttgagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgtgagaaacacccaagaatgatcaattaaaaaaaaaaaaaaataaccaaccagtagcccttggggctgctctatggagtagcttttgtttctcctctaataaacttgcattcactttactctgaaaaaaaaaaaaaaaaaaagaaagtggcccaaagacccagggtgattaaggtctctagaagattcttgctattctcactgagtattttaaaactacattttactacatgggaaactcctcagaaatcatcccagtgttcttcttttttcttcttcttcttttttttttttttgagactgagtatcgctctttcgcccaggctgaagtgcaggagcgcgatctcggctcaccacaaccttcgtctcccaggttccagcgattctcctacctcagcctcccgagtagctgggactacaggtgtgtgctaccacacctggctaatttttgtatgtttacaaagattaaatggggtgacaaaaattagatgggatttcaccattttggccaggctggtctcaacctcctggtctcaagtgatccgccatcctcggccttccaaagtgctgggattacaggtgtgagccaatgcgcccggccatcccagtgttattcttactgattgctgtgtgtgtgtgtgtgtgtttgtgcgggggtgggtgggtgtgggtgtgttttcttttctttaaaaagtttttaaaatttgagtcagggtcttgctctgttgcccgggctgtagtgcagtggcataatcatggctcatggcagcctcaaactcttggcctcaagcaatcctcccatcagcctccccaaatcctggaatttaacaggttggccaagagcagtgagccattcattgcacctgaccgtgtgcgtgtttgctaaaaagtgcagataacttactccctggtttgttttcttagtgagctcatattgtctaccttctaaagaccaaagcgtcaggactgcagagccccattctggctttggcaaacacgtggagtgagactggtttccacctgagaaataacccttctggtttccctccgagcatgctcctctcctgcgcgttacctacgtggtagggagatggtgttgcacactgcagaggctcaccccatagagggagaacttcctaaactgagctgagtcctggtgtcccgtgaaacactctacagagggtgcctgggggtgtctttctcggaaaagactcccccaggtagtgaggaaggcaggacctggcagagggagaacccagtgttgctggaactgaggccgtttctgcaatgaagctctggtcccaaattgagacatgaggtctgggcctttgcatctctgtttcttttcacttttaattttattttttcttttttttgagacggagtctcactcagtcgcccaggctggagtgcagtggtgtgatctcggctcactgcaacctccgccgcccgggttcaagtgattctcctgcctcagcctcccgagtagctgggattgcaggtgcgtgccaccacgccgggctaatttttgtatttttaatagagatggggtttcaccatgttggtcaggctggtctcgaactcttgacctcagctgatccacccacctcggcctcccaaagtgctgggattacaggcgtgagccactgcgcccagctctttttgcttttcgaaagtatggctatttgaaaattaaaatgacatccagggctcactggatttgctcatacaaaggcaggggcatctagaccacagagagtaatcggtgctggttcaatggccttgaacactactcattttatcaatgaaaaatcattcttagctctcattgtgctaattaacaaaccatctggtgtggattggagatagagctagagtggcttttgttgagtctttcaaatgtaggttctaatcacccctggaatttcgcgctcccaattccgcagcgctgactgcccctagaaagcaggctgaagctaagtgacacgtacagttggtgctgagggtttttgaagtaaattacaggcacgcttttcaagctctgagctcttgagaagaccactgagctcaaagttagtccaacaaataatgttcatcatacacagcatcttctgtttaagaaggcaggaaattggccgggtgcggtggctcacacctataatcctaggactttgagaggccgaggctggcagatcacttgaagtcagcagttcgagagaccagcccacatggcgaaaccctatttctactaaaaatacaaaaaattagccaggcatgatggcgtgtgcctatagtctcagctactcgggaggctgaggttgagaattgcttgaacccaggaggcggatgttgcagtgagcccagatcatgccactgcactccagcctgggcgacagagcgagactgtatcaaaacaatcaagcaaaaatggttgttgtcaacacagtgggtaacatctgaaccaaacaagccaggaaattgagcacttggttttagaaaacttttcatccaaaaagggttaacagatttataatgtgagtttaaaggggtcatctcgagttttcaagaacattcatttatgccaagcagctccttctccactgatatcaaagatattttactgtagagggcaccaaatacaccccttcattattttctccttttaaagaaaacaggacaaattagtgacctggaaggtttggataaaaacacatcagagaaatcattgttttgagagttcttttcagcttaattaattcacattggctgctcaaattcattttaggtctggaggcgattttcaaacaaaatgttatgacagagatcataacaaagatttggagcaaagatttctgtttgctgagctgtcactcaagctaaacagatagcaacagggaatctttaggcaaattaactttcccctgaatgggttcttttatcctgtccatctgcattcattcccatgggtacttcgagaccgagctaacaagtcagatatacataataaagaaaattgctcaagggaaaaaaaaatcaactgttcatttgggaaaatgtggtgctagtctaaatacaattctctattaatttcaaggggtctaaaaatctatcaccagttcttcaaaaagttaaacagacttatcctgtggcccagcaattacattcctaggtacgcaccccgaagaactgaaaacagatagtcaaacaaatacttgcacacaaatgttcatcgcagcactattctcaatagccaaaaagtggaaattactcaaaattccatcaacagatgaatggagaaacaaaatgtggtatatacgtatacaacagaatatcatccagccgtgaaaacaaattaactactgatgtgtgatacaacgtagatgaacctcagaaacatgaccttaagtgttaaaagccagacataaagatcatgattccgcttatgtgaaatatatgaatgatcccctttatacgaaatattcagaataggtgaatttatcaagacagaaagcagatcagtggttgtcaagggatggggaggggggaatgaggaatgaccgctaatgggtacggggttttctttcggggtgatgaaaatgttttggaacaagatagaggggctggtacgcagcatctgtgaaggtactaaatgccactgaagtgtactttttaaaaacgttaatgtggtgaggtgcggtggctcacgcctgtaatcccagcattttgggtggctgaggtgagtggatcacctgaggtcaggagttcgagaccagcctggccaacatggtgacactccgtctctactaaaaatagaaaaaaattagccaagtgtggtggcgggtgcctgtaatcccagctactcaggaggctgagacaggagaatcacttgaacccaggaggcagaggtcgcagtgacccgagatcttgccattgcactccagcttggacaagagcgaaactctgtctcaaaaaaaaaaaaaaaagttaatgtgtccagcacagtggctcaaacctgtaatctcagcatgttgggaggctgaggcaggaggatcacttgagcccaggagttcgaaccagcctggcgcacaggatgaaaccctgtctctactaaaaatacaaaaattagccgggcatggtggcacgcg

SEQ ID NO: 1251 - DNA, 28750 bp, Homo sapiens
tagcctagtggttcaactatatctctgctattcactgtctgagtgtctgtgggtacactgttaaagctctgtaagttccagtttcctaatttgtaaagttgggactagagtgaccaacctgtctgtttgcctgggacttatctggttttagcacttaaggcaatacatcctgaagaaccaccccccgacaacccctcaccacttcagtctcagatggttggtaaaccaaataataacagaactgatttcataggtttcttgtggtgattaaaggagacaatatgtttaaagagcatatcagaatgcttagtacataataaaggtccaaaagatgggtactgttatttacttctccctcacattcctctttttatttatttatttatttttttattttttcacattcctctttgaaaagcttatctaagaaaaaatggtaggagagcccaaacaggcttaacaatagtttgttggttaacaggctaccttaggttgaagaaagaaatattgataattaagcacactcatgtctgcattacagggaagttgatatgtaacacagctatgttctttttcttccttccttaatagcaattcccaacatgcatggctatcagggtcttacaggcacagctgtattcacagtgatcccaactgcaaggtacccccacctgctccccattaatttgagcccagtggttttctagagcagctatctttgaatgcaaatatgatgaggctgagaggaaaacagtactttttctgcatccccagtcatttttaactcttttccacgggccgttattatggggcttcttgttccttagctaagggcatctgcagtaacattctggcatctggggatgtgttccaaccaggtgaatatcagattcctacaacttcaaagcccaacctttataatcttctttgtttgcttttaaatactcataattttcatgtttaaacattttaagaccctatgaacaatgaggaacatgattctccccagacacagaagattttatctatattcccatctattaaaatctgtaagtaactggaacttttaaaatacttcctttccatcaataattccttcatacctggaaccacatatttctttagataactgggtgggaatttatatttttttatttgcaagagcttaaagagaagtttttacgcttagaattcctttgccatttaagtttctcattcagcacataagcccctttccttttggaaagtgctagataagtattatacttattctccatgcaggccacacctcaggtttgaaggtatctggagaatatatataaaagcagaattttgatacttagaaacagctaaaagtcatttagagcaaaatctgatgtataaaatcagcaatcaacttgagaaatgctaatctgatttttttaattggattaaactctctagaggcattgcacagaggagtgtaatgattaaaagcatatgatctggagtgtaagtggtgagatttggattccagctcaatcatgcacagtgttaaactctctacacctcagtttcctcatgtgtcaaatgggcataaaaattctaaccacatagggctacagtgaggaataggtacatgtcaagtacttaaaggtttagcattaattacttagcatgtattaagtacttaataaatgctagctactggtagacacttcagggaatgatgaggattggagagagggtaagagagcaaggctgtggcttacttaccattgtcaaccagagaatattccccttttcctgtttactcatattgggcttctgaagtaaggttctgtaggttccacagctaaacaaagtttgaaaaccagtaatgaagatatttatttatcaagaggaaaagataatcaagacctattgctaaatgataaaagcaggttggcaaaactgtatattataaagcaactctatttttctttttttttttttttttttgagatggagtttcactcattgcccaggctggagtgatctcggctcactgcaacctccccatcccgggttcaagcaattctcctgctcaacctcccaagtggctgggattacaggtgcccaccaccatgcctggctaatttttctatttttagtagagatggggtttcaccatgttgctcaggctggtcttgaactcctgacctcaggcgatccacccgcctcggcctcccaaagtgctaggattacaggcatgagccactgcgcccagccagcaatcctatttttcgatttatctatattgtctcaaaggatattaccaaaatgtgattattgctggatggtaaaatttttaaaaaattttatcctgcgttcacatgttggtaacctgtatttaatattttatgcaataagaatttaagtaaatatatttctcttaggaatttaaagtatatttaaaatatttttgggccaggtgcagtggctcatgcctataatcccagcactttgggaggccaaggctggaatatcactggaagccaggaaccagcctgggcaacataatgagtccctcatccctacaaaaaataaaaataaacattagctgagcataatgacatgtgcttgtagccccagatacttgggaagctgaggtgtgaggactgtttgagaccagaagtttgacgctgcagtgagctatgagctatgattgcaccactgcactccagcctgggtgacaaagtgagaccttgtctcacacacacaaaattttttttaagtcttcatttttaaatggcaaaagccaaaataaaacttgcaaagttaatatttaagctgcgacattaaacaaaaatttccttaaataaattgttctattttatcctagattgtagatgtaaatggcaatgttctacctcctggacaagaaggagatattggcattcaagttctacccaaccgaccatttggcctttttactcattacgtagtaagtgacttactaaataatctcattttctatttatttctcaagtgcttggtaacaatccctgtttgccacaaaacatacctaggataggtacttgaccctttcttgagagattggttgtcctgaatagtaatccaaaagacaagaaattgaagaaatacccaaattcttgctgaagaaaagcatgctggtcccctgaggccagatcactgttccaggtccacgaaggcaagaggaagggaccctagaaagaggacagcctcttaacatcccctgatcctctcaattatcaaacaaaacccactcattttcctgaaatccagttagtgctctttcttttcgggaagagtgagagggacaggggatgcgggggtggtgggattaagcaaatgtctttcacaagaggctttctaagctccttactgtttacaacaatattttcatctctaatcacagtatacaaattagagcaaagtctctatcatataataaaagatccagatgctacttgccagtgtatttgatataatgtaacagtatcttgttttttcttatgtcagacttgcagaaccaattctattattgtgtaaaacaaaacaaagcacaaaaacaaaacaaacctgtctgctctttattaggtgtcagtgctttcttttgactcttgagtatttacttctctcttttcctaccagcattatctattaatcaattagcaaaagacttaatttagtttactcctctgagctactgcaatatttattttgtaatctatctaagaaaaatctcaagatggaaacatgactaatctttgtaactgtagtttacctttcttctgtcgggctagctccatgctggaatttcatctttattttcacaatctatctcttcctaactctaatgcttctcaaaggagccaaacttttctgcttccttgaacatttaaaaatccaattgagggccaggagcggtggcttatgcctgtaatctcagcactttgggaggccaaggtgggcggatcacttgaggtaaggagctcgacaccagcctggccaacatggggaaactccatctcaaccaaaaaatacaaaaattagccgggtgtggtggtgcacgtctatagtcccagctatttggaaggctgaggcaggagaatcgcttgaacctgggaggcagaggttgcagtaagccaagatcgtactactgcactccagcctgggtaacagagtgagactgtctcggaaaaaaaaaaaaaaattccaattgaccagaagagttggattcaccataacaacaaaatgctatttgttttgcaggataatccttcaaaaacagcttcaactctacgaggcaatttctatatcactggggacagaggatatatggataaagatgggtatttctggtttgttgcaagagcagatgatgtcatattatcctctgggtaactttcttttccatatgtgcatatgtctgtgttaactgatcatcagtgttctagagtgaacctgccactcacctgtatgtattcctgccatatgtgtttctagctatcgaattggaccatttgaggtagaaaatgccctgaatgaacacccttcagttgcagagtcagctgttgtcagcagcccagaccccatcagaggagaggtaaaagaactgattcatgtcaactttataatttgttggcaatttaacacatacttacaaacagtagctcagtgaaacagaattaaccaaatgattcatttactaaatatgcaagtcagatagaaatatgctagtcagaaagaactgctacaaaataagattgaattatgagttgcagctctgatcctaacagacaaacaaaataaggctgaaaatacgtactagaaagaatttgaattccttccgtggtggactagggcaaagatggtgtgaatgccagtaacccaggctcacgtcaggatggggtgacagaagtcagctggatgggatcaaattgttacccagaaggtctggaaaccaacgaggtccctggtgtagtgaaggagaatgggctggcatcagatgtcagaagtgggaaccagaggctggaactgaggtaaccataagcagtcttggtaggtaaataagtagagatttcaggaaataaactctgaataacacaggtgtcctgaaagcccattcctattggggctgaccacacagtattttggcttaaaagtaccatgccaggcagcctcctgcgttttgcctgtgtgtctacaacatgcccctagggtttctctagctgagttacaagttctcacaagtatttcttcaagccatatcccttctaacactgaatccaagttttgaagatgacactgatgtcaatacaaatccagaactttctgtaccatgtattcaagctccttatctcaaatcctaggtatagggcttcaagcacagggcacagggcagagttagaaggtatccaatctcaggggatgaaataggtcctgaagtttaaggcaggccaggcacagtggctcacacctgtaatcctagcactttgggaggctgaggtgggtggatcacctgaggtcaggagtttgagacaagcctggtcaacatggtgaaaccctgtctccactaaaaatacaaaaattagccaggcatggtggcacacgcctgtaatccctgctacttgggaatctgaggcagaagaatcacttggacccgggacggggaggttacagtgagccaagatcgtgccactgtgctccagcctggctaacagaacaagactccgcctcaaaaaaataaaaataaaaataaaaaagtttaaggtaaaaataggagatgtgcatgttacagtggagggtggatctccccccaggactgattcccctaactgatctttgatgccagaagataccctgttaagtcctcctggatggcccaaagttgttccagatatagcccagtggctgggaattggtagtttgtcaagttgctaggatgacaatcgctatttactgtgaaagggtatattccaggcagctgagggcagggaaaacagtcagtgattattggcttgtctctttgctctgaacatcatcggcaaggtttcacgagtcttagctcttcctgtacttctcccctaccattagtcatcatcagttttacccacctagacaggtgcttactagggacaggatggtagctgagcctttcggaacagggttagcttggcagccacctgatatcctagcgtacaatataggaaaggtctataagtgggttgtggtcccctcacagctccgggggcttggcatagggcttggattagtcagagtgagggggaaagtgtggccagttttccaacagtggtaggctgcagcatttcctagtagaagatgtgagtgggtatctcaaacgaggtatccatgaacaaaacggccatgtgctccatgcctccctttctgctgccaggcctattctacctgggttaggtccttctctaggctgggtcctgccaggcagggtaattgggtagcaagttccagaattgattaaaaagaatatttggatttgaaataccattttaacattggaatgtgaaagacttgtggaatatgtgtctagatcactaggttcttaaatttttgggatcacatatctctttgagaatgtgaagaaaaccataggccactgttaagacttatgcagtgatggaaatgttctatatttgcaccatccaatgcgatagccatgcatggctatcaatcacttgaaatgtggctagtgtgactgagagtatttaatcttatttaattttaattgatttaaattgaaatagacacacgtggctagcagctatcatattgaatggcacagccatagacttttctcagaaaaatacaagattttgcatagaatttcatagagatttgaagcccacttatggattctgggttaaaaaataagacccaaacttcttgtaattctaagactacaactaagagctaatgtttttgatgacttactatgtgccaggcattatacatctatgctaattcatttaatcatcataatctcttttacagagaaggaaactgaggcacaaagagattacctaacttgtccaacattacacaacaaactgtgacttgaacccagctgttctgacttcagagttcatactcttacccatgttaggttgttccttgttaatttaacattttctgcagtagtttaaaaagataaaagagactatccaagttgtagaaatcgtcaatatgtgaaccagtattgcagtttttaaaataatttacctttgaatgactcacttacaacaagcataattttttaatttgtaaaaatgttaatgcagcagagctagcataactacaaatgcattttataaaatgtcaaaaagtgaatggaacaaaattatatccatagacacacacacacacaagggttcacaactgccgcatggcacatgtaaattaaaaatgttcaagtgttgttgttgttttttttcttagagacaaagtctcactatgttgcccagtctgctctcgaactcctgggctcaagcaatcctcccacctcggcctcccaaatgttggcagtacaggcgtgacccactgtgcctggccacaagggttttgggtaaagacaaaaatgggtaattgttcatacaatgtaaaactgcccactggtgaacagttttcaatatgtgaaaaaattataacttcaagtctttgtttctcaccaaatggctgtcctggtaatttgttgtttcaaataattccttttcaatgaaatctttactcccagatcaaagtggataggaaatgttgccagcttatctttaagctggacaaacgaatccttgaatttaataagatttcaggcacctaagtgcaggatacttaatcataaaaaagcttcaggggactctcctggaactgtgcctacagggaagcatcattccatagccagctccgggctggtaatctggcgttggaggtacatactagttgatgcacctagactcatgcctctagggaaggcagtaaatggcagtcctggtagtgccctaggagagaaaatgacaggactccaaatttacttttaaagggggctatgagggatggcctatctttctgtcttctccattacaggtccaaaaactaggcagagttttcaaaaacatttctaggaaggataaaatttggagaagaggatttgtaagcataaagtaataacatctttcttggcttctgccagttaaaggccaccatgatttccactcttgttcctcagggccatggaaatggatcagagcaacaaaaaaatagctgctggaatcttcacagccttgtataaagactgcatgttctctgtgaactgttcccttcaacaaagacatggcaaactcagcgtgactactgtttataagtaatcccccatgctgagggctaggctggatgaggctgggttgttacaggggtcccagaagctctcctgtattaggtacagaccaggaagtggctggcttaagagcacagagctgggatcaaactttattaaaacacactggcccaccccaccaggcatgtagattctcagagcaagcaaacaagacatactaaaacatacaaatgcataactcattttcctggtgtttcaaatatttattttaggtagtaaaggcttttgtcgttctaaatcctgattacaagtcacatgatcaagaacaactaataaaggagattcaggagcatgttaaaaaaactacagcaccttacaaatatcccagaaaggtaggcatcctaattataacgaatatttgctcagtgttgtggacaatttcaagtgtttatttttacattttaatgaatattttcttcacacatgctgcaccacatgtcccaaactgaactgatgacatatgggtaagaatcagaatctttgagattaaaatgaaaccctgaacctattttgtttggtcctttggcttactggactcacagtaaatacttaatatcaagacaactttcctaacaatacccttttccctattttggctgttacccaaaacccattccaaagactattctaattcttccacctagaattcataatcaaactgctatataattggctttatgtaaagataaaaatttccaggctaattttcttccccttgatgccaacaggtagaatttattcaagagctgccaaagactatcagtgggaagacaaaaagaaatgaactgaggaagaaagaatggaagacaatttaaagttgtttcattaattaccatatctataaaacaaacatagtatctgtcaatctctagaaaccacaagatgatggagaggtcataaaaactgtggtagtatgcttagaaactgttgatttaaaatatcttgtggttatgatatcagaggctaaattttgaaataaaatatttggcaaattcctccacattagtgtcaatgttcctatcatttcttaatataaaaataataccatcaattgctgattaatttttaaatgtatagtatagaagcagtttctgaaccagatctctgctacataggttttcaaactttagttgactaattcttctgatatgttgatatacaaatcagaaccaatgttcaagcctgaaataaaactaaagaacttataaaagtttttagaaaaatataaaatatcagttagaagattatgataatctcaaagtacaagaatctacctgaaaatagactagggatttttattagtcacattttttgcaaataatttaaaaatagtttagacttgtttcaaggtctaactataaaagaaggatcatatactattgttgcttattatatgtaatctaataaatactgtttacaaaagattacacttgtggttcctgaagaaagtatggtaaatgcagtaaacattaatatataaaataaaaataaaatagtgtaagatgttatcagaatactcatgtttggaaattcaaggaacaattaggattcatacatgaaaggttatcaattcctcattgaaggcctgagtctcaaagaatttttggtggaaatacttaaatttctgtcacaaatatggcttgtttctggagaactaaaagtgagtccccctgtggaatgagatggaaccatgctgttggctctttccttttgaagtgtttgttcccatttgaaataaccacaacattttctgttttcttggtatttcccgatagggcaacaatagaagacttttccatggttcggtccattattagaaacaacaagtctcttagatctccgaccacacttgcataatggaggtgtcattttcccactcttccatggctcttgtaggttaactgtagaagttaatatagatgggagacgcctccaggaagaacttcttactggggagcaatcagatgatgtaggcttttcttcatgaatagtgaagggttgtttttttgctggtgggaaagcttggggactgcatggattccttttggtaccacctgaaagaagaggatgtttccccaaaactaaaggatgagacatattggcattaactctgttgaaggtacttgatttgtgttcaggtaacttaaaggcagaaatatctgaacctggatctttggcttcttttacattataaatagtagtgtgaggactcttgtacacaatagacttagaagtctcagatttttgaggagtttcctctatgtctccaaagttttcatgacttgacatttccaattctttcaaaaccattaatctttctccagaattaaatgaaatctctaagtctgagtcactaatgggaactgtacagtctacgttttcctcaggctgagatgctggcagtaaaaccacatcctcccaatcagccaacacaggtaaacagtccagagtagagctcatttccaaatcagaaacatgatgaacagttggaacggtggtagaaacaagtaccaattctgaaccaactgttgaagccttagatttggtattaaatgcaagatgttcattttttccttgcttttgcatatagataggtgaattcaaggtaggagactgcaactgccccacagaagtagaggacttagtattaaaaagaggtaaggaacttttgacattgtgaagacttgcttttatattgttttttacttgtaattgatcctgttgtgcctttataggagaatttgcacaaattgacttcatttgaactttttcatgaggatttattatatttttaggctccttattatatatgctgggaccctggatgctaatgttacaggcagacatttcttcaacttgaattgtattcaaatttctggccagaatgctgaaattcttcttagtgggaacctatgattccacagacaaatgcaacagctttagaaactgtgcattcgttaatttcttcagtatacagttttatgacaaaaaagagaaatgtcattgatttataaatgactgcacacattaaatctacgtttcaaagaacgtatgactgtttatgaagtttgagatgacagaataaaaaggcaagacactactaaccttgttcaacgaccttgtaattttcattacacaaccatctctgatcattttccaagcaagaagggcagtattccgagaatcgtccaaccctgaggatacagatatcaaacactgaatttagtggtactagtactatttccttagtactaaagaaataacttaaaaagaaaaacaccacttgtgtagaaattggaacacagttttagttttatgaccatctactaattttaatcatgataaactggtcttggaagtggaaggctatggcagcattaccagtgaaagacaagctcgtccacatttatagaggaggatatgaaaatgtattagacagttccccaaaatgtggccagcgttctgcaggaaccaggatttgtgaataatctaatagtcttgttcagttttttcactagtccattctattatttgagcacttgtttaatctccatttgatttggctcattcttttcattcttcttagcaactagaaagccactagatggcagtgtatcttacaatagtttatgaaagtggtaatttgaaagtcttagaaacaatgtgaattgtttagattaggagttttttttttttaggctgaagatatcccttactaatgacattaccaaaaaatgaaattcatatgaagtattttttaaaagtcaaatggcttacataatttttaatgtatactaaccagaatgttctcgtcctgagaattctattcctacttcctgcaaggcaccacttagtccttttggttttctcctatagaaaagctaaccaataaaaaaagatatatttaaaagaagattactattttaaagactatgtattaaacacttttcataatttttagttctattagatttagaatgtgcttattttttgtgtgttgtttttaaatactttaagaaatgcatttatgtgaccagtacaaaagaaagtatcttctttgcagaaacccatgcccatgtgtaggataaaagttaatcatttttccatagaaaaaagtaaacatgcccccattttttaccattaccttgtaagttgctctgagatcaatccaagaatttaaaaacacaggttttaacagctgctttcttttacactcatactccaggcaaacccccaagtcccagtctgcattaggtacattaaaatagaacaaagtcaatgatgccagcattttttacttatgctgccaccatttacaaatagaatgctagaagatcatataaaatagaacagtatgatttcattgctctgctaatatctaaaaattattcactttatataacttactattaacaagttaggttgatgactaaatttcaaaatgatttcttaaacacccagtaaaaccttatttcagaaagaagagtaacatgttaaattacaaggactatattttctatattctaggaaaatattaatgttattgagaaaccaaacattttatagtaactggaaaccaaatatgactatcaatgctatcttatcaatgacacagtattgctattaatgactattaacagcaatgctctaacacagtcatacaaaaaacctactttaaatggctcattttttttttcttttaagtgtcaaagcataaaagcaaaggatgttgagctgatgaagactgtagaaaatagcataagagtgttcactaaatcatctttgcttaattcttaacagtggaactctagaaacatttttttaagttcaggcttaatattttaaggtatcccaaaaggttaatttaaaaaatatgtattaatttacttttcttggctaacatctgctaggcatttaaattttttttcctagcccagaagattaacaaacataattctaggttagcaagtataaaactagaaataaagaattacatagtggtaatgctacccatctgtgattaataggtataacttattctttacctgaccaagtaacaaatgcacataattttacttcagaagcagaaggctctgaaatcccagtagcaaaaataatgttcttctgttgctgaatcttatgaatccatttacagaactgagataagcaaatcttcagagggactccttcatcaacttgagcctgagtagagagtcacaaaagctgaattcaacaatcaaattccattattatttagcatgttttataactgtggagaaagattaatggttttaaaagaatcagaaatgccaagtcatgaaaacacagtgtactgtgggaagacataacaaagtggttctaactggcaaagagtttatttagtggaaagaggtaaaaacacgtgggaaagaaagaatatttagaacccaccaaggtaagaaagattaggttgataaaaactaaaatcacacagaaatatgatcattaagtccagactgacataaatcatagacaaatttgagtcacttaatttccataaaatcaatttgatcctcatttttataacattattcttcctttgctgtgtatttatttaatttttaaaatttatttttttttgagacgaggtcttgctttgttgcccagggtggagtgcagtggcatgatctcagctcactgcaacctccacctcctgggttcaagtgagtctcctgcctcagcctcccaagtagtgggaatcacaggtgtgtaacaccatgcctggctaatttttgtatttttagtagagacggggttttgccaagttggccaggctggtctcgaactcctgacctcagatgatccacccaccttggcctcccaaagtactgagattacaggtatgttcctttgctttttaaatcgagtcctgaggtgactcacgcctgtaatcccagcacctcgggaggccaaggtgggcagatcacttgaggtcaggagttcgagaccagcctggccaacatagtgaaaccctgtctctattaaaaatataaaaattagccagatgtggtggtgtgtacctatagtcccagttactcaggaagctgaggcatgagaatcgcctgaacccaggaagcagaggttgcagtgagccccgccaccttactccagcctggccaacagagcatgcctttgtctgaaaaataaataaataaatacataaatcgagtcctgaatctggaataacactaatcttatttatttatttacttatttattcatttattttcagagacaaagtctgtcacccaggatagactgagattatacctccctgcagcctcaaactcctgggctcaagtggtcctcccacctcagcctcagcctcccaagaagctgggactacagacacatgccaccaagtcaggctaatttaaattttttttttttttttttttagagatggggttctcactatgttgtctaggttggtctcaaactcctggcctcaagcaattctcgaacatcagcctgcaaagtgctgggattacaggcataagccatcatgcctaacactaaataaatctaatttcaaatggtataataacttttattttctttttgaaactgacttctgaattttaagatttgcatcatacctgctttatgcctgtcaattccatgcaaaattctgaaagaattggatgttcctgaggttgaacataagcctggaactcagagtcaatctgtccagttgatgtgttcagcaacactgctggaaactcaactaaatgaaagaataatcaattgacagttgaataaataatttttaaattaatcctgtaatcatcctaaattaaacatgttaccattttaattaaacaaccagttttcagtaaaagcatactaaaatgaccaaagcagtgtgacataaaggttataataaagttatgctaaagtcaaaatattgaagttatgagcatgttgtcttaaaagaaaacaatataattaaataaatataaaaaccatatggaatataaaatttactttttttgcaaaggcatttttttcagtttctatgccattgaggtgttgtatgtaatataaaacaactattttatataataacacatttaggtatttgagattttgctcttttttattcaacataagttttgcattaaactaccaatgcatagaccatcctgttttcttaaacttttggctgattcagatctataaactttaaagtgactcatctagtgccagctttggccattcgtagcccagacttacttatttcctggctatggtggtgcttcccatcattccagcatgtcgattcaaaatcaatgacaattaagtagtcaaacaactgctctgcaaaagatcaagttgttcttatgctttaccagtgctgaaaatgcaaggctacaaaatgcaaagaaactaagcatactactcactggatttgcttcttccgagatttccatttgctggcgcaattgactttctcctaattaatccaagctgcctaaaaatgtgaagcaatccaaatatgatcaatgaactcattcacactcctgtttgagtaggctaccaaactaatggtactgggcaacaatctcattatttattgtgactgaggggaaatcgaactggactttggctttacctgcacaggcctcgaaagtacatatttgcaaattaggctaatttgttggttttgtttttgagacagggtcttgctctgtcacgtaggttgcagtgcagtggtatgatcaccactcactacagccttaatctcctgggctcaagcaatcctcccaccacagtctcctgactaagactacagatgcatgccaccacggcccattagttttaatttttttttttttttgaaggcagggcctcactatgttacccaggctcatctcgaactcctgagctccagcaatcctcccacctcagcccctcaaagtgctgggattacaggcctgagccactgtgtccagccaatttacactaattttatgttacccttgttttacagtaatactgagtaactcatttgagttcctacaatcatttgattgtagaggtaaaaatgcactgaaaatcttatttttccccctgcattttttaagctcttgctatgtgtacagtgcagttttaagaagacaagacaatgtaggacatggttcagtcttccagtttaaaaatctgggtaaagaaacaaaagatagggccaggtaaagtggctcatgcctgtaatcccagcactttgggaggccaaggcaggtggattgcttgagctccggagttcgagaccagcctgagcaacatggtgaaaccccgtctctacaaaaattataaaacctagctggggcgtgatggtgcatacctgtagtcccaactactcaggaggctaaggtgggaggattgcttgagcccgggaggtggagactgcagtgagccgagatcatgccactgcactccagcatgggcaacagagcgagaccctgtctcaaaaaaataaataaataaaataaaataagaaaaaaagagaagagcttactgaggtcttaagtgcaagtaaaacaaactacttggtattagcaggtagagttttaactaggcagacacctcctgtagttttctgtgtttgctaagagtgggaagtgccaggatttgggaataataaatatcatttattgactgcttactacatagcaggtactaaaattaaactaagatgatggcctcctttaatcctcaacaagtgtagtagctagaaacttttcctacctatattttatggatgagaaaactgattcttaatttgccaaagaacatagctttggtatgtgaacccaagactgtccaattctgaagctcatgctatttgctattatattacatctttctagtaatcagaaatatgcacagcgcatccaggaatcagggaggacacaataattcatattgtgaattaaaaggatcactaggccaggcaccgtggctcacacctgtaaccccagcactttgggaggttgaggcgggtggatcacctgaggtcgggagttcgagaacagtctgaccaacatagagaaaccccatttctactaaaaatacaaaattagctgggtgtggtggtgcatgcctgtaatcccagctacttgggaggctgaggcaggagaatgacttgaacccgggaggcagaggttatggtaagccgagatcgcaccactgcactctagcctaggcaacaaaactccgtctcaaaaaaaaaaaaaaagatcactagaaaatgggtttgtaaaaagtagaggttcctcttcaaagacttccttccccgtctaattaggaataaatagtaacttctcttagagcaaaatttattcaaagacctgtgctaacattcttaaatatctgctagatataataaagaaatcaatgtactttatgttcttagctcccacaatttagcctaaatatttgccctggcatgcttatactggtccaatcaaacattaggtcatagcctgttcctcttccttacttaaaagtgtttttacctttctcagcattccacaagttacttccttcttcctttgttctcctctgcctttgcctcttttaaaaagttctatgttgctagtcagtcgggacaaatacagaatgtgaggtcccgttccagccaaaggaaaccggacacagcagtagggtggacgcgccacgttataaatgaccctgtctcctttgttcagtgtactctcctggcaaaactgctggcgagtgtaccctttctgcaggaagtaaaaatggccttactaaataaattaaatttaagtttaagttctatttctttacagcaccgaggaacgagcatttcgaacaggttgaacaccttgacagattcagtgtgtggcctgcctgagacctccaaccagtctgcagggcactgtcacgtccagtcgtttcccaaggcctaaaataggcaggcactggctcaaggccacacagtcaaggccccagggttcgtccgcctcgggctcctgtcaccctcgggtagaaggtggcccaaggctgaagaccgaggtccagggaggcgcctttccaaccgtgccagagagggcaggtcgcagacgccggggctgcggggaatagaggccctcaccgcagatgccacctgccgtgccctgctctgcggccaacgccagcgctggacccggagctacccgcccccgacccggaactccctcgagtaccgcgcgagccgcttggtcgccattcccgacactccttgcttttccaagtccagctgccggaagtcgctcgacttctacttccggtccgttcaaaaagcccgcgaggctgaggggcggttgttgttggcagctgtggctaaggaggggagaacctctgctccccgcccgtcttctcttctgcgtttcccgggctagggggcgtggggagtggttttaggcggcgaagccgctcggcagcaccttccttctttgccaggcagacgcccgttgtagccgttggggaaccgttgagaatccggtaaccgatgcggacggtaaagccgtttgggttagagcggcgcgggtgtccagtccgcggaacggggagatcgttggcaccttcgcttttttaggggaacggggatagttcggtaaactgaattgagaagcggatccgagggaggttgaaagctgtcaagcccgtgtagctctcccgctaggaggcggcacgcgggggaataggggcgctggagtttccccagctctacctcatctttctccacagccatggagccagagagggaagggaccgagagacaccccaggaaggtcagggaaagcaggcaggccccaaataagctggtcggggcagctgaggcgatgaaagccggttgggatctcgaggagagtcagcccgaggccaaggtgagcaacggggatcccgagcaggcggccctaggcggtttggagctcccggaccctcgcccaaccgccgtcgggggcactggattcgggcgggctctccgccctggcctctccgaacctgatccctgatcattaaaatgggaatgagtgtaataccaccttcctgcaacaaggctgtcattggctgtcactgggatagtgagtcggccgagtgcggtggctcatgcctgtaattccagcactttgggaggccgaggcgggcggatcacgaggtcaggagttcgagaccagccttgtcaacatggagaaatccccgtctctaccaaaaacacacacacaaaattagccaggcgtggtagtgggtgactgtaatcccacctacttgggaggctgaggcaggagaatcgctagaacccaggaaccagaggttgcaatgagccaagaccacgccattacactccaccctggacaacaagaaagaaatcacgtctcagaaaaaaaaaaaaaaaaaaaaaaactgggatggtgggccgggtgcagtggctcacgcctgtaatcccagcagtttgggaggccaaggcgggagcatcatttgaggccaggaattcaagaccagcctgggcaatatagcaaggaccccatctcttaaaaaaaaaaaacaaaaaacaaaacaaaaaaaaaactgcctgtacataataggaatgttcatcgatatcctggggcacaaaaatacaattccttgccctcgtgcagtttacattccagtagggcgggggtccccaaccccctgtgcacagactagtacctgcctgtccatggggtccccaacccactgtccacagctggcctgttaggaaccgggccacaaagcagcaggaggtgagcggtggccgatagaacgttaccccctgagctccacctaggcattagattctcataggaatgtgccaaacctattgtgagccctattgtgaactttgcatacgagggtcctaggtggcatgctgcttatgagactctaatgataaatgtaatgcacttgaatcaccccgaaaccatccccccagcccttctcccagtcagtggaaagattatctaacacgaaaccggtccctggtgccaacggttggggaccgctgcaataggggaataaaaaggctgattatccctatcatccttaccatttactgagaactaaatatacttcattcatcccttcagtcgttcattgggcttttttgtttgtttttgtgtttgagacagggtctctgctctgctggactcaggctggactacagtggtgtgacaaggatcctcctgtctctgcctcttacaggcatgagccactgcacccagctattcattggtttttattgtctgccatgtgctggggcactgacctaggtgcttggggtacatcagtgaatcaagttcactgccctagtaggtcttatattctagtgggcagagacaaatgataaaaataagttataatatgtgagagagggattagggatgtgatttttttttttttttttttttttgaggtggagtctccctctgttgcccaggctggatttggctcactgcaacttttgcctcccaggttgaagtgatcctcccacctcagttccaccaattagatgggactacagatgtgtgccactgtgccagctaatttttcttttttttgtagagacggggttttgccatgttgcccaggctggtcttgaactcctggacttaagcgatctgtccaccttggcctctgcaagttctgggattacaggcatgagccactgcttttttttgtttttttttcgtttgtttttttttaaagagagacagggtctccaactcctgggatcaggagattcacctgcctcagcctcccatagtgctggggattacatgtgtgagccactgcacccagctgaaaattttttttattaaagtgggattccagtttttttgcctatcaaatttgcaaaaaaatgtttaatgtttatgtggttagtgtaaggagattgacaatcacatattttgttatgttgaaacaatctcaaacttttagaaaagttgtaagaatagtatcaaaacctcccctcaaccaacatttgaaagtagttgctgacacaatggtctttttctacccaccctcaagatattttattatatattctctataaacctacataatcacaatgcaaccatcaaaattggaaattaccatggatatatcatgaccatctactcctcagatgccatccaaattttctgtagttgtttgaataacgctttttagcaataagatccagtctagaattgtgttaaatttaattgtcatgtctccatcaaacagttccttagtcttcccttgatattcatgactttactgcatttgaataatcctgggccaattattttgttgaatgtcccttaaattagatttgtctgtttcttcattgattagattcaggttatatacatctttagcaggaatatcacaggagtgatactctgctcccttgcagattgtacacaatttgatttgtcccattattggtgatattaaccttgataactagattaagatagtttctactaaagttctctaaagttatctttttctctgtgtaattttcattcttatttttttgagacaggatcttgctatattgcccaggctagtctggaattcctgggctaaagcaatcctcccacctcagcctcagtgtagctgaggttacaggcccaagccactgctcccagctgtctgtaatgtgcttcctcaaacactttgggcttatgcatttacttttttatcagtatgatgaactcagtggtacctattttgttcagtgtgttactatcttttactggattgtgatgctttaaatatccaagattttgtcattaagctagcttctgtggccttttgacatgacaacatcattctttgagcatgtcattactttctggcacaagaagatattccaggctcatatgtgctttccctgccccaagcctggaatcagtcatttctcttagggtacctggttctttttagtgtagaatgatatttagatttgggtgctatggtgatgttaatacagatgcttcttcacttaaaataagattacgtcccaataaatccatcgtaaattgaaaattttgtaagttgaaagtgtatacacacacacatacttacatttaaatatttttctgtattttacttatgtgaattcacatcagtatctccactttaatccaaatccagtaatacagggttcattctattcattctagttttctcctttttttttttcttttgagacaaaagtcttgccctgtcacccaggctggagtgcagtggcatgatctctgctcattgcaacctctccctcccagcgattctcctacctcagcctcctgagtagctgggattacaggcacccaccaccacgcctggctaatttttgtacatttagtggagatggcgtttgaccatgttggctggtctcaaattcatgacctcaagtgatctgcccacctcggcttcgcaaagtgttgggattacaggcgtgaaccaccgcgcccagtccattttcatatttgtaacttccttcactaacaatgagaaacccgacacccaacatcttcagtatatttgatcaatccttattgctgccgctgacccaccctcacaccctcttgactctgcttaggctctgtcaccctgcactggctccatcaccttgtaccaggtcatcttcctttgtgagcaccctcatcctatgacaggtggctgccaccatccctctcaggtttataccctcatcctgttcaggctttaaaccctgcaacaggccactactgtccctcagcattgatgccctccttaccctaaatagtttctgacatctgatgtcaggactcactgccctcccttccttcctgtatgggtgacgtccttgtgctgctgaggctttgacaccccacaccagagcaccctcctgcatgaatgtcctcagcttctgctcctagtcctggactgtctcctctacaggacaccttcctcacccaactcaggctcttgacatcccatgcctggcaaccagggttactcaccgccatatagactccatcttgctcagtctcaccttattaatctcatgtttttatttggtaaaaacaaactggcatattctttcaggagttcatttgaaccaggaattgatcctaagaaagtagatagatgtacaaaggtgtctgtacaaggatgttcatcataatgttgtttgtaatttaaaaaaccagtgttatcaatagggaatgtttttcagatatattataaattttcaggtaaatttagaaaatggactattattcaagtattaaaattgattttttttaactgatatggaaagatacagcttaagttcgggagtagggagttggtttcaaaaaagaatgattgataaaatccactgcgggctgtatagtatagagataagcctgcattccagtcttggttctatcatttatctgtctctccaatttatctgtaaaatggggatgatagtagtacacacttacaaagttgtgagaattaaatgatttaatgcatgtaaaatgatcagaactgtgtttcgctaatgtaagagtttaacattagcttaaggccatgggaatacattagcaataatatctaatgtttattaagtacttatgtcaggtactagcctcagtacattgtacttgaactatttcattggtcctcccaattatttaatgagataaaattataattactctctagatgaggaaactgagtcttagaaaggctatggcactggtccaagatgatgatgatggtccaaggctatggcactggtccaagcctggtgtttgaactcaggtagtatgactagggcttgagcttctaaccgctatgctctgctgcctcgcagaccaaaacgaaagtggtgattacctctaagttgtacttttattttaattatctctgaggtgacttttattttcgtttctctgtatcatttattttacaattctctgttaatgagtcttttgtaacaaacacgaattactttattaaacaaatataggctgggcgtggtgactataggccgggcgtggtggctcatgcttgtaatcccagcactttgggaggctgaggagagcagatcgcttgagctcaggagctcgagaccagcctgggcaacatggtaaaaactcatctctaccaaaaatacaaaaaaaattagccaggtgtggtggcatacatctgtggtcccagctactcaggacactgaggcaggaggatcgcttgagcctgggaggcagaggttgtagtgagcaaagatagcgccactgtactccatcctgggtgacagagtgagactctgtctcagaaaagaaaaaaacaagtataagttcaaagcctttttaaaggggttgggagctttgctgaactcttgttgcccaggggataaattctgattcattagcttaggccgcattgatctatgatctggctcctgcttccctctcctcatacctccactactatgcaacatgcaatcctggctccttgccaaaccatactacatgttgaatgcgatgttccctccaacatggcattgttttcaaggctcagcctcagtattttcatctcagtagccttccccaaactctctaacccctaaggcagttagactccttgttctcatagctttgtaatagcacttacccacactgtgttggaattagctattgctttctctccctagtagaatggactctttgagagcatgaattatgctttatttatcctattcctagcatgtaaccaagtatctataattcagttttgtgtcaatgataattactttattaataatgtcatacctaccacatattgttattttaggccatcattttcaattaattagcacttccttatgttagaatatacctgtatgttaaagtaatcagaagctagaataatttaacttgctttgttggtattcttgataaccaataatggcttgctacgccctgattaatctttgcagaaagcccgcttatctaccattttatttactgacaactgtgaagtaacccatgaccagctgtgtgaattgctgaagtatgcagttctgggcaaatccaatgttccaaaacccaggtatgagatgaatttaaatggtgggtattgaccagcggtttcttttttttttttttttttttacctctcccaagctccatcattcaaaccagaggtttcaaactggcttatcgacagtatttttttgctatgcagcatgtcctgaattttttatgatggctgccaagtgttaattctggaaattcctatataaaaatctacattttcttcttccaaaaactcaaagatggcagctatccctatattcccacatggcaataatttgtcaaagctgagtggtggtctccccctttatatgggacatgtatactacaatgtcctacctggcctgcttcccatatttacagtatctgtctggctactatagatattttagtttgtttcccgtgttgcagactcagctgaaataacaatgatctgtgaagaattccagttaatcttttttctttcttttacaaataaaaggcaaagagagccccggcatagtggctcacagttataatcccagcactttgggaggccaaggtgtgaggatcacttgagtcccagagtctgagaccagcctgggcaacatagcgagactcaggccctacaaaaaaaaaagagaatcttactgttctgatattgttggtgccattattaagtgtcttatgaaaaatattttgtatgtatgcaaataatacacacgtctttctgggggaggttgttatgaattggctagctacttcgagaactgtcttctccatcaacaattacagccatcagtctgtcagtttatctaaaactgtttttttttttttttggtaggttttatgtctctattgcaactacccaacttggccattgtagcccaaagcagccatacataacacatagacaaataagcatgactgtagttcaatagtcttatttacaaaaatgggtggagcaggatttgacatttttttggtgggggatggagcctcgctctgtcacctaggctggagtgcagtggcacgatctccgctcaatgcaacctccacctcccaggttcaagtgatcctcttgcctcagcctccagagtagctaggattgtaggctcatacaaccaggcccagctaatttttttgtattttttttagtagagatggggtttcgccatgttgcccaggttggtcttgaactcctgacctcaagtcatccacctgcctcggcctcccaaagtgctgggattacaggcgtgagtcaccgtgcccagcgaaaactgaatttcttaaagccagccatttgattccctggtttaggaaggaccgcagagtaggttggtatcttagggatgactttgtaaagtgagcttagttctgattccaaacaaaccttaataggactgtgaatttaaatgcattgcattttgcttggtattttactggatttgaatacaacaagtatttatctctagggatctttatttgaattctgtgcaataatggctgtcttccagttccaggcagacggtgaatggtgataaattctattaactctcactcactgcttttcctgcgccttctcccctatttcccctctatatgactgtaactgacttaaggccatctgtcttaactgtgttggtttgatttcttggcagctggtgccagctttttcatcaaaaccacctaaacaacgtagtggtttttgttctgcagggaatgagtcagctacacttttacaggttctatttggagtttggatgtcttcgaaaagcattcagacatgtaagttaagaatactttgtactaggggctgagtctgttttcccattctgagactaatacatgtgtcagggaccatgctccttggcaacctaactgaacaaacagtaggggatatagaaagcaaaaagaccttagaggcctcatgtagatttgtctctgattttctttggaaatctaggcaaactcttattcccaggttataatctgtagctcctaggttgatattgttctattttatttgggctatggtgttttcagaaattgtaaaatataatacaagctgagttttctacctctctttaaaaaaatcgcaagattgggcacccttaaaacagtatatggaactgaatagcagttgtcatctttaaaaagaggcacctgctgtccattttcccgtagcctcttccatttcctagtgacccatttcatccatttattcctgaaggcatttgagttggtgagccctaatttaacctccctgggtcaccattttttttgctttcatttattgagcacttcctgtgtatcaggctctctattaaccacggaccacctgctacacgtatcatctttaattatcacaatagtcttataaaatagatactttttaatttccattttgtacatgagaaactgagtaacttgcccgagttccagctagtaagtggtagggctgaaatttaagcccaggtgaacctgaagctgaagctctcaacctttttgccgtgtgataccatctattctgatggcaatggcatgctttccaatgaaataatagatttggaagaactttgaaaatacaaagggacttttcttgtctaagttgtatatttctgtaaagtttgtctattttacaatatataatcatagggatcagttagtgttgtgtggcttcatttacttagtcacttttctatattaaggaaacagttcttattttaaaatgctaacaattactgtctagaactttcaaagcactgaggtgacaataaaagtccaggcctttcacagtattttagctgttttcaaccatttttgtaaaacctgttaatatattttcagaaattccgcttgcctccaccatcatctgattttctagctgatgttgttgggctacaaactgaacaaagagctggagatctgcccaagacaatggaaggtatagctatgatgctggtttgatgctttgctcactctaaaagatacggatatgattgtaagtaggtttagcacaacaaaactcaattctaactagcttaagcacaaaaacaattttttttttttttgaaacgggggtctcactcttgtcacccaggtgtgagtgcagtggcgtgatcacacggctcactgcagccttgacctcccagactcaagcagtccttccacctcagcctcctgagtagctggggaactaccagca

SEQ ID NO: 1252 - DNA, 46731 bp, Homo sapiens
tcacaggtcaccttactctcacaggacacctcacactcacaggtcaccttactctcacaggacacctcacacagggcacacttcactcccacaggtcaccatacctcacacagatcacctcatactcacagatcacttcattctcacaggatacctcacactcagggcacacttcacactcacaggtcacacctcacacagatcatctcattctcacaggacacctccctctcacaggtcaccttacactcatctcacactcacaggtcgccacacctcacactcacaggatgcctcacactcacagaaccacatctcatatgcacaagacacctcacactcaggacacctcatgctcaaagaagcctcacactcacaggaggtccagctgtctgaggcaaaggctaacatgaccctttccagacaaattgaggatggtcatgcctagcatttttatacacctagttttgaaagcatttctcatctgttgtattctcacagcaccccgtgagtttaagttcaggtggccaacagtttcttcagcaatcacttttttctgtggagtgcttttgctgtttgtggaatattttgcatctgctactgcaccctctccccgtatgtgtggccaccctgtcagaggtggagctgtggctcagagcctgtgtacctcgtcccaggtccacagctcagcgacagaagagtcagggttgaacctcgggtgttctgacttgggagcaggaaatgtgtggtcacccatagttccagatgtcctggggaggggccaagattagaagaaacctacctcagctccagaggaaagtctggcttcctgagcccaccccgccagacccaggtccaagtcccccaaccccagttcatggtgtgtccagtgcttaccgttgggtgctctggtgaaggtgcatctcacgaggcttgctctcttgttccttcagaagctgttctggatttcttacagtggtgagtggatgatcaccaccagtcctgcctgcaacccttctcagcttactgacaccagcccactccacagatggggaccagtgtgcctcaagtccatgccagaatgggggctcctgcaaggaccagctccagtcctatatctgcttctgcctccctgccttcgagggccggaactgtgagacgcgtaaggccccactttgggtcccatatttgcagagggccctggggagctggtggaggtggcctggccaaccgggctgcagggtgcacaacctggtggggtgtgtaggccgggcattcagggctcagccccagttggaaattggtctaggtgaccttgaaatcccttccagtctgaggtctttgacagggacccaaggttctgattatcagactcagtggccccttgggctcccggccctgggcaattctcagccctcgagatggcccagctgagagtccctgtgtccctgtcccacttccacatcccaccacgcaggaccgcttggtaaacttccccttctctactttccattacaaaggtttgaggggtttgttttttttttaaccatctgaatattaaattatcacaaagtttgaggcccccaacctcccttgggttcagtaattcactagaaggactcatagaatccactgaagtggatacactcacaggtaccgtttattacagcaaaggatgcaggcttaagtctgcagagggaccaggcacaagcttccccttgtcctctccctgtggggtcatgtggacagtccttaattctcccagaatgacgtgtgacgagacgtgggaagtactgccaacttgggaagctctacgagccccggtgtccagaggttttatcagggctcaatcacatagacccagctgaccacccgcatggctgacctcagtctcagcccctccagaggctacgccgatagtgcggcccaaggccccaccatacatcacattgtcagctagaccatccagcatggctcaaggcccaggtaaacaccaacattccctcaggcaagaccttccaagggcttagcggtcatttcccaggagccaaggcaaaggctaccctttctctggcacagcagttcatccttgaccacccaagaccacattcttacactgaatgagctctcctgtgcagcagccattttcttctctaagcagaagagagcccagcaagctggaggaggctgaagagagaggcttcctgctggtcatctgggtccagaatgcctggagatctctgctcagccctggtgcccagcagccctggtgtgcatcctgcagggcaggccttcccgccggagtcctggacttgctcagggccactccccttgcccatgtcaaccaaagtcaggctgccggttctgcttcttctgtctgagcccatgaccagtgctgggactaactgtccccaggcgggctcacggtggtacgaggccagcttggagaactgtctcagctctctggtcctctcgtcagttgggtctctgattggaaagtcccttggacacttttaccatccccattggactttcactttcccccaggctcccatcagctgctcggaagagtggtcaccctggaggccactgcccaccagccaggcaccccccaaatgcaaccgcagccagcactgccagccactggcaaggctgttcagacatgtggctcctctgatccacgccttgtcctttggatcagtccacggagcaggtggtgccaagctcaggctctgtcacccacagctcagtgccaccttccaggcagaacaccactgctgacccagggcatggccaccccgggggctggctctcgctgacccccagaagcccctctcagggtgtccccttcctgtccccagacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacaggtgaccaggcttcatgtcccagtcccagatgacaccagtccctgtcccactacggattatcttactggacaaaagacgggtgggagtggcttcacatctactgagcactaactatgcactgaccaattgtgaggtgggatctgggcaccaagggtggcacaggccagagcgacagtgactaggatgggcaccctgggggcaatccctgaatggcctcaggccccctgccaattctaggcagaccaggggagccaagcaaggcactatctcacgtccaactcccactcgcaggacctccgccagggttcatgaatctacttcggcacagccaatgtctgtactgactgctgcccactctgcattccaaaactcgtaaaggctcctgggaaaatgggatgtttctccaaaccagcctggaacgaatgggctgcacttccaaaagcagggacaccccacacccactgtgtctcaaagaggcggacgtgcccaccctggccacacagcctgggactcagcctgccacctcctcgggcttcctttctggcccaagaccttgattgaagcagatcaaaactaagcatgggatcaaaacaacacagtttgattcatctttaggtagaatttcattcaccttctactaaagtcaaacaacacatcttctccctgaaaagtgagcagagggcggttttaagacgtaagccctctgtttcctccaaaaccagccctgaccattgtctcctcagccagccacttcttcaagggcctctcatggccgggccccaccagtcaggcccagccgaggccctgccttccaccacccctgggccctgggagctcctgctcctgggggcctcccatagcctcggcctcaaggcctctcagaggatgggtgtttctgaatctttcctagtggcacgttcatccctcacaaatctctgcatctttctgacttttgttttacacagttgaatatccatgtggaaaaatacctattctagaaaaaagaaatgccagcaaaccccaaggccgaattgtggggggcaaggtgtgccccaaaggggagtgtccatggcaggtaaggcttcccctggcttcaggattccaagccctgagggtcttgaagccttttgaatgtgaacaacagctctggaagggaaaatgggcaggtcagccccaagcccaccaggctccaagtcagcacacctagcacctccagctcgcggcacccccatgcttttagtggggcaaggaaggagaaaagaaaacgacactcactgagggtctaccctgtgcagagaaccctgcgagatgccccatccgagttgtcacgtcgtcctcacggttactctttgaggtgggatctttgcctgatctttgcaaaatcaggagcattggatcaaagctatgtgaagatcctgtgaggtgaacagtgaaatctcacagcgacatttgtattcttgggccgtgcccaagagcacgtctcggctagagaggggcacagcctcccagagccaggtctgagcagctttgcctgggagggatctgcaaagaccccaggatttcagaaagaaattgtgcaatgccagaggttccttggcatgcccgggagggcgagtcatcagagaaacaatgacagcaatgtgacttccacacctcctgtccccccgcccaggtcctgttgttggtgaatggagctcagttgtgtggggggaccctgatcaacaccatctgggtggtctccgcggcccactgtttcgacaaaatcaagaactggaggaacctgatcgcggtgctgggtgggtaccactctcccctgtccgaccgcggtgctgggtgggtgccactcttccctgtccgaccgcggtgctgggtgggtgccactctcccctgtccgaccgcggtgctgggtgggtgccactctcccctgtccgaccgcggtgctgggtgggtgccactctccgctgtccgaccgcggtgctgggtgggtaccactctcccctgtctgaccgcagctctcaagtgtctcaggggctgtggctctgggcttcgtgctgtcacttccacagacagacagacatccccaaaaggggagcaaccatgctgggcacgactgctgtggccaccgtgctctcagccactttcccatgcccaaataaaacgataaaagactgggggcttctgcccatcctgcctcacttgaccaagagcccagaagaggatgcgacacccagggcctcatgggaccaccggctggcaggggttctgctcactgggtttatgggtgagacgagcactcccaggagggccactgggccgggaagaactgtggagaatcggggcacgccctgtcctcccagctgccagggcacagcatcccttccccacctcaacacccagaccccagattcaccccagttcacttgtccccacacgagccacaggctgccacctggggcaggctggccccaccttggggttagatgcaggtccccttgccccagaaggagactgcagcccctgcagacctagaaatggccacagcccatccccatgcaccagggggtgaggtggcaggtggtggaaagggcctgaggggggcttcttccttccaggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtcctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttccctagcccagcagccctggcctgtggagagaaagccaaggctgcgtcgaactgtcctggcaccaaatcccatatattcttctgcagttaatggggtagaggagggcatgggagggagggagaggtggggagggagacagagacagaaacagagagagacagagacagagagagactgagggagagactctgaggacatggagagagactcaaagagactccaagattcaaagagactaatagagacacagagatggaatagaaaagatgagaggcagaggcagacaggcgctggacagaggggcaggggagtgccaaggttgtcctggaggcagacagcccagctgagcctccttacctcccttcagccaagcccacctgcacgtgatctgctggcctcaggctgctgctctgccttcattgctggagacagtagaggcatgaacacacatggatgcacacacacacacgccaatgcacacacacagagatatgcacacacacggatgcacacacagatggtcacacagagatacgcaaacacaccgatgcacacgcacatagagatatgcacacacagatgcacacacagatatacacatggatgcacgcacatgccaatgcacgcacacatcagtgcacacggatgcacagagatatgcacacaccgatgtgcgcacacacagatatgcacacacatggatgagcacacacacaccaatgcgcacacacaccgatgtacacacacagatgcacacacagatgcacacacaccgatgctgactccatgtgtgctgtcctctgaaggcggttgtttagctctcacttttctggttcttatccattatcatcttcacttcagacaattcagaagcatcaccatgcatggtggcgaatgcccccaaactctcccccaaatgtatttctcccttcgctgggtgccgggctgcacagactattccccacctgcttcccagcttcacaataaacggctgcgtctcctccgcacacctgtggtgcctgccacccactgggttgcccatgattcatttttggagcccccggtgctcatcctctgagatgctcttttctttcacaattttcaacatcactgaaatgaaccctcacatggaagctattttttaaaaacaaaagctgtttgatagatgtttgaggctgtagctcccaggatcctgtggaattggatgttctctccctgccacagcccttgtcaatgatatttcacagagaccctgggagcacctgctcaagagtcagggacacacgcatcactaaatgcaagttcccaggccctggctgcagtgggaggacctggcaagctgcactcttgctgagtccccagggtggtggaagaagaatgagaaacacatgaacagagaaatggggaggtgacaaacagtgcccccactcagactccggcaagcacggctcagagagtggactcgatgccatccctgcagggccgtcctgggcaccactggcactcacagcagcaaggtgggcaccattggcactcacagcagcaaggcaggcaccagcaacccacctcgggggcactcaggcatcatctacttcagagcagacagggtctatgaactacagccgtgggctgcttccaaggcaccctgctcttgtaaataaagttttatgggaacacacccatattagtgtccatggagtggccgtggcagagacgtccagccggacagaccagctgacccgccaagcccagcatggttagtgtcaggacctctgctgaagatgcttgctgaccctggccagaccccggttcctaatgccccctaaacgggacgggagccagtggcgggccctgatccaggtcagagctggctctgctttctcttttgtccgagtgaccatgcctcagtttcctcatgtgtaaaacaggagcccaccgtgatgcttatggtgggatgagatcagcatggatggaacaaggccctggaagggcccatgccatggtcatcgacagcaaagccactctgcagacagatgcttcagtgaattggtagaaaattctgcaaccagaatgcccggggctcctgagggcctaagcccagcccagggttctggaagccactctgacttcttgggagtggaagttggcaggactcttcctgggaagaagcggagggtggggatgagaggacagttcaggagcccacccagacccacaggaggaaactaggggagtcatgcggggtcctggtggagcgccagcctcccttcctgccaatgggaaatgcaggcgcccacctcatggtgctgccggaggagggggcccgggactccccagaggcttcgctgaagggcctgggcgcccccaaaggctacatgtttcatatgggacgtgccacctgccacggctcagctccagctttctgtgagtggcgagatagaatacggggaggccactggccatgggcctgggacagggtgggatgaggcggcaggcttgggccaccaaagccagcatcgccacccagcattgatgacaaagactgcgtgtctgccatgagcatcctgctgttggtgcacacaccgcattggtctctccatacaaacatgcctagaggcgatgtcagagggtggagaccaggagaggcaggagtcagacatctggtgccaccaggaaggcccttctcagaggaccaggctgtgcgtggtgcccgccgtgggaggccagcctggcgttggcatccagcatcatcagtttgtgcagtcgggtggggctcagtgagtgcctcctgtgtgccaggcacaatgacgcacaatgtgtgcacaccaggctcatgtgcaggtggctgcgagacagggcgacccatcaaggcagatgcaccatgaggcagtggccagtgctgtgggtgttaggggcattgctccccggccactacggcatagcaggcagtgatcgccacactggccaagctttagaccatttattccagagaccccagaggcaaaaagcccggctgcacctcccagtgactcccacagccattgagcagagacactcaggaccttgtgatgggaggtttctgcactggagaacgagcccagaagccctctcagcctcggaacagtgtggccagtggtgggcaggtcaggaggggcttcagacacagcctgtccctccagatggtcacgggaaggtcactccccacagaagtacgttttggggccatgcgggcacagaaggtttgggggtgggtggggcaggtgccagcctggcctgtgggaggccatggtgcagatgccaagccccccccgtgacatgagaccacctgataccacccagagagtggctgtgagcggaagggcccgcccagaaacaagcagggccttggggcagaagtcctgggctcagatcccacgctcactgccagcggcctcggctcaggcttctgcgctctctaaacttagttttctcttctggaaaaatgatggggaaaatgatatttgtatgtgaggactgagagttaaatgtaaacatctggaaactacaaaatgagcacgaaatgatgtttttattcttagaacagaaagtccccacacccgcggccctggtgactgatgaggatgaggttctgcggggcctctctggccgcccagctctgcctggggaaggtggggccagagtggatgtgttcccagcgtggtcactcccctgcctcgccagcaggtctcggctccaatcaggaggcctaagccaagtgataagcagccagacaacagccatcccagctggggcgtggactttgctccagcagcctgtcccagtgaggacagggacacagtactcggccacaccatggggcgcccactgcacctcgtcctgctcagtgcctccctggctggcctcctgctgctcggggaaagtcgtaagtgcccctcgcccttcagacccaaaagcagcgccagggagcagggaggggcggcagttggggaaaccctctcatctctgcagcctggacggtgggtgccttgagtgctgccagaggctgggctcggatggctgggcttggcctttccagccaacggcatcctcaaggccagctgtggctccctggggctgagagtcagacgggcggatcagaggtcacagagacaaaaacacaaggacagagtcagagagagaaagggagagggaaggagaaacggagacacagtgagatgggaggccaagaggcagagacagaggtagaaagacggagacagagagagagggaggggttggggcaggcagagacaggacagttagccatctgccaccacagggaggcacaggacgaggggcacagcagaggagctcccagggaggaggaggctgagccgagccagtgccaccactctcggactggctccgtcggggaaggagctgcctaatgcacagctggacaggtgggggcagcagggctgtccaggacccccgggtctgtccaaaagcagaggcccagacaggacagaagccaggcaagcctggggacagcggaggaagaggaggcccctctggtggggacacgagagacagggaccctagacttgtttgcatcctggacaaagtggacaggcaggggcaccaaggggacccaggcctgggaagggaatgtgtgagggagagacggagcagggggagaccctcgtggggtggaaaggggagacccctgggaaggctgagtggatcctcagtgcatcactgacctaaacggcccctccgcctggtgacttggagctccagtcacatcacacgggggtcttctccatcccaccctcaaccccctgccctccccagcctctgtcccctgagccacatcttcctgtctcccacgcggaacgggactcccgtcttcatggggtactgtgtggctccaactcgcccagccttcttcctccccctcaggccacactgccccctgcaggagcccactgtgatgcttgtggtgggatgagatcagcgtgggtggaacaaggccctggaaggacccatgccatcatcatcgacagcaaagctactctgcaaacagacagatgcttccgcgaattggtagaaaattctgcagccggaatgctctaggatcctgaggccctaagcccggcccggggctcccgaggccctaagcccggcccgggactctggaagctgctctggcttattgggaatggaagttggcaggactcctcttcctgggaagaagcagagggtggggatgagaagacaggccaggagcccacccagacccacaggaggaaactaggggagttatgcagagtcctggtggagcgccagcttcccttcctgccaatgggaaatgcaggcgcccacctcgcggacctctgggtccacagggtattggcacccttagctgtgtgatgcgggcctggctcataaccatggcctgtggtgtccccgggggccggcctggaccctgggtggacatggccagccccggagagccagggccaggccatctctctcccctactctgcctcagaggcctcggcagctgcactgtggggtgggtggggctgaacacaggtcccagaaggtcccactcaggaccctgctgtgcacacttttgattttaataaaatcagaatgcgcacagcatctgcagtctagcctttaaacgagcacagctgtcctggcagtcacggaagttcttctggggcggtgggacctcagcattcctttgctggtactgctacaagaaaggacaatggaccaagtagcttaaagcaacagaaacatttctcccacagctctggaggctggaagttcaaaatcaaggcgtcagcggggctggttcctccagaggctgggagagagtctgctctaggcctgtttcctggcctcggggtgccagcggcctcacagcccatggcttgtgggagcattgctcccatcgctgcctccatcatcgcatggggttctcaccatggctgtttttctgtcttcttttctctcagaaggacaccagtcattggatttagggctcactctactcccataaaatgtcttcctaactaaatacatcacaaaagttctatttccaattaaggtcaggttctgaggttctgggaaagacatgaatttggagggacattattcagccctgtcctgccacctgtgagtgttttctgcaatccaactttttattttaataaaatcagaatacgcagagcacctgcagtgccagcctttaaactactgctgttgtactggcaatcattaaagctacgtggcttcagtttcaatctttacattcaacaagtttaaacccattcttcatgagtttggaccttactgactgaaaattttgcttgctggtaaaacttgctcaaatgcagttgctgactgtggaattcactgatgttgccaaaacaacaaacacaactgtgtgctcgaggattgcaatgctcccaacagcttctgaagaaacaaaccacacgacaaatgtctaccaatctggatgctccatatcagagttctagagtgttccattaatttcttgagacaagtgcctaaaaaccttgttttaatttcgttttgccaaaatcccattttactcacatcagaaagtgtggccacgtggcccagacccggcctgctcagtctgactgaagcgttgatgcgactcagccataacagatagcagaagcgcccagattcagtccagagggctgagccaggcacgccatctttccttcattccctcaacacatattggttaagttccggccgtgctaggcacgggcatacagctgtgaccaaacacgtcaagtctttttccagcggagggaaggataagcctgtcagcatgtaatgtcagagaggggttgggtgctagaagacaaatagcacagtgtaaggggatgaaagagacacgagtgggggcaacgtcagagggcgtggtcagggagggtgtctcggagggcgctgggcctgagccacttgggtatctgtggaaagaatgttccagacagggaggtgactggtgcaaaagtcctggggtgtgagtgttgggctcagccagggtcagcgcagagcccagtgtggcagagagaggtgaatgagggcagagttgaaggtggtgaggcctgggaggcctggccatgggaagaccctgggctctgttctaagaccactagaggcagattctgggtagtccttgacttccttgcatcaccctttccaccccgtgcctgccacctgtaccctcttcctcacacagtccagctcaaccttataggccgtgtcctacccccatgagctggggagagctgagcaggcttcagggagatgggaaaaggcgggaactggacaggggctgcaaaggaaaggtgacttcttactggtcaatcagcctggggatgctcgggggtggatgccaaggggaacagagctgtggccgctatcacagaacagcgagttcctctaagaggtcagaggaggcgcaagggatcgaccagagacagtgagggcgtcaggctccagttgagtggggaccaatccttgtggcaagtctgtgaaccatcactgtggctctagggtagcagagaaaaaagcaggcatatgtccatctggccacaaggaaggagaccaaggggaagagagaaggtaccaagagaggtgttcacatggaggtgcgtcagaacaccgagggcaaggcagaacgcggtcttcagaccccaactggagcccaggaggcccgcgagtcccagtttgggaaacactaagccaggcttggataacttgtctgaggctgtggtcatcccaacatgagagccagaggccccaagggagatgggcattccccacccctcagcttcctcagtgccttttgtggagtggaggtgacatgaggctgcaggttgcagggagccacgtgtgggctgcatttcagagcaagtgtgtgggagtggagcagacacgcagagtaatggggcagggtcaagaaataataaatctaagtctagcgttggtgggataatgtcggtgtcactaaaagaaatggggaatttggaaggtaaagtaactggaggtaggaatgaacccaagatttactaagcaccttctgtataccaaactcaacactaggagtttatacaatctttaaaacagctctaagagtagatattataattcccttctgccaataataaataataagtgactaaggtgtttttgaagctcaagattgcttgattctgcagtcttgttttaaattttggacatggagagtttggagttctgagatgagggaaggcatctgtcatagtgagagagctgaaaacatggagctcaggacaaaagtcagtgctagagagatcagttggaagagttatctttattgtagtgagacattgaatttttcagtggaaaaaaagcacagaaaaagactacagagggccaagaaaagaaactgaggctgtcaaaatgaaaagaggaggaggagtgggtgagagacaaaggagacacaggcagagagatgtggacagcacagcccacagacacacactctacaagggacacagactctcggatccagggcattttaaccagcagatcaagactcatttgccagtcatgaaatcaactcagtatttttttttaaaagagtagaatcaaatagaaaactttgtactaagtactgtattttaggaaatactaataaatactatttcttgaaagttggcatgtatgtgtgtcctggcacttcataaattgtactattatagtttgtaattgaaacagcatcaccaatccccacataacaaagagcagagaccttaaagacgagtggggccaggctgaaggggcacagcttgagccaaagcacagaacagtgggctgaaagcaccctagggagggagaattcaaggaagggggcttgggtggccaggctgagccagcgtgagcatgtgaggaggctggtgagctgattgggtgggatgtgtctacttctccagagaagggtgcatgggtctagagcaggtgcctcatgctgtacctcatagagaactggggggaggggggaaatgggcatttccctccacagcccccaaagtgcctgaggaaagtgttgataaagaagccaaactctgtaaaatatttgaagagatttattctgagccaaatgtgaggaccacgacccatgacacagccttggaaggtcctgagaacatgtgtccaaggtagttgggtcacagcttgattttatgtattttagggggacagaagttacatacagacaccaatcaataagcataagttgtacactggttcgttccagaaaaggggaaggtgggggcttccaggtcataggtggcttcaaagatattctgattggcaatcagttgaaagagttattatctaaagacctggaataaatggaaaggagtatctgggttaagataagaggttgtggagaccaaggttcttgttatgtagatgaagactcataggtggccacccttagagggaatagatggcaactgtttcctcttcagacctttaaaaggtgctacacacatggccaggcgccttggctcatcctgtaatcccagcactttgggaggctgaggcaggtggatcacttaaggtcaggagttcaagaccagcctggccaacatggtgaaactccatctctactaaaaatacaaaaattagccgggtgtggtggtgcttgcctgtagtttcagctactcgggaggctgagacagtagaatctcctcctgaggcaggacaatggcttgaacctgggaggcagatgttgcagtgagctgagattgtgccattgcactccagcctggatgacagagcaaaacaccatcttaaagagaaaaaaaaaaaaaaaaaaaaaaaaaggtgctagactctcagctcagaaaaagacctggaatggtaagggggttctctacagaatgtggatttccctgagatagctttgcagggccatttcaaaatatgtcaaacaaatacaatttggagtaaaatcatttattttagggcctgctatatgtcatgtgatcctatactagagaagtcaggttggaaactggtatcttattgctacaaagactctgtttggtcagcctcaaggtctcttaacgtgaatgctggtcagctgtgcccgaattccaaaggaagaaataatgaggcgtgtgggacctgcttcccctcatggcctcaactagtctttcaggttcctatggaattcccttggcagagaggacgggtccactcagtgagttgggggcttagaattttatttttggtttacaagagagtgatccgccttttgtgatctggatatggcaagggacatggcagtcagggagcataggtgagggggagcctgggtgagggtgaccagagcttttaaccctgtcctccctgccttccagtgttcatccgcagggagcaggccaacaacatcctggcgagggtcacgagggccaattcctttcttgaagagatgaagaaaggacacctcgaaagagagtgcatggaagagacctgctcatacgaagaggcccgcgaggtctttgaggacagcgacaagacggtaagggctggggatagcctggctgttggtaaggagctcaggccacagcgccctcgctggccccgctgctccgtccatccaggggggcggcctggaggaaggggcagcgtgcgcgaaggctttcaggggcggggcccagcaaatcgaggcctcggcggagtcctgcccacagggacatcagtgccgcccccgcgctgactccttcccggcgaggactcagcggggagggatgcgcccaagtcccttgagggtcacagggcttctgccagagttaagttctatttaaaaataaaatgttaacctaaaaaccaatagtcatggtctcggccagcgcctcgccgagttgcagtgagctgagatcgtgccctcccacgcccgcagcccgcgtcctgccttggcctccgtagtcgctgagagccacagcctagagcgccagcgcgcaggcgcacaactgacgccaggccacgaacccagtactgctcctgcacagcagaagcactagcactgaggccgggcggcgaacccggcactgcgcctgcgcagcaaaaggacacgcactgaggccaggccgcgaacccagcacggtgcctgcgcagcaggaagaccggcatccacaccggacgacgaacccagcatcgcgcctgcgcagtaggaggagagcaatgccaccaggccgcgattgcgcagccgcagcagccccgcgcggaagacgctaccctcctctcccccgaagaggcggggcttcgaacgaacctggaaatggccgaggggtctcgacttcctcaccccaggcatcaggaaaggtgcctgcaggacagggctctgaagtggaagtgggcggtggtgatgccgaactgacaagaatgagctgaagagaagaaagtagccgagaagggggccaagccggagctcagtgagcaacagctaggccagccgcggctggtgccatcagccacaccactaactgtggacccaaatggaaactttgaggccccttacaggtcccccagcgcaggccaccgccgaaggttactggggaagacccctgcagcttccatgtggacattactcgcttgcttcatcccggagtgcagtcacctgcagcctgggaccacctgactgatgtcaccctggagatccatgccaaaagagctggggaaagttcaccttctaatgacccctgcggaccagggtgaagttacaagttatggccaggtcaaggaattataagtcaataaataaactgcctcagggagacgtactcagagtccaggaaaatctaggaaacaccaagaagggcgagcgcagcatcagcccctgcaaaattgcactgctgcctcctggctcacatgttgccccatccttactttagcctcaaaggcaaggagacccaatattatttgagtacttggatttgatcctgagtgactttctgagaaagcagtgtatcatctgccctaagatcaccacatatatgacaaggtttttggatgagttgagatttctagacattgaaaccctcatgatgaacgtcatcccgggtagcaggggctaagcctttcatcacctgctacaacaagctggacattaacttgtatttgagaattgctccaggactctaccttcagatgctggttagtagcattgactggatttatgaaattggatgccagttaaggaataagagaatgtatttgatttgccaccctatatggtctgtgcagactgtcatgatctcattgaaatccaagaaaagattatgtcagggatgaagcacatcacaggtggttacaaggtcacccaccatccagatggctcagaaagccaaacctatgggttgacttctcctcacccttctggagaatcagtgtggtagaagagcttgaaaaagtgctgggtgtgacgctgccagaaactaacctctttggaactgaagaaactcaaaaaattattggtgatatctatgtaacaaaagcttttgaaagtcttctacctcagaacatattcaggcgccttgataaacttgtcaaggagttcctgaaagtgacttacatcagtcccacatttatctgttatcacctgcagataatgagctctttgaccaaatgatctctctaagagggtctcactgagcactttgagctatttgtcatgaagatagctgaatgtttccatgcagcaacagcagcagctgttgacaaacaagacaaggccagcaaagatgatgaggccacattcatagatgaaagcttccatgcaaccctggaatatgggcttccgcccacagctggttggagcgtgacaatcaaatgtgttaccatgtttctcacagactcccacaacatcaaggaaatatttctgactcctggcatgaaacttgaagaaagagaatgtagcagccactaatacaatggaaagcgcaacattgacacgtctatctagaaaattttaattgtctaagttgtgtgactcagatatctttgcatttctgcaaaagatcaaggtctactctaattcttaattaaattaagaattcctttttattacttgttagcaaataaatggcttgtctctaacagaaaaaatttagaattttcggaaatattttcaaatacttcttatatatacatatatttttttccactggtagaatttttctttagtaaaagtaaataatgctgatccaagtttatgtttcactcagcatcgtttctcaaacactcttctttacttatatatagctaccctatagctaagctatattttattgtatgatgcatttactcttttcagagtttggccatataagttatttctaaatattgctattaggaaaacacatatgcatgcatttcttctagattatcatctaagagtggcttctccagagagagacgactgaattaaaggttatcaacaagttccaattccagataagatgaagaaatcacattccacactgcctctcccactgagtgtagctccaaaacatggatagaatgcatgtagcagctatttgacgaccctaaaaagtaaatcgcagtgtattgcagaataagactacaattagatgtatgatatgatacaactggctgtgagtttatcattttttcctccagtcttccagacatcacttgacctgaatctaatggacatttataggattctcaacaatagcaaagtacactttccttccacatatggaaaattcctcaaggtagactatatcctgtgtcttaaagcatacctcaataaaaagattgaactcacataaagtatgttttctgaccataatggaattaaagtaaaaattactaacagaaaaataactggaaacttccctaagtactcggaaattaagtcacacatgtataaataatctgtgagtcaaagagaaaattttaaggggagtaagaaagtattttgagctgaacaaaaatgaatatgtaacataaaatctgtgggatgcagctaaaaaagcagtgtttcaagggaaatttatagcattaaatgctcacatgggaaaagaaagacggtctcaaattgtttatgtaagcttccactttaataaactagaaaaaaagaaaaaaataaaccaaaaggaaattgaaaaagcagaaatcaaagaaatttaaaacaaaaataatagacaaaattaataagctgatgaaactcaaacaagactgacaggaataaaaacaaacaaacaaaaacaagaaaaaggacctatgttggaaatggaagagaggggacatcactacagaaactgtagatgttaaatgtataataagaaaatactttgaacaactctgcatatataaatttgcatgagatttgaacttggatgaaatgagcctattcttcaataccacaagccaccaaaacatacacaaggtgaaagagatacctgccaattcaattcttaatttaaaaccttctgaaaaagtaatgttcaggtacagatggtttcactggtagaattttaccaaacatttcaaaaagaacaccaattctatacaactcttccagaacatagaagagggaacacttcttagtttgtcttaggccagcattaccctgatgtcaaaaccagacaaatactgaaaacaaaaaccaccctacgtaacaatatctctcatgaatctagacataaaaatcctcaacaaaatattagcaaacggtgcagcaatatatttttaaaagagtaataatacaccatgaccaagtgagtttttctggggcacacatgactggctcaatatttaaaaataattatgtaatccaccatataaacaaaagagaacatccacataatcatgtcaattgatgcaacaaacaaatctggcaaaatttaacatccatttatgattttataaaaaacctatcagcagaatatgaataggagggaattttatgaacataataaagttcatctacaaagagtctacagttgatattatacttaaaggtgaaaactgaaggttttctccctgagactggaacaacacaagaatgtccattcccaacactcctaattcaacattatactggaagtcctagctctaaggaaggccttcagtaagtcaagaaaaagaaataaagttatcactatttgaagatgacatgatcatgcatatagaaaatcctaaagaatgtgaaggggaaaaaagcttgttttagtcccttctcacgctgctgtgaagaactacccgagactgggtaatttataaaggaaaaaaggtttaattgactcagttctacatgtctaaggagacctcagtaaacttacaatcatggcagaaaaggaagcaaacgtgctcttcttcacatggctgtaggagggagaagaatgagagccgagcaaaaggggaatcctcttaaaaaaaatcagatctcatgagaacatactcccacgagaacagcatggaggaaccaccctcacgattcagttacctcccacttggtccctctcactacacatggggattatgggaactacaattcaagatgagatttgggtggggacagagccaaaccatatcaatgctcctaaaatttgcaaatgagtgtaacaaggtcacagaatacaaggtcagcacatgtgttaatcacatttttatgtaatagcaatgcacagttatttgtaagccaaaaatttttaaatgccatttacaattgcttcaaagaaaattatatacttatatgtaaagctaataaaacatatacaggatctttatcccaaaatctacaaaattccaatgaaagtatttaaacagacctaaataaatagagacacatacagtgttcatggattgaaagactcaacatattaagatatcaattttcggccgggcgcggtggctcatgcctgtaatcccagcactttgggagaccgaggtgggtggatcacctaaggtcgggagttcgagaccagcctggccaacatggtgaaaccccgtctctactaaaaaaatacaaaaattagctgggcgtggtggtgtgcgcctgtaatcccagctactcgggaggctgaggcaggagaatcacttgaacctgggaggtgaaggttgcagtgagccaagatcaagccattgcactccagcctgggcaacaagagcgaaactctgtctccaaaaaaaaaaaaacaaaagaaaagaaagaattgtctttttcaacaaattatattagtctcagtctgtttgtgcttctataacaaaatagatcagactgggtaaattataaacagaataaggttattgctcacagttatggaggctgggaagtcctccaagatcaagaaaccagcagatatggggcctgatgagggcctggtctctgcttccaagacggtgcctcatggctgtatcctcacctgacagaaggcagaagcacagaagggacaaacactgtgtgaagcctcttttataaggacattaatcctattcacaagggcagagccttcatggcctaatcacctcctaaagatctcacccttaatactattacattgtcgattaaattttaacatatgtatggggggcatgttgagaccatagcagtgttggaacaattatatatttatatgcaaaaaaatgaacctgacctaaacttcacaattatacaaaaattaacacaatatagataatagatccaaacataaaatacaaaactataaaacttttaggagaaaatacaacaaaatttatgacatggagctaggcaaaaattcttagacattgacaccaaaagaatgattaataaaagaaaaaagtcataaattggactttatcaaaattaaaaccttttgcacttcagaaataaacactgttaagaggatgaaaatacaagctacaaactaagagaaaatatttgcaaatcacatatccaacaaaggaatcatattcggaatatataaagaaatcttaacagatcagaagaagaaaataaacactcagttaaacaaaagaccttaacagccaactcgccaaagaggatatatggatagaaaataaacatgtgagaagatactcaacattattagctcttacagaaatgcagataaaaaccacaataagaacgactatatactcatagagtaaaaaacactgacacagaacagcgctggttaagacacggagaaagcagaactttgatacactgctcgtgggaatgcaaaatggcacggccactttgaaaaggaatttgacagtttcttataaagttatataaggttaccacaggactcggcaatcccatttctgggcatttaccctagagaaatgaaaacttatttccacataaaatcctgtacataaatgtctatagcaactctagtctttttttttttttttaatttttattttttgagacagagtcttcccgttgcccaggctggggtgcaatggcacaatctcggctcactacaacctcctcctctcaggttcaagtgattctcctgcctcagcctcccaagtagctgggattacaggtgtgtgccaccatggcaggctaattcttgtactttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagctgggatggtctcgatctcctgacctcgtgatccgcccgcctcggcctcccaaagtgctgggattacaggcgtgagccaccgcgcccggccaattcttgtacttttagtagagatggggtttcaccatgttggccaggctggtctcgaactcctgacctcaagtgatccacccgcctcagcctcccaaagtgctgggattataggcgtgaggcaccacgcctggccagcaactctattcttaattgccaaaagctggaagtaagataaatgtcttttgctgggtgtacccatacaatataacagttgtcagcaacaacaagtaagaaagtattgatacaacttgcatgaatttcaaaggctttgtattgaatgaaaagctagtttcacaaggtcctataataaacactttcatttacatgacatgctcaataggttgttatcattgtgataaagaatagattagtggtgggacagggtttgccaagggttggcaggtgggggagatggcatggggtatttgggggggaaggatggacctgtactgcatcctgatgatgctggtggctacagaagtctctccatgtgttgaaattcatagaagtgtacaccaaaacattggttttgctgtgtgagaattttaaaagtaaaaaagtaagaagatagtgtatttgcttcctagggcaaccataacaaagcactacaaacgccttaaaataacagggatttattgtcgcagctttggagacaagtctgaaattagggtgtcagcagtgttggttccttctggaggctctgggagagtctctgtcccaggctctctgctcgcttccaggagcacccggcaatcatgggcatccttgggctgcggacgcgtcgctcctgtctctgctttcatcttcgcatggccttctctctctgtgcctctgtgtgactttttctgtctcttataaggactttctcctttatttagggcccacactgacccagcatgatctcttctacagccttggcttagttaacatctgcaaagacccgatttccaattaaggttctattctgaggctgcaggtggacctgaattagcagggagggcactattcaaccaactgtagagagttaaaaaacaataagcctgtggacattttttagcgtaatctaggctcttgatgacctgttttaaactaatcagcaatgaatatttttcagctaacgtaatgactattgacaagcacgtgacccttgtctgaatgttaactcaggcatagcaactaaaaaccatccattgaccagctcgggagtagcaaacagagcaagccattcttggtgcaacctgtttctaggtaattaacttgaaaatattttcaatattcaacaaagatggttcatttaagatgactgaagccacatcttcacagatgcagaagatctgaatagctttcctctttagattgaatagttctagaacaattcattcctaaaagtgacttccattggggaaaatatcctattcagcttgagtcacttaattatggttgttattggtataaaatgtctctgttttccctaatatatttttaaatttcttttttccttttagaatgaattctggaataaatacaaaggtcagtattttttctgttttaaccttcagtgagaggggttcatcaggatatttgaattttgaaaatagttcctgaatttcctttctgcttttgttctcattttactcatttaagactttttccctcagggtgtttccataatagttattgtaaaagagtttttagagtaattttatactaatcctagttttgttattgagttagagatatatatttaaatcagttcattctcatttgaggataccaaattccatgataacttttcttaaataaaagtgtattcggtaaaagcaaaaaacagagtctgaaagattagattcccgactaaggtaaccaccttgatttaatgcttaatagcatctgaagtggcctcagtcatgactacctggtaacagtattcacatttctcaaaatgacaactgggcctatctctaaatgagattgtgtaaatcctccaagaaatgggaagccccgtgttagtgtttgccttctccttttgccccaggatgatttggaaagaggaaccctaacctcctctcccgtcaaggcccagcccagaaatgagcatcaggctctcacctttcctccatccttccagttggtccctgtggtcacctctgactgtaaacacactgcaaaacaccggcaaaaatcaaaaagctgggccggtgatccacctagataaaggcatcacgtacacatggccacaaaagggggtggatcaaataaagtccaaagagggggagttgtttacagagaaaccggaagactcttccagttatctgaacggcagggccaaggttagcacagcaaaactgtttccatgatgccggaaacagcttgcagactccagtttcgaaatcctctctttgcagatggcgaccagtgtgagaccagtccttgccagaaccagggcaaatgtaaagacggcctcggggaatacacctgcacctgtttagaaggattcgaaggcaaaaactgtgaattatgtaggttcctctgcttggtataccttcagatcagatgcccctgaagagtggcaggtgggcgggggaagaagtgaaaacgcctaatgaaacaatcttaagtcatttctgatttacaaagtctgggctctattatacctattatactgtgccactatagcaatagaaaaaaaagccccaatatgtcccccaaacgattcggtttgggggcatgatgagagagacacagtcacttctctgctcctccgagagagactgtagaacattgatgaagcgtgtgatccattcatgtgtaaacaggagtggactctctgttttccttggggccaagtgcattgccctgttattcctgctccttgtgaccctgtgcagtgattctaaatcacctcttatttatgtgtatggatgcaggtgtcaatatttgtgaatatttgtgattggccaattataaaaatttgatacatttaattagttctacgtggaaaaatcactaagtgctttctctaatgtggtgattaagttttaaataaaaagttaggctactgttagatcaatttccctaaggaaaaagatttgcatttcttttaaagtacttaattgatcatcttttttttttttttttttgagatggagtctcgctctgtggcccaggctagagtgcagtggcacgatctcagctcaccgcaagctccgcctgccaggttcacgccattctcctgcctcagcctcccaagtagctgggactataggccccggccaccagtcccggctaattttttttttttttaattttttagtggagacggggtttcaccgtgttagccaggatggtctcgatctcctgacctggtgatccgcccgcttcgacctcccaaagtgctgggattacaggcgtgaggcacagcgccggcctaattgatcatctttagactgtgttcttagattggattacttttgagttttccctgatgagaatatcaattacgcatcattccattccaagtccgcagtcgcctccctggaacaccatttggtaacttatgaggcataaccctgttcaggctcccagggctattatgcacattttctaaaatttcaggcatgttgatctttgcactgtgattactttttcatcaaaagccacacagagggatgtggagtgaccgtaatgtgagtgctgctggggcagggggtaccggccatcccggaggtgtgaggggcaggtacctggagcctggcttctggctacaccgggcactgcaccatgagctccccgtgacccgtgaggttgcccttcaaggcaagtgtacctgtcgcctggctctggccctttgctcaacccaatggccgctttgtggctgacaggcaagtggatgtagctggcacccttgggccagcccagcctccatttctccagctgtccccagagccaacgtgcctctcctttgcagtcacacggaagctctgcagcctggacaacggggactgtgaccagttctgccacgaggaacagaactctgtggtgtgctcctgcgcccgcgggtacaccctggctgacaacggcaaggcctgcattcccacaggtaggaggcacgttgggccacagccacccgctgccgctgggccgggccagggaggacaagcccgtgccagggggtggggacacaggcatgttctgggcgggcctggcaggtaacagtgacaccaagaggacaggactgagccctgggctccgggcccaggtggttcaaacatgaagaccatgaggtttggaaacagacccattatttctgtaagccagatctgctgtttaacctcagcttccccatctgacaaatgggaccaacactattgcctgactgcttgggtgatccctggagcactttgcatgatgcctggcccaccgcaggccctcagtctgcattgggactgtggggggatccagtgcaagggctcaaagcaccagggcaggcaaagggcagagctggcccgaggaactggagctaaggtgcggggctgggataggagtcaggggacgctcaggctctgagctccttttaccaggaccagtgttcattgaacgtagtttttcttttccttgatgaatgtggacaacaggcggccagagggcagtgagcacaggacaggcaggggactgggcagggtggggacgagcctccctgtcctgaccccgtgggcattgcctacgctgggcttgcctggctgccggcacttccacacggccagcacacatgaggccctcgaaggcggggcctaggcgtcacagctgcaccttgcacagcaaccccactcccactcatagctggcccgacccgcagcgttggcctcacccgggggcatattcgaagggcagagttccaggcccgccttttcaagagcctggtgacccagctcaccttccggcttcaggtgcggctcagcccccagaccgtgttctgcccccggctaccatgactgtcccctccagacacaggttactcccgagtgttctgtcactcttcctttcatatccttcttaccgaaaacaatttacttccaaagatgagtgatcacgaaaagaccgggttccatatgcatccttcaagcgctgcttcaattatgtgcctgaaacatctcagcaagtgaaagacactgtggctgaccttgctactggcaatgacattcaagcttaagctggttaaaaaatattttaactgaagtcatttcttgacatacacacgaatattttttaattctagaaacaatcacaaatccatttaaaaccaagtgtgggccgggtgcagtagctcatgcctgtaatcccagcattttgggaggccaaggcgggcggatcatgaggtcaggagatcgagaccatcctggccaacacagtgaaaccccgtctctagtaaaaatacaaaaaaaaaaaaaaattagctgggcatggtggtgcacgcctgtagtcccagctgctcaggaggctgaggcaagagaatggcgtgaacctggaaggcggagcttgcactgagcactgagccgagattgcgccactgcgctccagcctgggcaacagaatgagactctgtctcaaaaaaaaaaaaaaaaaaaaaatcaaaaggcaaatgtgatgtgtgaaaataaaattacataatctactttgtagtgcaaaaagttcaggctgggcaaggtggctcacgcctgtaatcccagcactttgggaagccaaggtgggtggatcacctgaggtcaggagttcaagaccagcctggccaacatggtgaaaccctgtctctataaaaaaaaaaatacaaaaacttagctgggcgtggtggcgcacgcctgtaatcccagctactcgggaggctgaggcaggagaatcgcctgaacccaggaggtggaggttgcaatgagccaagatcatgccattgcactccagcctgggagacaagagagaaactccatctcaaaaaaaaaaaaaagttcagttccaaataatggatgaactcagaacttggaagggtggtgactgcacacatggacagagctgaggcacggcggggtggaggcccctgcggctggcagattcaccggagcctcctcagactgcgcaggagcacagcaagtaaacagctaagctgtgcccatctgaccccagacacgtgtggccacagagaagccccttgccatccattcccccctcctctcctctcctgctcccccacacccctgccttcctccaacatgtttcagccattctcttggccttggtgccctaattggccgttatacaaaaggaagcttcctaacatctcggcgtggcctctctgggagctgtgctattccagacgctctcctgtgcctccagttgtttgcgtgcgccattccttctgcctgaaaacttttttttcttcaatgtttcattaggaaaagttttccaacacacagcacactggaaagaattttgcagggagtcgcacacgcccagcacttgggttctcctgttggcatcctccggccagatgcattcatcccatttcgcccggcccgtttgtctctgtccatccgtcaagctttcttgacttcttggtgcattttcaggcaaaccgcagacgccaacactcccctcgctgcctgggttgctgcctggcgtccattgttcacaggcggtcacctgaggggaggccaacgctcggacagctgcgctcacctgcagatccgacccctgccgacgacgtggggcctcgccctgcaagcccgctgcccctccgggtgcccctgcgctctgcctcccggctctctgactcttctccctcagggtgagctgtgcaggctatggggagcctctctctgtgctgaaggccccggccgtcctctttctttcagggccctacccctgtgggaaacagaccctggaacgcaggaagaggtcagtggcccaggccaccagcagcagcggggaggcccctgacagcatcacatggaagccatatgatgcagccgacctggaccccaccgagaaccccttcgacctgcttgacttcaaccagacgcagcctgagaggggcgacaacaacctcaccaggatcgtgggaggccaggaatgcaaggacggggagtgtccctggcaggtaacagtaggatgtcccctcgggcctgctggagagaccacctgtcccgctgtgcacctcggggaggccagcctgacacttggaatagcaatccgggaaggaactgttccgaactaggacagaggggctccgccacccaagcctgcctgcctgtcccctccctccgggcagccaaggaggctgtgagctccacagggaagtggccggggctgagggagaggctgggcccaggcaacgcccccctcagccccttcccactgggcatttccatggctgcccgtggcatgcccaggacgatgctgtcctgtgaaacagaagagagggagaaggcgcagccacacgctcaagtgtcctcaaacctcccctacaccaggagacaaggctaaagccagggagccacccacactgcaggggcatcagcgggcaggaggacggtgccgggtgggcaaggcctccatctgctcttctgtttgacgggaggcagaaagagttggtgtcctcgcttcatttctaattttggaatttttttacccaaacacctaaatcctatggaggtagatagtaccttagagaaaaacacatctacttattttcaaaggtaaaaaagaaaatcactctttgaggcttttttgttaagagacagtaccttgctctgttgcccaggctggagtgcagtgtcgcgatctcggctcactgcaacctccacctcctgggttcaagcgattctcatgcctcagactcccaagtagctggaattacgggcgcccgctacttacgcctggctaatttttttttttttttgagacggagtctcactctgtcgcccaggctggagtgcagtggcgcgatctcggctcactgcaacctccacctcccaggttcatgtcattctcctgcttcagcctcccgagtagctgggactacaggcgcctgccaccacgcccagctaattttttttgtatttttagtagagacggggtttcaccgtgttagccaggatggtctccatctcctgacctggtgatctgcccacctcagcctcccaaagtgctgggattacaggcgtgagacaatgtgcccggccatgcctggctaatttttttatttttaatagagacaggaatttcaccatgttggccaggctggtctcaaactccaggcctcatgtgatccaccctcctcagccacccaaagtgctggagttacaggtgtgagccactataccaggtcctaatctttgattgttgatttggactaatgctgccagattaaacaaataaaagcacaatactttcaattaaatttcaatttcacataaactagaaatacattaaacaaaagcacaatactttcaattaaatttcaatttcacataaactagaaatactttcagtgtaagtatgttccaagtatcgcatgaagcatacatatgcgaaaaattatttgctgtttatctgattcaagtcaaactaggtgtattagtcagttttcacactgctgacacatacatacccgagactgggtaatttataaagaaaaagaggttgaatgaactcacagttccacgtggctggggaggcctcaccgtcacggtggaaggcgcaaggcacgtcttacatggcggcagcaagacagagaatgagagaacaagcaaaaggggtttccccttagaaaaccatcagctcttgtgagacttattcacttccaccagaacagcatggggaaaccgccctcacgattcagttacctcccaccaggtccctcccacaacacacgggaaatatgggagctacagtttgagatgagatttgggtggggacacagccaaaccttgttgctgggcatcctgtattttctctggcaatcctcacttggacttgaattttcagcgcccaaaaccagaatgtcctctcctacaagcaagaatctcagagctgccagcgcccccatgaattcccccaggtcttcccccaccccagaccgtgtggcgggtgagcctctgtctaactataaagagccaagcgagagagggatgcactgaggtggctctgcaatgcatgtttgttgagggccttctgtgtgtcaggcactgagccgggtgctgtgtaggtgggatatgaaaccatgaagcctctctgtgaccaatacacagaaatctcaacctagttagggagctgagaccgaaatcctcccagtcccaggcactgtgtggttggggcaagaacctcgatgcaggagaccccaccgaggatgagcaggaaaagcctcttgtggggctgaggagctggacttggagctgcaggcggggttttggaggggttcctgggctgggggaccagggtggggcgccctggagggctcactggaggggccctcgcccagcctgttgaggtttgcgattcttgtttcctggttcgagtcttggcaagtgggcctcatctgcatctttaggaagaatggttggtgttcgtgtcttagaaagcctgactttccctcatgtaagctggatgatgagttgacaaattatgcaaaaaagaggcaaaaacatgaccccttttctagccatgaatgttttaagaaatgttttaagactcggtattgtcagtagtttcattggtctgtacatgtgcccagccactatcacaggacgggaaactccccagagaaaagaaaaccaaaatatgcccgggctccaaacttgcaagtccagctccctagggacagcatgtggcacccctgtcagtgcttgctcccctgggaccgtgttccaagtcctggcaggtaggagacccttcacaggagctgccacagggacccccaggaagtcacctgggatggaggtgtccgtgcaccatgggggacaggctcacactgctgaaccgtcgggacaccaggcaggcacaccggttgaggcagatgatgtttctgcacagactggcgtctcctggtcccaggtagaaatcctgccacagagacgggaaaggctgctcccacagggagcatcttttccaaagcatggacagatgtgtcgtgtgcatgagactttagagagctctgtgatggagttggtagaaagaagagatgactccctatatcagtgagtgtgtggcacaggcagagaaaagagacagacaaggaactgtccttgggtggatggcaggagaccgaagaggacagcttggcatggggagggccgggcagtgccacctgaagagctggcttctcagtcaggcaacacctgtccacctggccagccacactgagcctgtcacgtctgtcacaggccctgctcatcaatgaggaaaacgagggtttctgtggtggaaccattctgagcgagttctacatcctaacggcagcccactgtctctaccaagccaagagattcaaggtgagggtaggtaagtgaccaacagcccccagggccgtggtgaggggcaccgtcactgtctgcttttcagaaaccactaaagctgatggaatttgttgggaacactggttgaaatcctgaaatcctatttgtaggggttaggggcatttcacagaggaagaagatgaggaagcagaggaaggggaagagtggggaggaggacggggaggggaggcgaaccagcccagcccttctcccactgggtgtccaggtctcgggtctccgagtctctgggtcccgggtctctgggtctgcatgtccagctaatgttctgtgtctcagtgtcttttattgggagccttccagacctccctttctctttaacatactctgaacaccaagcacctctgtctcttctatttttatttgtgggattgtttcattaacatctgtctttgtccactagaccctagagctgctcagtacaaacccaacacaagctacaaatgcaagcaatatatgtaaactgatatttttctaacattaaatgttctattatacattttaaaatataaaaaaacaggctgggtgtggtggctcatgcctgtaatcccagcactttgggaggctgaggcgggcagatcacctgaggtcaggagtttgagatcagcctggccagcatggcgaaaccccatctctactaaaaaatacaaaaattagccgggcatggtggcacgggcctgtaatcccagctacttgggaagctgaggcaggagaaccacttgaacccgggaggtggaggttgcagtgagctgagattgtgccattgcactccagcccgggcaacagagcaaaactctgtctcaaaaaaaaaaaaaaaatatatatatatatatatgtatatatatatgtgtatatatatatacatatatatacacacacacacacaatttccataatatatcttatttaactcaacatattgaaaatattactttttccatgtgtaatcatgttaaaggtgtaataacacattccgcacattttctttcatgctaagtctctattttacgttcatggcacaactattttacactctcagccagcggccacaccgcacaacctgggtctgggatgccaaaagccttcggtcctgggacgcctcgttggtgcccacgactggcacagacgatgcacccgccaaaggacacaggagtggcggccgtctaaagaaccaaacgtgtgagacaggaccagtggttccctgggcagcaaggctgacaggcacttttatttgctgctttgcacttccctctatttttcaaattttcaaaagtgatcacgtgccatttttaatttaaaaaaatatatataacttccttaaaaagcaacggatgtgcgagagcatgtccctggctgagctgagcacagtcccactcgtctgtcccaggggaccggaacacggagcaggaggagggcggtgaggcggtgcacgaggtggaggtggtcatcaagcacaaccggttcacaaaggagacctatgacttcgacatcgccgtgctccggctcaagacccccatcaccttccgcatgaacgtggcgcctgcctgcctccccgagcgtgactgggccgagtccacgctgatgacgcagaagacggggattgtgagcggcttcgggcgcacccacgagaagggccggcagtccaccaggctcaagatgctggaggtgccctacgtggaccgcaacagctgcaagctgtccagcagcttcatcatcacccagaacatgttctgtgccggctacgacaccaagcaggaggatgcctgccagggggacagcgggggcccgcacgtcacccgcttcaaggacacctacttcgtgacaggcatcgtcagctggggagagggctgtgcccgtaaggggaagtacgggatctacaccaaggtcaccgccttcctcaagtggatcgacaggtccatgaaaaccaggggcttgcccaaggccaagagccatgccccggaggtcataacgtcctctccattaaagtgagatcccactcaaggcctggtttgtctctcgattgccgccttgccctggcttctcccgccctgttgaggtgggaaggtgaagtgtctgtctggaacaccagcttccgcccttcccagctaggctggggattcctccagggaatattctagtctgtgggggcaggatggaggctccagggatgatactgtgccatgactgccatgggcattcctttccccagataccttcctgcatctgggtcacgcccagaggcagatgggagcctgtgcaggccccgtggcgtcgggaggggcccacacgttggcgcagcctccccaagaccccccacttggcctggtctctcttgttcctcttgggaattggacacctccccggtgactgcctatgacccgcagactccctgggagggaaacgtccagaaagcttctcattggggcggacattttacattaacttaaacaaccaggtgctcttcaactgcacggtgccaggccccaccccagctcaggcttgtgtggtgggggccacaggcatcccccgggcaggtgacctgctcaccaggcagcgacctgacctggcacagttggcccccaccgtggccacccttagaaccccctgtgggctttagcatgcctgcatccaggccacagcctggccactgaaatcagtctctggagtgaagctggccaggagcttctggaagcttctggagctcctcaggtgctgagtggtggtggcgtggcaggcggggcttcggggggctcctcctctcctagggtccagatgtttagtccttgccctgctgcaatccggcactgtccctaggcctcaagttaactggccatgaaaatcaaatgaactttcggtaaacagaaaagattccggacaaggcctgccgtgtgtctcccaaacgtctcctgcagtttgcgtcttgtgtaatgtccctaagcaaagttcaacagttctagtacaaaaactccccaaaaaagtcatgagctgggcaaaaccgttcgtaaacagatgttgcgaagtcagggaaaatcaaagtggacaggtgttcgacctcccagaaacggtctgaggaggggccggtctcccagggtgggcgggagggcattcctggcctgcccgctctgaggccttctccgtggagctggctgtcgggctcctcgccggcccttcctggagaaaaggcttctgcctcggagctagcctgctgttgggctgcgtttcctaggcagccacgtggtccccagggccccagaggtaaaccctggacttggattcccgtttctggaaatcaaaggttgagtggggtccagagagaactctgggaaaataattacaattgaaaccccccatcgccatcactgtctgcaccctggttcctgccgcactgggtgtctggtgcccgtgcccgtctcaggatagaaaggaaactggaggctgcagagagaaggacctgatgggtcgtagctcagcatctgccgaagccccatctagaaataggttctcgtcctgggaggtgtgggagggagcctcgggagggagacagcaggaggagaggccccagtcctggacacgcgctgggggttgaagtctcggctctgcaggctcctgtgctgcgtggcagggattttctctctgcctaaatatcgtcttcataagtaaaggcaagtgggctaaacctatgtcatctccgtgttaactcagaatagtctaggcctgggccaggggacactttgtgatctgagacccccagaattccctgagggaggcccagctctgtttcgggaaataactgaagcggctgtttgtgcgaggtgagaccctgaggaccgagagcagcaggaggtcatggtggggagcaaaaacgggaaaagtgattccgcctgagactgagggagagagaacccaggtgagaccctgaggactgtgagcagcaggaggtcacggtggggagtaaagatgggaaaagtgattccgcctgagagtgagggagagagaacagaggtgagaccctgaggaccgagagcagcaggaggtcacggtggggagtaaagatgggaaaagtgattccgcctgagagtgagggagagagaacagaggtgagaccctgaggaccgagagcagcaggaggtcacggtggggagtaaagatgggaaaagtgattccgcctgagagtgagggagagagaacagaggtgagaccctgaggaccgagagcagcaggaggtcacggtggggagcgaaggtgggagaagtgattccgcctgagagtgagggagagagaacctgcagcagccccatcgcctcccccagtgacacctcccctccccctgagcaggaaggggagctttggggcgtccacctctggaggacgaaggtgagagcgggtgtcgggggcctggtggggcagggaggcccttgtgggtgctgggagaccagcctgtgtgggtccagagctgcgcttggatggggagatgggcctgccgtctgggaacacgcagcccaggctgtgaggaagaggaagcaggaatgagagcttcagccaggacagctggtggacggcagacctcggccccaccatcactgtcatggagccatctcagcagggctgggggttaagctcccgtttagaaggaccccactccacagccacggggtagccactgatgtgggcaagcgcccgccatgaagaccccaccttggtggaagggcactgagaaactggacaccctcgagactcagaggatcacctcagaactggcctgttaactatgccaggaaagcatgcctttagcgtggcaaaacctggggacccagcctcctcctgagccgaaggcagggggctgccaaaacactgtctaagcagagcccgatcctgagtcaggcaagtccagatggaggaaaccatagactcttaaaaaacgtcagcgtcagcaaagaccagaaacagccagtgactctgcagtcagtgagaccagaggagtctgcaggctgccaggagagcgagggagactgctgggggttcccgtcagacagcgctcagcgggggcgaggggagagggagagaggcagagccagagagacaaaaagaaagagagacagagacagagagaaagagagagacagagacagagagaaagagagagacagagacagagagaaagagagagacagagacagagagaaagagagagacagagacaaagagaaagagagagacagagaaagagaaacagaggggagggagtaagtccaggtaaaaaacaaacaaaaaaattgagaatagaacaagagagaaacagagacatggagacacagagaaagacacagtgagacacaggagacagagacagagagagatgctgagagacagacagggagagggagagagagaggagacaccaagacacaaagagggcggagagacagacacagaaagagggagacagcggggctggatggacgtgtggccgggccagtggggaggagagacgagtccgcagacagcgttcagaggccgcgctgcctgggtgctgagccgtcccggggttcacggtcgcagtttgtccttacaaaacgcccagccgccccgacctgtggtgcttagggaggacctacctggctgtgccggtctgagaaggggccagtgaggcccggtgcgggtacgggcgggtgcagatgcagccaggaggacgggcgggagcgggggcctgtcccacacgggggcctcggcagcaccggcatggctggaggccagtacggccaggtgtggcgggagggagcgccgtctggcttgggtcgtccatcctgacaggacgctgcaagggcaggagccccgcgccccgtgtcctgcgcccccgctcgaggacaagccccagccgccggtctccgctgggttccgacaggccttgctgggaggccttgctgggagctgggggtcgaggctcacagactgcgctgaccccagcaggcacagctgggtccagggactcgggaactcgcagcctgacgcgggccggacccccggggtgggtgctgagggcctcggatgccctccctggctggacgttgtggctgtgctgatactgagcggtaaccctaggaaggagagtcccctgggctcagctacccgggacaaggtcaacagggacaccggccccagttccaggagaaaaacaagcacggccagcggcgagtgtgggcgacagcagctcagggagaagcagattatcaacagcgaattcactcagggtcagccaactgtacgcttaaaaaaagattcctgcggtaaactgtatgtctattttaccacaataaaaaacttattgtttttaattaccaatgacttctaaaaaatgtttttaaaacccagatcacaaatcctgaacatagggcctgaaaggcgaattcagccaccacggaggactcccgcaccgtggagccgggacgcagggactccatgctgcgcggagggcaggggcacgtgacgcagggcgtgggggaggcggggcgtggaggaggcggggcgcggggggcggggcgtgggggaggcggggcgtgggggcggggcgtggggggcggggcgtgggggagggcaggggcacgtgacgcagggcgtgggggaggcggggcgcgggggaggcggggcgcgggggaggaggggcgtgggggggcgggccgtgggggaggaggggcgtgggggggcgggccgtgggggaggaggggcgtggggggcggggcgtcggggagggcaggggcacgtgacgcagggcgcgggggaggcggggcgcgggggaggcggggcgcgggggaggcggggcgcgggggaggcggggcgcgggggaggcggggcgcgggggaggcggggcgcgggggaggaggaggaagggttctgagtggacgcggggactccatgccacgcggagggcagccgctcatgaggcggggtgtgggggaggaggaggaagggttctggagtggcttttctactccagaagtctccccgatcctgaaagaaaatctagacaggtggaaaaaagagaaacatgtccagatagtgtcttccacattaatggtctcccaagctctgaggaagcccaatgagttgaacagtttctcataagcttgcgggtccctgtcagtgcttctgagatgctaaaaacgccaggctgtgggctgcgtcaccatgtgtctcctctttaatttcttcaggagctccaggtgataagctgccacctccatccacaatgtggacatcagaggatgcagcatgctgtggtttgaatgtgtccctatagtgcacgtgttggaaacttaatcccaaggcaacagtgttgagaggtgggacctttaagacgcattcattgtcagagcccacgtgaatgaattgataccactattgtaggagtgggttcgttattttggaataaaaggatgagtttggcccccttcctctctcccctttctctctctctctctctctctctctctctctctcacgcgcatccaccttccaccatgggatgacgcagcaagaaggccctcgccagatgggggcccctggacctttgatgtcccagcctccagaactgtaagaaataaatttctgttctttataaattacccagtctcagatatcctgttacagcaccacaaagtggactagaccacactctactctgtgaatctaagacgcaccattattgatgaacctgaaagaaagagcatatacccaaattagctgtgggtcagctcagcctggaggcaagagggggaagctcagataatctaaaccacaggccagccaggaaccagctttgcaatacatttacactattcacatgggctcccaaaactcacacaaaaaaatgtatttaaagggattgcaaagtggcagtgcccccagggggcaacataaagcacaacccctttcaggaagaactcggccttgtccaggctgacattagaacattggctgtagggaacaggccaattcagagatgttgaaatctaaaacataggtcccagagttgattgaacaggtatttaaatagggactgcggcaagatctaagtattcaatgaccaggttctccataggctgctcatttcaggttccacacaaagttgtggggtcagttgatttaagctggggacccccacagaggacaccccaacatctgaaggacacgacaaagaccccaaaggaaggaagattctcctcaggtatacagaaggaaagtaaaccagtcaatggaaaaagtgtcccaatgttggttggtttgtttttcagaacagaagagggtgacagaagaacgattattcatatgagagatgaggaagatgagtagaacgaggtgaatcttaatgtttggacaatttattattgtagaatttttggtccaaaggtggtatctttgagaaggcagatgagaaaattaaatcaccacatacaacacggtcagtccacgtacaacacagtcaatcacagctgtggcctcgatgttgatgccttcctgtattagtctgttctcatgtcactgtgaagaaatacttgagactaggtaatttataaagaaaagcggtttaatgaactcacagttccacatggctggggaggcctcaggaaacataatcatggcaagcaggcacctcttcacagggtggcaggagagagaaaatgtgtgtcaatcacagggggaagccccttataaaatcattagctcttgtgagaatgcactcactatcacaagaaccacctccatgattcaatcacctccacctggtcctgcccttgacctgtggggattattacaattcaaggtgagatttggttggggacacagagccaaaccatcccccaaaactcacgttgaaacctaaccccctgtgcaatagtactaggaggtggggcctctgggaggcactctgccttcatggatggatgactgccctcccaaaagaggctccagggagcacccacattcctcccttccaccatccaaggacacgtctatgaatcatgggccgtcaccagacactgagtctactggagccttgatcttggacttcccatcctccagaactgtgagcactacgtttctgtttatcgtaaattacccactctaaggtgttttgttacagcagccccaacagactaaaatggtccatgagggaagaggttgtagctcagatacccatgtcaggcatataggatgtgcttaattaacacttattgatcgaatgtgtatgtccctgtctgcctttccatttttaggcagctattgatggtttttaaactatccagcagaagtatttttaatgtaaatttccatgtgggaatacattttcacacaaaaaaaggcaccttttcttaagtgaaggccacgtagattgccaggctggtgcaattcacccaagagctatcctatacaatcaacttctggctttcaaattattttaactcactcactaaagataaactttattttcttttcccagctttttaaagcaaacttcacaacttcagtgtatttgcgggcatgccctcttaatcaagggtgtcagcttcttagttttcttctgttcccactttaacaaaattgtatttagaatcctttcattgagttttgccacctttgagtgtcattcaatcgaacaatatctatatgctgacaatgctgtcatttcatctgttaccacctgaatctccactgtgagtcccagcttctcggatgcccactcctgtctccacctggacatcccacagacacctcaaatttgccaaacctcgcttccctctgccctcctggagcttggccgtctcagcacacgcactgccatcctcccaatcgctcagcccaaaccttggagccgtgctgcccgacacaattcatcatgaatcccatcagctttcccttcctgaagcatccagactgcaaacgtgcttcctgctgcatggctgcaccctcaccccctcctggactagccggcagcctcccttttgacttctctggaatgttctgttctccacacagcagcccagtgatcccttcagagcacaaatctttccatgtcaattcctgttccctccaatatcttcccaacacagtgaaaatgaaacaccaggttcttacctcaggcttcaagggctgatatggtttggctgtgtccccaccgaaatcttatcttgaattgtaatccccatagtccccacgtgtcctgggagggacccggtgggaggtaattgaatcatgggggtggtttccaccatgctattcttgggatagtgagtgagtctcaagagatttgatggttttataaggatctggcatttcccctgcttcagtcattctctctgctgccaccctgtgaagaggtgccttctgccataattataagtttcctgaggcctccccagccatgtggaactgggagtcaactaaacctcttttcttaaattacccagtcttggctatttcttcataacagtgtaagaagggactaatacacagggcctacatctgaaagcagcaaacgacaaccctggggccaaatctggccccttaatagctcttataaataaagctttattggcacacagccaagtgttcattcatgattgtctatgctgcctctgctacaatggtgctgagctgtagtgacagacactatttggcccttccccgctttctccctcctccctccctcccttccttttctccccttccttctttccatcctcctgctttccctccctcactccctcctgtctctttccctcgttcttttctgtgtattccacacacacctagaacgtaagctgcatgtgactttgtctgtcccgcccagtgctgtgtccccagggcctatctcacctccattgaccacacacgggcatgggtgccaccttccaccttgcacctgctgcctttaccttctgttctctgtctccctaaatatctcccagggtcctctgagccttcaccgttcatttctctgcctggcctcaaacagaaaacgtcaggagggaagcacacagctgcacaggtcgtgccccgaggctcctgctgccggcacctcccccagcctggactttggctgtgtttgtagccctgtcccagcgctccgggtgggaatggcaggctgcgtcccactgctccagggcctggtcctggtcctcgccctccatcgtgtggagccctcaggtaggcatctggcttacctgtctgttgtgcctgtgctgtgtctttcttgactcggtccatggtggatttgtagatgaggctttttccaggagccagaggagccctgagtgcccagactagtcttaattcccctgaaaaagctgtttggatctttatcatttggtgacaagtatttgggacatgatagtgtcacttggggtcctcccaagagatgcccaaatggaaagaagcctgtgtgcaggggattcagccgggaaaggccggggagaggggagggggaaagggggaggagtggggggaggcctgggttgggcattggacgaggggagggggtggggcaggctgagcccagactgcaatgtgggcagagagagccttggccaggccagccaggaatgcccagtcttgagtcaggagacatagccagggagcagccaccctgcctgcctgccacccttctaccaccagccacttcactgaaggaacgacatggactccattctgactctgcctgcacaggcgtccaggaaagctgcaagtcaaaacacccagcatccccgctggccccatggtctcccgctggccccatggtctcccaccctgagagggtgatccccccgccctgccctgcccagcacttaccgtagccggacttagctgagccccccctgctgtaaccctcagcaccgagagaaaaggagggaggatgggaagggcctgggctttgaccctcccggagagggagagaacatgctttgggaccctcaggtgggaagaggctccagagaccactgccgcg

SEQ ID NO: 1253 - DNA, 34241 bp, Homo sapiens
cttcctgggtccccattccccaacggaacgtgttccatgacatctgtgcagcatccgctgtgtgccaggcacagttctaggccccggagacaaagcgggaacagcacagacaggaacctccactcttacagtgaggagagaaagaggagtgaggcttggggaggttgggcaggacagctgcagggagagggagggcagaggacgggcgagtcggggagtaccaaggaaggcctcagcaaagcagcatggaaataagacctgaaagcacggaagggccctccgggaggcgggtatgcaggcgcaaaggccctggggccgagagctgtgtgtggagaccagcgtgaggggctggggcagctgggcccaaagacagattcacagacgccttccatcgccgctgcggtagtcatgccctgcggcgtagcctcctcccaaggctggagcccttccccggagctggtcgtggccaggagctcccaccggggcagggcgctaaggcccggcactccgcctggctgctgtggggctgctgccggggcgggtgctgacgctgtctgtgcccctgcccgtctcccaccaggttccaggtaaatacacggtcgtggcggaccacgagaagggaggccccgatgcgctgcgcgtgaggagcggggacgtggtggagctggtgcaggagggcgacgagggcctctggtaagaccccgcgctcagccccggactgccccgcacgtggctgccgctgaccctcgccccttgcaggtacgtcagggacccgaccactggcaaggagggctgggtgccggccagcagcctgtccgtccggctcggcccgtccggctcggcccagtgcctgagcagctcaggtaaggcccacgtgccccgagcccacccgtgacgctgccaagggcccgggcgaggaagctgccccgtgtgtgcccggcagagccgacgccgaagcccgtccccgcctgatctccccgcagagtcgagcccggggtcggccgtgctgagcaactcgtccagctgcagcgagggcggccaggcccccttctccgacctgcaggggtagcgcggcctcggcgccggagacccgcgcgctgtctggggctgcggtggcgtggggagggcgcggcccccggacgccccgaggaaggggcacctcaccgcccccacccagagcgcctggccgtgcgggctgcagaggacccctccggggcagaggcaggttccacggaagaccccggcccgctggggcttccccggagactccagagcccacagaggaggggccgcagggaacagccccgggcggcaggcgccgggcagcggcatctcgtcctggctccaccgtgctgcttctgcctctggacggtgctttcaggggacgcgcggaccgtggtggagctgcttccggagaagtggaggatcctctggccaacggcctgaggagagcggggcacggggtctctttagcttttacaagttttaggattttttcaagcagggatcaatcccgtggccattttttgtggtactttggcctcaattcttcaccaggaatcactgtgtttacatgaaatgacaatttgatactgtatttgatagaaaactatttttttgttaccggggtttacatagaagcacgttgtttataccactaagtgactttgggggggctctcccatggaaacggatggcactccctgaagctccctggtcacaggtggatgaaaacgtgtccgtgggtgacatcaggtggtgtctccaccaccaaaagcagttagaagccaaggagattcctttatctacctagggttcattttcaaaagaaaatttaaactataatttaaacaattaacgttcttttctacaaaaaaaatgcagggacttgatttttttaaagagcttcactgaattaggatatttttattgcttttaaagaaaatacaaagatgcagtttctgcagggtgtggcgtggaccagtgctgccgaccatagctcagagagccctgcccctgcctcactgcactgcagcctcctcggaggccgcacctccactccactccccacgcgccccctgcctcccacccaggtccacctgccacctggtgaccaccttgagtacagaagtgaaagtggggagagtattttattcaagtcacagcagaactggaaaaaaactcttctgttttaccaacttcttgtgtttcagaaacatattctgttcaaaacttttgaagccctttcggtgtctagtctgcagatgtttttgtatgtgtgcacctctgaccatgtgtgtacatatgtgtcttgctggaaaggacatattcgctgtccccgtgctgctgggagggccgcctcacagcctcacggttcccagccccagcacagtggaggcaggcgtggctgcattcccctcacgctaccctcccagcggcttgtagccgtcactggccagacctccagggtgcggaatcaaataggaagcatgcagagactcggcagcttttcctctgatgtgtaagttatttggaacgcgtgctgtgtcccgcgatgtccctgatgtactgtgcaggcgcggtgcctccgtctcgtcgcacagctgcgcgcccttgtgtgaccctccccataaaggcactttacagcttcatgtttcatccactgtcacttttttttaactgctgatgtaaatggaattttaaaagcagagttctttattgtatggatgacgtttgaataaatatcagcaactcctgccatctgcctttgtctgtcaagacacagaacgtctcagcagtcggggtttccagggccgcagtgcactgtgcttgcacatggtaagtcattgttgggacggaaaagaagccggcagtgggcagggcccagcgtgcggctcaggcaccgagcaaccgctttgctttcttctgtcagacggcgatgatgacaaaatagcaacaaggttgtgcgtgtcagaaacgcaaaggcagcagaggaagcgtagtggaaccattacagaatcacaatgcagccgacactctccagaccagaaaagggagcataaagaaagggtattgatccaatagaagaagggaagggtggagaaaggggaaagcatggttaacaggaaacaacatgtaacggaagagacagcccagatgtgtctggctcacaacagacgtgatcatgttatgctggcctggaagagcatcggatcagacgtgacaagtcactgcttagagaccatcaagcaaatttatatatagattggagatttaaaataaaagaagacagaacagacaaacaccataagaaagctggtgtagcagtatcgatgacctgaaatgggattcaggacagttcatagagtaaagggggctgcgtggcaatcaggaactcataagccactgactataaagctcaaaacacagcaaagttggcagtcggcagacagcaatgttgactgtcatgaaaagtgatccctgtttgcccctaaacgtagagaaatctgcgttattttccagcacacatggagcacaaacaaaatatttgcaaaacaatgggaagatcattgaaacactgtttggcaatttaaaagcttgtttctaactcacgggatgcgggcagtctgctctctagaactggacagcgtgcacagagccacgggagggagcagccacggccagctcagattggtgtcgacagcttagtggtgtctgattttatacatgacaaaatgaacgagttaaccatttaagccaaaaaaataagactagcgtaacccaaagaaagtatttaaatacttctgtcaattaggacagttgagaaaagagaataacaaaatcaaaagcaaaactcaaactttgtacctgaaaaatctaataaaactgactaatttatagaaaacctaagaaactccatatcaaataaaaaattttaaatatgagagaaccattatgaacacctttctgccaatatatttgaaaacagataaataggatttattgttagaattggtcaagaagaaatgaaatacttgggttgatgaataacagttacagaaattgcattgcaattaaaaaaaaaattaccccaaacagataccagatctaggtgattttgtaagcatacaaacatatttataaaagctatttaaaagaatataacaagagaaagcaactcaataaagttatgaatcaaatttaaccttggtacccaaacctgacaaagattatgtaagaaaagaatcagctgggccaggtggctcacatctgttcttctagtactttgggaggccgaggtgggagagttgtctgagaccaggagtttgagaccagcctgggcaacattgcaagacaccatctctacatgaaatttaaaaattagccgggcatggtggcacatacctgtagtcccagctacttgggaagctgagaccttacaagtgagcccaggagtccaaggctgcagtgagctatgatgatcatgccactgcactccagcctgggcaacagagcaagaccctgtctctcaaaatcaaccaaacaaaaagacaatgtaagaaaaaataaaattatgaagatgaatgcaaaaattccaaatgaaatataattaagtaaaacccaattctgtgttataaataaaggtaatactttctaagcaagtaaattcatcccaggaatgcaaggggtagtatgttaatgtggctataatttgccatattaatgaagtgaagggtaaaatcaccagcttaacaaatgcaaaacaataattcaatttttattcaacatgtacttgtcatgttaggccaactaggagtagaagaaaatttctttaactaaataatatgtatcaaacaaaatctttgcagcgaactttttttttttgtttgtttgtttgtttgttttctgagacggagtctcgctctgtcgcccaggctggagtgcagtggcgcgatctcggctcactgcaagctccgcctcccgggttcacaccactctcctgcctcagcctcccgaggagctgggactacaggcgcccgccaccacgcccggctcattttttgtatttttagtagagacggggtttcactgcgttagccgggatggtctcgatctcctgacctcgtgatctcccacctcagcctcccaaagtgctgggattacaggcgtgagccaccgcgcccggctgcagcaaaaattttaagtactgaaatcctttagaaccatccccattggcagcagaactgaacggggccccactactctccagcgccatttagccgcagtactagtgactaccaccgcaaaggaaaaggaaacaaggccagcgcggcggctcaggcctgtcatcccagcactttgggaggccgaggcggcagatcacgaggtcaggagatcgagaccatcctggctaacacggtgaaaccccgtctctattaaaaatacaaaattagccgggcgtggtggtgcatgcctgtaatcccagctactcgggaggctgagacgggagaatcgcctgatcccaggaggcagaggttgccgtgagccgagatgtcgccattgcactccagcctgggcaacaagagtgaaactccatctcaaaaaaagaaaaaaagaaaaaggaaccaaggcatgctaattgaaaaataacttttcatatctagaaaaaccaggtgaattcataaactattgaaactaagaagtccacaagatcaacccacaaaaagttattaacattcctagcaataacaatactattttaacagcaacctaaatactaaaataaatgtaacaaaagttttggacaaaattatgaaacatgatagaaggtcataaaagaaggcctaaatgggagatttttatggatgggacaattcagtatcaccaaagtgttaactctcccccaagttaatctgtgtatttcatcaaaattccaacagaattctttgtggaattaggaagttgattgtaataaacatagaagataaaggtctgagtatagccgtggtgattcggggagcagaggcaggaggaggagggctcacctaccaggcatctggatagatcataaacctgtcatcagtcgtgacaagggggagagaggctaaactggtcgagcagaattcagattcccaggcagggatgtgtgcagggacctggcttgtcctggggctggtcaatctttggcacggaatggcctcttcaggaacgggtgttattgggacagctgcctttccatgtggatgatggcataaaagtatagcccccccaaacttaagattaaaacattattatgaggaaacagaatattcttattgcctagggcaaggatagatttcttacaaaagacaagctacactttaagagatggacaaaaagataagatggacaatctgagcacatcccatggtgaatttctctccacgctaagaccccagacaagggtgaaaagcaggaccaaggcccagagaagaaaaattctgctcaaaatcataactgttcaaccttgcatacattctctctcttaaactgaaagttagcatcctacagcactggtgtgacacccggcaggcccgagggctcagctgcctccagctgtggccccaagaaggcaaagcacccgggtggggtggagggagcagccccgtgctctactggctgacagtggtgcccaggcccagctcccttctctgcacagacagcagagttccgcttagcacaggcttttcctcgccagtgcacacactgtcagccattggaactggcctgcaagacagcttgctgtggcggctttgcaggcacagggcacacaggcatccgtgcacgcagctcctctgtcctcccatgccctgcaccctccgtcacaaggaaacccttgcttctaggattgcaccaaataggatttggaaccaattggtgcccaagctcaaatcctgttagtggctgcctgtttccctggcatacatgcgtcctgccgagatgcatttggcaccaggtgggatgtgctcactggttcccaaaacgagaacacatagcagtttccctggatgtttgttcaatactattcccgggacctgcccgtagattccaattccttatgggtgtggaagagcctggaaatcacgtgtgtgtaggtgtgtggcatgtgtataggggtgtgtttatgtggtgtgactttggggtatgagtgtggcatgtgtacggtgtgtgtgagtgtggtatgtgtatggcgtgagtttgggttgtgcgagcgtggttctcatgtacgagtgtgagcatggagattctttggtagggaaggagtcagggtctccctctgtcgcccaggcttgagtgcagtggcacaatctcagctcattgcaacctctgcctcccgggttctctgtctctgggaccacaggcatgaaccaccaagcccagctaatttttttattttttgtctagctttggtcttgctatgttgcccaggttggtctggaactcctttcctcaagcgatcctcagtcctcagcctcccaaagtgctgggattacaggcatgagccaccacccaagagattctgatgtcacagacatctgactcacacactccctggacagctcacgtgtgcccaccaccacagtcagggatggctgcagatgaacaaggtgctgacgtggtttctgtagcccccaaacaagcaacttgccttgagatgacaaccaaagttttcctgtgtcctccacactcaagagtgactgtgaggcggaggggcccagcccttcttgcaggcgggaatgagtggatgggtggatcaacagaggctgccacaggagagagggaggcctggcctgggaacagagctgtgaccgtgcccttccccagggtaggggctgaaggaccctcccatcctagtgacagggccacagcatgtccaaggaggccccagaggaggtcccgggagtcctgggagagcctggttagcctccctgaagggaggaagtggggttttgtgagagggatggtgcagcagcccccacacctgctactccgtgtggccgggtccagccccaggcaaggttccaggcatgcccctgggacagacgtgggagggagaccagcaggcaggtccccctcagggaggtatggagcgggtccccggggccaggtggagcccctcacacctgtgtcctcaaggacccacaccaggacaatggccataggcgggcacctgcagccgccctggccagcagtgagacgggcagagagcccagccagatagcccggttcctgccccctcccgcctgcccgcacagagagggctgcatgcaggtgagggtccatcacctgaagagcttcaccagccccgaggccatgagccactgaatctctcagggggttttggcgcttgaggttccccaggtcattctgctgcccagagagggttgaggacctctgacctggagccccaaaggggaagggtaccctaagaccagccagccatctactctcaggtgggaaaggggtagggtttagatatggccccctcccctccacgtcctgaaattaccttgggctgtgctggccgagagccgcggggaccagatttgagctggacgtgagctttattccagacggagcagctactttgtaagcgatctccctgggatcgatatcatggaggggcacagatgggcttcagctgtgctgggtggaagagaaaacatgccctgtcggcccctcagcaagtgctctgctctctggactgagatgcaggtcagcagcaagcagggaggctttgggggtgctgggggctgctttgaaaggcacccctgagctaagacttggctgttgggaaggaatcacctccctccctccagccgtaaaaagaactggacatcagcttccaaagaagtcatcagcaatgcaactgttcacatggaggatactccctgcttgaggggtcagacaggcctgctgggcaacccaggaggcttggatgaccgtctaccccagtgtttttgggatggaaagttccacattctgagaaccctcagtccctgggcaacctggggtggttagtcaccacagcttgtggcttgggcccatgacagcaggtagaaatgacgtggactgccgccagccgggcacagtggctcacgcctgtaatcccagcactttgggaggctgaggcatgtggatcacttgaggtcaggagttcgaaaccagcctggtcaacacggtgaaaccccatctctgctaaaaaaaaaaaatatatatatataaattagccaggcatggtgacgtgcacctgtggtcccagctactcaggaggctgaggcacaagaatcacttgaacccgggaggtggaggttgcagtgagattgcaccagtgcactctccagcctggcaacagagcaagactctgtctcaaacaaacaaaacaaaacaaacaaaaagacgtaagatgtggaccgctggagaatgggggtgctgcctgcagtcaaaacggagtgggggtgcccagctcagggccagaatgatcctattcccggcacttctcagtgaggctctgtggctcacctaagaaaccagcctcccttgcaggcaacggcctagctggcctggtctggaggctctcttcaaatatttacatccacacccaagatacagtcttgagatttgactcgcatgattgctatgggacaagttttcatctgcagtttaaatctgtttcccaacttacattaggggtttggaattctagatcgtatttgaagtgttggtgccacacacaccttaacacctgcacgctggcaacaaaaccgtccgctctgcagcacagctggggtcacctgacctttctcctgtcccccccacttgagctcagtggctgggcagcaggggatgcatggccactggccggccaggtgcagctctcagctggggtgttcagaggacgcctgtgtcctcccctcccccatccctctgtcacccttggaggcagagaactttgcccgtcagtcccatggggaatgtcaacaggcaggggcagcactgcagagatttcatcatggtctcccaggccctcaggctcctctgccttctgcttgggcttcagggctgcctggctgcaggtgcgtccggggaggttttctccataaacttggtggaagggcagtgggcaaatccaggagccagcccgggcttcccaaaccccgcccttgctccggacacccccatccaccaggagggttttctggcggctcctgttcaatttctttccttctagaaaccagcatccaggcacaggaggggaggcccttcttggtggcccaggctttggcgggattatttttcaaagaactttaggagtgggtggtgctttcctggcccccatgggcccctgcctgtgaggtcggacaagcgcagggagtctggggcctctcagagtgcaggaagtgcgcacagggtgctcccaggctggggagcacaggtaggggacggtgcgtgggggatggcgcctggggcatgggggatggggtgtgggaaacggcatgtggggcgtaggggatggggtgtggaggatcgggggtggggatggcgtgtggggtgtgggggatgggccgtgggggggtggggcctgggaaacagcatgtggggcatggggtgtgggggtgaggtgtgggaaagtgtgtggggtgtgggggatggggcatggaaagggcgtgtggggtgcaggggatggggcatggaggtgtgggggatggggtgtgtggggtgtcggggatggggcatgtggggtgtgggggatggggcatggaaagggcgtgtggggtgcagaggatggggcatgggggggtggggatggcgagtggggctggggcctgggaatggtgagtggggcatggggatggcgagtagggggtgtggcgtgaggatggctagtggggcgtggggatggcgtgtggggatggcgagtggggggtgggctgtgagggacagtgcctgggatgtggggctgcagccctagctcacagcatggccttatgaccccggccaccttcctgccccaggcggggtcgctaaggcctcaggaggagaaacacgggacatgccgtggaagccggggcctcacagaggtgagcagggactgccactggttttgtcctggggcccagtgggggccaacatcacctccttcccctcccatggcaaagagccagcccgcggggtggctactgcagtgccccccaaggagggtgttccctgctcgagaggaagtgaccgctccagcttggccttccctgggactggggtgcaggcgattttatcttctttgctccattctgttccttccagataatcgtgtgttcttcatcaggttttcctcagttcttgagagcttttctgatgcaaatctgctttcaccccagggcggtcaccggctctgctcacaccagcctccaagggtgtgggtgtcccgggagtgtgggtgtcccgggggcgtgggtgtcccaggagtgtgggtgtcccgggggcgtgggtgtcccgggagtgtgggtgtcccgggggcgtgggtgtcccgggagtgtgggtgtcccggaggcgagggtgtcccgggagtgtgggtgtcccgggggagtgggtgtcccgggagtgtgggtgtcccggaggcgagggtgtcccgggagtgtgggtgtcccgggggcgtgggtgtcccgggagtgtgggtgtcccgggggagtgggtgtcccgggagtgtgggtgtcccggaggcgagggtgtcccgggagtgtgggtgtcccgggggagtgggtgtcccgggagtgtgggtgtcccggaggcgagggtgtcccgggagtgtgggtgtcccgggggcgtgggtgtcccgggagcgtgggtgtcccgggggcgtgggtgtcccgggagtgtgggtgtcccgggggcgtgggtgtcccgggagtgtgggtgtcccgggggcgtgggtgtcccgggagtgtgggtgtcccgggagtgtgggtgttccggaggcgagggtgtcccgggagtgtgcgtgtcccgggggcgtgggtgtcccgggggcgtgggtgtcccgggggcgtgggtgttccggaggcgagggtatcccagaagtgtgagtgtcccaggggcgtgggtgtcccgggggtgtgggtgtcccgggggcgtgggtgtcccgggagtgtgggtgttccggaggtgagggtgtcccgggagtgtgggtgttccggaggcgagggtgtcccgggagtgtgggtgtcccgggggcgtgggtgtcccgggagtgtgggtgttccggaggtgagggtgtcccgggagtgtgggtgttccggaggcgagggtgtcccgggagtgtgggtgtcccaggggcgtgggtgtcccgggagtgtgggtgttccggaggcgagggtgtcccgggagtgtgggtgttccggaggcgagggtgtcccgggagtgtgggtgtcccgggggcgtgggtgtcccgggggttgtgggtgtcccgggagtgtgggtgttccggaggcgagggtgtcccgggagtgtgggtgttccggaggcgagggtgtcccgggagtgtgggtgtcccgggggtgtgggtgtcccgggggtgtgggtgtcccgggagtgtgggtgtcccgggggagtgggtgtcccgggagtgtgggtgttccggaggcgagggtgtcccaggagcgtgggtgtcccggaggcgagggtgtcccgggagcgtgggtgtcccgggggcgtgggtgtcccgggagtgtgggtgtcccgggggagtgggtgtcccgggagtgtgggtgtcccggaggcgagggtgtcccaggagtgtgggtgtcccgggggcgtgggtgtcccgggagtgtgggtgttccagaggcgagggtatcccagaagtgtgagtgtcccgggggtgtgggtgtcccgggggtcgtgggtgtcccgggagtgtgggtgttccagaggcgagggtgtcccgggagtgtgggtgtcccaggggtgtgggtgtcccgggggcgtgggtgtcccgggagtgtgggtgtcccgggggagtgggtgtcccgggagtgtgggtgttccggaggcgagggtgtcccgggagtgtgggtgttccggaggcgagggtgtcccgggagcgtgggtgtcccgggggcgtgggtgtcccgggagcgtgggtgtcccaggggtgtgggtgtcccgggggcgtgggtgtcccgggagtgtgggtgtcccgggggagtggatgtcccgggagtgtgggtgttccggaggcgagggtgtcccgggagtgtgggtgttccggaggcgagggtgtcccgggagtgtgggtgtcccgggggcgtgggtgtcccgggagtgtgggtgtcccgggggcgtgggtatcccagaagtgtgagtgtcccaggggcgtgggtgtccggggggcgtgggtgtcccgggggtgtgggtgtcccgggggtcgtgggtgtcccgggagcgtgggtgtcggggactgcagggacatgggcctcccctcccactcctgccgcccagggcacctcctgtgaggactcggagtccgtgagttcccacctccttgagcccgattctttggtgtccccgcctgcatcctcagcctccttccaaaccagaccagttctctaggggcgtcgacgtgtgaaactgattttaaagaaaacaggcagtggcctttctctcggccccacgtggcccagtagcgctcaccttccgtcccttcttccgcgctcagtaaccaatttaggccgctcctgcagaactcgggctcctgcccaccggcccacagcgtccacctgaggcctcgtcctcccagcaaaggtcgtccctccggaacgcgcctcctgcggcctctccagagcccctcccgcgcgtcctctcagccccgctcgcctcctcccggggcctccctctcccgcctgcccccaggcccgtctcccctcgcgggctgaggcaggttcgggcagcacggccgccccggggcgggggtcactctccaccaccgcgtggtgcccacagctcacggcgctcccgggtgacggtcccctcggctgtagggcgtcctgaagagcggcctgctcggagctgagcgcacggggttgcctcgccctgggcgtctctggccctcaccagccccgtcttcccatgggcaaaacggcggtcctgtttgtccacaagtaaccgtcggggttacggaggggccaggagctgcggcggggggctgtgctctcaggaccggccccaggaggatccgcgcgaggtctggagctctcaggggtcgcgggggacagaggggccccaagcggaggcggggaaggcggcagaagcccaggaccgccaagagctggcgaggaagcccggggctcgctgtcgggggagccgggcaggggccgcgcctcggaccaggacggaggcctggggaaggcggatctggccgccggagacgcggtgcgggtggagacgagggatttggatttccgcgggcggctgtacggatttccacgcgcggttcacgtgggccccagggggttgcccggcacccggggccgcgccgccttctcctcgccggcatcgacccgcagcctcacgtttacgcggcggcgcccgcagcccccttcggcccggcttccgcgcgtgcccccgagcgcgccctcgggatcagcccccggaagcagagaggccaggccgggaaggatgggcgacgggggtggctgacccgggagcacggcagggaggacacccagccaggcccgcgagcagcgccgctcccctcctccaggacgggcgggaacctgcgatgcccccgccgcgtgggccgtggggcggtctccgaggcactgggcggggcacgcggtgggcgcttcacggaactcgcatttcccagtcttcgtaacccaggaggaagcccacggcgtcctgcaccggcgccggcgcgccaacgcgttcctggaggagctgcggccgggctccctggagagggagtgcaaggaggagcagtgctccttcgaggaggcccgggagatcttcaaggacgcggagaggacggtgagcccagcctcggggcgccccgcgccgcggacactgcaggcggcggtgaaccaggccgcgtggggccgcctgcgtctctttggctgcggctgtgggcggcgaacacgcagcggcgcccgcgcggcgctttctgcgggggtcgctttccgcccggggtgactccgctttcctgggcgatgccccccacccccaggcacgcgctctccccgtgcggccgcaccgcgcatgccggttttcacatcagaaaatacgatttgcaaagcacacttagggtgtcccccttaacttcccaagggagtccccccagtccccgaagggtccagggcagcctgcgcatcgcagacgcgcgcggctcgcagaagggacgtggtgagaagctggcccacagcatgccaccagcggcacctcctcagggcacgtgtcggggagaaacaacacttagggacctgggactttctccagctcacgctcacgggtcacctcacactccaagatcacctcaaagaggacacctcacacagggcacacttcacactcacaggtcacctcacactcacaggacacctcacactcacagggcacacttcacactcacgggtcacctcacactccaagatcacctcaaagaggacacctcacacagggcacacttcacactcacaggtcacctcacactcacaggacacctcacactcacagggcacacttcacactcacgggtcacctcacactccaagatcacctcaaagaggacacctcacacagggcacacttcacactcacgggtcacctcacactcacaggacacctcacacaagacacctcacacggggcacacttcacactcacaggtcacctcacacccacaggacacctcacacagggcacacttcacactcacgggtcacctcacactcacaggacacctcacacaagacacctcacacggggcacacttcacactcacaggtcacctcacacccacaggacacctcacacagggcacacttcacactcacgggtcacctcacactcacaggacacctcacactcagggcgcacttcacactcacgggtcacctcacacccacaggacacctcacagaggtcacctcacacaggacacctcacactcagggtgcacttcaaacccacaggtcatttcacctcacactcacaggacacctcacacaagataccacacggggcacacttcacactcacaggtcacctcacactcacaggacacctcacagaggtcacctcacacggggcacacttcacactcacaggtcacctcacacccacaggacacctcacagaggtcacctcacacccacaggacacctcacacaggacacctcacagaggtcacctcacacccacaggacacctcacactcataggtcacctcagtcttacaggacaactcacactcacaggtcaccttactctcacaggacacctcacactcacaggtcaccttactctcacaggacacctcactctcacaggacacctcacacagggcacacttcactcccacaggtcaccatacctcacacagatcacctcatactcacagatcacttcattctcacaggatacctcacactcagggcacacttcacactcacaggtcacacctcacacagatcatctcattctcacaggacacctccctctcacaggtcacctcacactcacaggacacctcacagaggtcacctcacacccacaggacacctcacagaggtcacctcacacggggcacacttcacactcaggtcacctcacacccacaggacacctcacagaggtcacctcacacccacaggacaactcacagaggtcacctcacacaggacacctcacaaaggtcacctcacacccacaggacacctcacactcataggtcacctcagtcttacaggacaactcacactcacaggtcaccttactctcacaggacacctcacactcacaggtcaccttactctcacaggacacctcacacagggcacacttcactcccacaggtcaccatacctcacacagatcacctcatactcacagatcacttcattctcacaggatacctcacactcagggcacacttcacactcacaggtcacacctcacacagatcatctcattctcacaggacacctccctctcacaggtcaccttacactcatctcacactcacaggtcgccacacctcacactcacaggatgcctcacactcacagaaccacatctcatatgcacaagacacctcacactcaggacacctcatgctcaaagaagcctcacactcacaggaggtccagctgtctgaggcaaaggctaacatgaccctttccagacaaattgaggatggtcatgcctagcatttttatacacctagttttgaaagcatttctcatctgttgtattctcacagcaccccgtgagtttaagttcaggtggccaacagtttcttcagcaatcacttttttctgtggagtgcttttgctgtttgtggaatattttgcatctgctactgcaccctctccccgtatgtgtggccaccctgtcagaggtggagctgtggctcagagcctgtgtacctcgtcccaggtccacagctcagcgacagaagagtcagggttgaacctcgggtgttctgacttgggagcaggaaatgtgtggtcacccatagttccagatgtcctggggaggggccaagattagaagaaacctacctcagctccagaggaaagtctggcttcctgagcccaccccgccagacccaggtccaagtcccccaaccccagttcatggtgtgtccagtgcttaccgttgggtgctctggtgaaggtgcatctcacgaggcttgctctcttgttccttcagaagctgttctggatttcttacagtggtgagtggatgatcaccaccagtcctgcctgcaacccttctcagcttactgacaccagcccactccacagatggggaccagtgtgcctcaagtccatgccagaatgggggctcctgcaaggaccagctccagtcctatatctgcttctgcctccctgccttcgagggccggaactgtgagacgcgtaaggccccactttgggtcccatatttgcagagggccctggggagctggtggaggtggcctggccaaccgggctgcagggtgcacaacctggtggggtgtgtaggccgggcattcagggctcagccccagttggaaattggtctaggtgaccttgaaatcccttccagtctgaggtctttgacagggacccaaggttctgattatcagactcagtggccccttgggctcccggccctgggcaattctcagccctcgagatggcccagctgagagtccctgtgtccctgtcccacttccacatcccaccacgcaggaccgcttggtaaacttccccttctctactttccattacaaaggtttgaggggtttgttttttttttaaccatctgaatattaaattatcacaaagtttgaggcccccaacctcccttgggttcagtaattcactagaaggactcatagaatccactgaagtggatacactcacaggtaccgtttattacagcaaaggatgcaggcttaagtctgcagagggaccaggcacaagcttccccttgtcctctccctgtggggtcatgtggacagtccttaattctcccagaatgacgtgtgacgagacgtgggaagtactgccaacttgggaagctctacgagccccggtgtccagaggttttatcagggctcaatcacatagacccagctgaccacccgcatggctgacctcagtctcagcccctccagaggctacgccgatagtgcggcccaaggccccaccatacatcacattgtcagctagaccatccagcatggctcaaggcccaggtaaacaccaacattccctcaggcaagaccttccaagggcttagcggtcatttcccaggagccaaggcaaaggctaccctttctctggcacagcagttcatccttgaccacccaagaccacattcttacactgaatgagctctcctgtgcagcagccattttcttctctaagcagaagagagcccagcaagctggaggaggctgaagagagaggcttcctgctggtcatctgggtccagaatgcctggagatctctgctcagccctggtgcccagcagccctggtgtgcatcctgcagggcaggccttcccgccggagtcctggacttgctcagggccactccccttgcccatgtcaaccaaagtcaggctgccggttctgcttcttctgtctgagcccatgaccagtgctgggactaactgtccccaggcgggctcacggtggtacgaggccagcttggagaactgtctcagctctctggtcctctcgtcagttgggtctctgattggaaagtcccttggacacttttaccatccccattggactttcactttcccccaggctcccatcagctgctcggaagagtggtcaccctggaggccactgcccaccagccaggcaccccccaaatgcaaccgcagccagcactgccagccactggcaaggctgttcagacatgtggctcctctgatccacgccttgtcctttggatcagtccacggagcaggtggtgccaagctcaggctctgtcacccacagctcagtgccaccttccaggcagaacaccactgctgacccagggcatggccaccccgggggctggctctcgctgacccccagaagcccctctcagggtgtccccttcctgtccccagacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacaggtgaccaggcttcatgtcccagtcccagatgacaccagtccctgtcccactacggattatcttactggacaaaagacgggtgggagtggcttcacatctactgagcactaactatgcactgaccaattgtgaggtgggatctgggcaccaagggtggcacaggccagagcgacagtgactaggatgggcaccctgggggcaatccctgaatggcctcaggccccctgccaattctaggcagaccaggggagccaagcaaggcactatctcacgtccaactcccactcgcaggacctccgccagggttcatgaatctacttcggcacagccaatgtctgtactgactgctgcccactctgcattccaaaactcgtaaaggctcctgggaaaatgggatgtttctccaaaccagcctggaacgaatgggctgcacttccaaaagcagggacaccccacacccactgtgtctcaaagaggcggacgtgcccaccctggccacacagcctgggactcagcctgccacctcctcgggcttcctttctggcccaagaccttgattgaagcagatcaaaactaagcatgggatcaaaacaacacagtttgattcatctttaggtagaatttcattcaccttctactaaagtcaaacaacacatcttctccctgaaaagtgagcagagggcggttttaagacgtaagccctctgtttcctccaaaaccagccctgaccattgtctcctcagccagccacttcttcaagggcctctcatggccgggccccaccagtcaggcccagccgaggccctgccttccaccacccctgggccctgggagctcctgctcctgggggcctcccatagcctcggcctcaaggcctctcagaggatgggtgtttctgaatctttcctagtggcacgttcatccctcacaaatctctgcatctttctgacttttgttttacacagttgaatatccatgtggaaaaatacctattctagaaaaaagaaatgccagcaaaccccaaggccgaattgtggggggcaaggtgtgccccaaaggggagtgtccatggcaggtaaggcttcccctggcttcaggattccaagccctgagggtcttgaagccttttgaatgtgaacaacagctctggaagggaaaatgggcaggtcagccccaagcccaccaggctccaagtcagcacacctagcacctccagctcgcggcacccccatgcttttagtggggcaaggaaggagaaaagaaaacgacactcactgagggtctaccctgtgcagagaaccctgcgagatgccccatccgagttgtcacgtcgtcctcacggttactctttgaggtgggatctttgcctgatctttgcaaaatcaggagcattggatcaaagctatgtgaagatcctgtgaggtgaacagtgaaatctcacagcgacatttgtattcttgggccgtgcccaagagcacgtctcggctagagaggggcacagcctcccagagccaggtctgagcagctttgcctgggagggatctgcaaagaccccaggatttcagaaagaaattgtgcaatgccagaggttccttggcatgcccgggagggcgagtcatcagagaaacaatgacagcaatgtgacttccacacctcctgtccccccgcccaggtcctgttgttggtgaatggagctcagttgtgtggggggaccctgatcaacaccatctgggtggtctccgcggcccactgtttcgacaaaatcaagaactggaggaacctgatcgcggtgctgggtgggtaccactctcccctgtccgaccgcggtgctgggtgggtgccactcttccctgtccgaccgcggtgctgggtgggtgccactctcccctgtccgaccgcggtgctgggtgggtgccactctcccctgtccgaccgcggtgctgggtgggtgccactctccgctgtccgaccgcggtgctgggtgggtaccactctcccctgtctgaccgcagctctcaagtgtctcaggggctgtggctctgggcttcgtgctgtcacttccacagacagacagacatccccaaaaggggagcaaccatgctgggcacgactgctgtggccaccgtgctctcagccactttcccatgcccaaataaaacgataaaagactgggggcttctgcccatcctgcctcacttgaccaagagcccagaagaggatgcgacacccagggcctcatgggaccaccggctggcaggggttctgctcactgggtttatgggtgagacgagcactcccaggagggccactgggccgggaagaactgtggagaatcggggcacgccctgtcctcccagctgccagggcacagcatcccttccccacctcaacacccagaccccagattcaccccagttcacttgtccccacacgagccacaggctgccacctggggcaggctggccccaccttggggttagatgcaggtccccttgccccagaaggagactgcagcccctgcagacctagaaatggccacagcccatccccatgcaccagggggtgaggtggcaggtggtggaaagggcctgaggggggcttcttccttccaggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtcctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttccctagcccagcagccctggcctgtggagagaaagccaaggctgcgtcgaactgtcctggcaccaaatcccatatattcttctgcagttaatggggtagaggagggcatgggagggagggagaggtggggagggagacagagacagaaacagagagagacagagacagagagagactgagggagagactctgaggacatggagagagactcaaagagactccaagattcaaagagactaatagagacacagagatggaatagaaaagatgagaggcagaggcagacaggcgctggacagaggggcaggggagtgccaaggttgtcctggaggcagacagcccagctgagcctccttacctcccttcagccaagcccacctgcacgtgatctgctggcctcaggctgctgctctgccttcattgctggagacagtagaggcatgaacacacatggatgcacacacacacacgccaatgcacacacacagagatatgcacacacacggatgcacacacagatggtcacacagagatacgcaaacacaccgatgcacacgcacatagagatatgcacacacagatgcacacacagatatacacatggatgcacgcacatgccaatgcacgcacacatcagtgcacacggatgcacagagatatgcacacaccgatgtgcgcacacacagatatgcacacacatggatgagcacacacacaccaatgcgcacacacaccgatgtacacacacagatgcacacacagatgcacacacaccgatgctgactccatgtgtgctgtcctctgaaggcggttgtttagctctcacttttctggttcttatccattatcatcttcacttcagacaattcagaagcatcaccatgcatggtggcgaatgcccccaaactctcccccaaatgtatttctcccttcgctgggtgccgggctgcacagactattccccacctgcttcccagcttcacaataaacggctgcgtctcctccgcacacctgtggtgcctgccacccactgggttgcccatgattcatttttggagcccccggtgctcatcctctgagatgctcttttctttcacaattttcaacatcactgaaatgaaccctcacatggaagctattttttaaaaacaaaagctgtttgatagatgtttgaggctgtagctcccaggatcctgtggaattggatgttctctccctgccacagcccttgtcaatgatatttcacagagaccctgggagcacctgctcaagagtcagggacacacgcatcactaaatgcaagttcccaggccctggctgcagtgggaggacctggcaagctgcactcttgctgagtccccagggtggtggaagaagaatgagaaacacatgaacagagaaatggggaggtgacaaacagtgcccccactcagactccggcaagcacggctcagagagtggactcgatgccatccctgcagggccgtcctgggcaccactggcactcacagcagcaaggtgggcaccattggcactcacagcagcaaggcaggcaccagcaacccacctcgggggcactcaggcatcatctacttcagagcagacagggtctatgaactacagccgtgggctgcttccaaggcaccctgctcttgtaaataaagttttatgggaacacacccatattagtgtccatggagtggccgtggcagagacgtccagccggacagaccagctgacccgccaagcccagcatggttagtgtcaggacctctgctgaagatgcttgctgaccctggccagaccccggttcctaatgccccctaaacgggacgggagccagtggcgggccctgatccaggtcagagctggctctgctttctcttttgtccgagtgaccatgcctcagtttcctcatgtgtaaaacaggagcccaccgtgatgcttatggtgggatgagatcagcatggatggaacaaggccctggaagggcccatgccatggtcatcgacagcaaagccactctgcagacagatgcttcagtgaattggtagaaaattctgcaaccagaatgcccggggctcctgagggcctaagcccagcccagggttctggaagccactctgacttcttgggagtggaagttggcaggactcttcctgggaagaagcggagggtggggatgagaggacagttcaggagcccacccagacccacaggaggaaactaggggagtcatgcggggtcctggtggagcgccagcctcccttcctgccaatgggaaatgcaggcgcccacctcatggtgctgccggaggagggggcccgggactccccagaggcttcgctgaagggcctgggcgcccccaaaggctacatgtttcatatgggacgtgccacctgccacggctcagctccagctttctgtgagtggcgagatagaatacggggaggccactggccatgggcctgggacagggtgggatgaggcggcaggcttgggccaccaaagccagcatcgccacccagcattgatgacaaagactgcgtgtctgccatgagcatcctgctgttggtgcacacaccgcattggtctctccatacaaacatgcctagaggcgatgtcagagggtggagaccaggagaggcaggagtcagacatctggtgccaccaggaaggcccttctcagaggaccaggctgtgcgtggtgcccgccgtgggaggccagcctggcgttggcatccagcatcatcagtttgtgcagtcgggtggggctcagtgagtgcctcctgtgtgccaggcacaatgacgcacaatgtgtgcacaccaggctcatgtgcaggtggctgcgagacagggcgacccatcaaggcagatgcaccatgaggcagtggccagtgctgtgggtgttaggggcattgctccccggccactacggcatagcaggcagtgatcgccacactggccaagctttagaccatttattccagagaccccagaggcaaaaagcccggctgcacctcccagtgactcccacagccattgagcagagacactcaggaccttgtgatgggaggtttctgcactggagaacgagcccagaagccctctcagcctcggaacagtgtggccagtggtgggcaggtcaggaggggcttcagacacagcctgtccctccagatggtcacgggaaggtcactccccacagaagtacgttttggggccatgcgggcacagaaggtttgggggtgggtggggcaggtgccagcctggcctgtgggaggccatggtgcagatgccaagccccccccgtgacatgagaccacctgataccacccagagagtggctgtgagcggaagggcccgcccagaaacaagcagggccttggggcagaagtcctgggctcagatcccacgctcactgccagcggcctcggctcaggcttctgcgctctctaaacttagttttctcttctggaaaaatgatggggaaaatgatatttgtatgtgaggactgagagttaaatgtaaacatctggaaactacaaaatgagcacgaaatgatgtttttattcttagaacagaaagtccccacacccgcggccctggtgactgatgaggatgaggttctgcggggcctctctggccgcccagctctgcctggggaaggtggggccagagtggatgtgttcccagcgtggtcactcccctgcctcgccagcaggtctcggctccaatcaggaggcctaagccaagtgataagcagccagacaacagccatcccagctggggcgtggactttgctccagcagcctgtcccagtgaggacagggacacagtactcggccacaccatggggcgcccactgcacctcgtcctgctcagtgcctccctggctggcctcctgctgctcggggaaagtcgtaagtgcccctcgcccttcagacccaaaagcagcgccagggagcagggaggggcggcagttggggaaaccctctcatctctgcagcctggacggtgggtgccttgagtgctgccagaggctgggctcggatggctgggcttggcctttccagccaacggcatcctcaaggccagctgtggctccctggggctgagagtcagacgggcggatcagaggtcacagagacaaaaacacaaggacagagtcagagagagaaagggagagggaaggagaaacggagacacagtgagatgggaggccaagaggcagagacagaggtagaaagacggagacagagagagagggaggggttggggcaggcagagacaggacagttagccatctgccaccacagggaggcacaggacgaggggcacagcagaggagctcccagggaggaggaggctgagccgagccagtgccaccactctcggactggctccgtcggggaaggagctgcctaatgcacagctggacaggtgggggcagcagggctgtccaggacccccgggtctgtccaaaagcagaggcccagacaggacagaagccaggcaagcctggggacagcggaggaagaggaggcccctctggtggggacacgagagacagggaccctagacttgtttgcatcctggacaaagtggacaggcaggggcaccaaggggacccaggcctgggaagggaatgtgtgagggagagacggagcagggggagaccctcgtggggtggaaaggggagacccctgggaaggctgagtggatcctcagtgcatcactgacctaaacggcccctccgcctggtgacttggagctccagtcacatcacacgggggtcttctccatcccaccctcaaccccctgccctccccagcctctgtcccctgagccacatcttcctgtctcccacgcggaacgggactcccgtcttcatggggtactgtgtggctccaactcgcccagccttcttcctccccctcaggccacactgccccctgcaggagcccactgtgatgcttgtggtgggatgagatcagcgtgggtggaacaaggccctggaaggacccatgccatcatcatcgacagcaaagctactctgcaaacagacagatgcttccgcgaattggtagaaaattctgcagccggaatgctctaggatcctgaggccctaagcccggcccggggctcccgaggccctaagcccggcccgggactctggaagctgctctggcttattgggaatggaagttggcaggactcctcttcctgggaagaagcagagggtggggatgagaagacaggccaggagcccacccagacccacaggaggaaactaggggagttatgcagagtcctggtggagcgccagcttcccttcctgccaatgggaaatgcaggcgcccacctcgcggacctctgggtccacagggtattggcacccttagctgtgtgatgcgggcctggctcataaccatggcctgtggtgtccccgggggccggcctggaccctgggtggacatggccagccccggagagccagggccaggccatctctctcccctactctgcctcagaggcctcggcagctgcactgtggggtgggtggggctgaacacaggtcccagaaggtcccactcaggaccctgctgtgcacacttttgattttaataaaatcagaatgcgcacagcatctgcagtctagcctttaaacgagcacagctgtcctggcagtcacggaagttcttctggggcggtgggacctcagcattcctttgctggtactgctacaagaaaggacaatggaccaagtagcttaaagcaacagaaacatttctcccacagctctggaggctggaagttcaaaatcaaggcgtcagcggggctggttcctccagaggctgggagagagtctgctctaggcctgtttcctggcctcggggtgccagcggcctcacagcccatggcttgtgggagcattgctcccatcgctgcctccatcatcgcatggggttctcaccatggctgtttttctgtcttcttttctctcagaaggacaccagtcattggatttagggctcactctactcccataaaatgtcttcctaactaaatacatcacaaaagttctatttccaattaaggtcaggttctgaggttctgggaaagacatgaatttggagggacattattcagccctgtcctgccacctgtgagtgttttctgcaatccaactttttattttaataaaatcagaatacgcagagcacctgcagtgccagcctttaaactactgctgttgtactggcaatcattaaagctacgtggcttcagtttcaatctttacattcaacaagtttaaacccattcttcatgagtttggaccttactgactgaaaattttgcttgctggtaaaacttgctcaaatgcagttgctgactgtggaattcactgatgttgccaaaacaacaaacacaactgtgtgctcgaggattgcaatgctcccaacagcttctgaagaaacaaaccacacgacaaatgtctaccaatctggatgctccatatcagagttctagagtgttccattaatttcttgagacaagtgcctaaaaaccttgttttaatttcgttttgccaaaatcccattttactcacatcagaaagtgtggccacgtggcccagacccggcctgctcagtctgactgaagcgttgatgcgactcagccataacagatagcagaagcgcccagattcagtccagagggctgagccaggcacgccatctttccttcattccctcaacacatattggttaagttccggccgtgctaggcacgggcatacagctgtgaccaaacacgtcaagtctttttccagcggagggaaggataagcctgtcagcatgtaatgtcagagaggggttgggtgctagaagacaaatagcacagtgtaaggggatgaaagagacacgagtgggggcaacgtcagagggcgtggtcagggagggtgtctcggagggcgctgggcctgagccacttgggtatctgtggaaagaatgttccagacagggaggtgactggtgcaaaagtcctggggtgtgagtgttgggctcagccagggtcagcgcagagcccagtgtggcagagagaggtgaatgagggcagagttgaaggtggtgaggcctgggaggcctggccatgggaagaccctgggctctgttctaagaccactagaggcagattctgggtagtccttgacttccttgcatcaccctttccaccccgtgcctgccacctgtaccctcttcctcacacagtccagctcaaccttataggccgtgtcctacccccatgagctggggagagctgagcaggcttcagggagatgggaaaaggcgggaactggacaggggctgcaaaggaaaggtgacttcttactggtcaatcagcctggggatgctcgggggtggatgccaaggggaacagagctgtggccgctatcacagaacagcgagttcctctaagaggtcagaggaggcgcaagggatcgaccagagacagtgagggcgtcaggctccagttgagtggggaccaatccttgtggcaagtctgtgaaccatcactgtggctctagggtagcagagaaaaaagcaggcatatgtccatctggccacaaggaaggagaccaaggggaagagagaaggtaccaagagaggtgttcacatggaggtgcgtcagaacaccgagggcaaggcagaacgcggtcttcagaccccaactggagcccaggaggcccgcgagtcccagtttgggaaacactaagccaggcttggataacttgtctgaggctgtggtcatcccaacatgagagccagaggccccaagggagatgggcattccccacccctcagcttcctcagtgccttttgtggagtggaggtgacatgaggctgcaggttgcagggagccacgtgtgggctgcatttcagagcaagtgtgtgggagtggagcagacacgcagagtaatggggcagggtcaagaaataataaatctaagtctagcgttggtgggataatgtcggtgtcactaaaagaaatggggaatttggaaggtaaagtaactggaggtaggaatgaacccaagatttactaagcaccttctgtataccaaactcaacactaggagtttatacaatctttaaaacagctctaagagtagatattataattcccttctgccaataataaataataagtgactaaggtgtttttgaagctcaagattgcttgattctgcagtcttgttttaaattttggacatggagagtttggagttctgagatgagggaaggcatctgtcatagtgagagagctgaaaacatggagctcaggacaaaagtcagtgctagagagatcagttggaagagttatctttattgtagtgagacattgaatttttcagtggaaaaaaagcacagaaaaagactacagagggccaagaaaagaaactgaggctgtcaaaatgaaaagaggaggaggagtgggtgagagacaaaggagacacaggcagagagatgtggacagcacagcccacagacacacactctacaagggacacagactctcggatccagggcattttaaccagcagatcaagactcatttgccagtcatgaaatcaactcagtatttttttttaaaagagtagaatcaaatagaaaactttgtactaagtactgtattttaggaaatactaataaatactatttcttgaaagttggcatgtatgtgtgtcctggcacttcataaattgtactattatagtttgtaattgaaacagcatcaccaatccccacataacaaagagcagagaccttaaagacgagtggggccaggctgaaggggcacagcttgagccaaagcacagaacagtgggctgaaagcaccctagggagggagaattcaaggaagggggcttgggtggccaggctgagccagcgtgagcatgtgaggaggctggtgagctgattgggtgggatgtgtctacttctccagagaagggtgcatgggtctagagcaggtgcctcatgctgtacctcatagagaactggggggaggggggaaatgggcatttccctccacagcccccaaagtgcctgaggaaagtgttgataaagaagccaaactctgtaaaatatttgaagagatttattctgagccaaatgtgaggaccacgacccatgacacagccttggaaggtcctgagaacatgtgtccaaggtagttgggtcacagcttgattttatgtattttagggggacagaagttacatacagacaccaatcaataagcataagttgtacactggttcgttccagaaaaggggaaggtgggggcttccaggtcataggtggcttcaaagatattctgattggcaatcagttgaaagagttattatctaaagacctggaataaatggaaaggagtatctgggttaagataagaggttgtggagaccaaggttcttgttatgtagatgaagactcataggtggccacccttagagggaatagatggcaactgtttcctcttcagacctttaaaaggtgctacacacatggccaggcgccttggctcatcctgtaatcccagcactttgggaggctgaggcaggtggatcacttaaggtcaggagttcaagaccagcctggccaacatggtgaaactccatctctactaaaaatacaaaaattagccgggtgtggtggtgcttgcctgtagtttcagctactcgggaggctgagacagtagaatctcctcctgaggcaggacaatggcttgaacctgggaggcagatgttgcagtgagctgagattgtgccattgcactccagcctggatgacagagcaaaacaccatcttaaagagaaaaaaaaaaaaaaaaaaaaaaaaaggtgctagactctcagctcagaaaaagacctggaatggtaagggggttctctacagaatgtggatttccctgagatagctttgcagggccatttcaaaatatgtcaaacaaatacaatttggagtaaaatcatttattttagggcctgctatatgtcatgtgatcctatactagagaagtcaggttggaaactggtatcttattgctacaaagactctgtttggtcagcctcaaggtctcttaacgtgaatgctggtcagctgtgcccgaattccaaaggaagaaataatgaggcgtgtgggacctgcttcccctcatggcctcaactagtctttcaggttcctatggaattcccttggcagagaggacgggtccactcagtgagttgggggcttagaattttatttttggtttacaagagagtgatccgccttttgtgatctggatatggcaagggacatggcagtcagggagcataggtgagggggagcctgggtgagggtgaccagagcttttaaccctgtcctccctgccttccagtgttcatccgcagggagcaggccaacaacatcctggcgagggtcacgagggccaattcctttcttgaagagatgaagaaaggacacctcgaaagagagtgcatggaagagacctgctcatacgaagaggcccgcgaggtctttgaggacagcgacaagacggtaagggctggggatagcctggctgttggtaaggagctcaggccacagcgccctcgctggccccgctgctccgtccatccaggggggcggcctggaggaaggggcagcgtgcgcgaaggctttcaggggcggggcccagcaaatcgaggcctcggcggagtcctgcccacagggacatcagtgccgcccccgcgctgactccttcccggcgaggactcagcggggagggatgcgcccaagtcccttgagggtcacagggcttctgccagagttaagttctatttaaaaataaaatgttaacctaaaaaccaatagtcatggtctcggccagcgcctcgccgagttgcagtgagctgagatcgtgccctcccacgcccgcagcccgcgtcctgccttggcctccgtagtcgctgagagcc

SEQ ID NO: 1254 - DNA, 34141 bp, Homo sapiens
aacctcatgaggaccctgtgccagaaccatgaggctaagctactcctgattcctaacccacagaaactgtgacataataaatatttgttagcttaaattggtaagttttacagtaacttattatgcagtcatagataactaatataagtagttcattagaaaagtaaatggtatcaaagtataatcatataggtgataataaatcatgtgtatgtatttttcacataaccccctgaaattcatgacatgataatatgatgagtagggatttatgtcatttgtctttctgtattaaatatttttacaattagcttcatttaacagctttattgacatgtaatcaacaaacaataaaatgtacatatgttgatgttctatctcctagtacctgcaagtgtgagcttatttacaaatgagacttctgctttctacatagttagttaagattaggtcatattgcagtagagtgggcccctatctaatatgacttgtgtcctaatttaaaaagtgaaatttggatagaaagacagacatacagacaaggagaacaccatgagaagttggagctctgctgccatatgctgaggaactaccagaacctaggaaagtggcctggaacagatctttccctagtgccttcaccctactgacaccttgatcttggacttttggcctccagaactgtaagacaataaatttctgttttttaagacacctagtttttggtactttgttacggcagctctagaaaactaatacattgggttaaataaaatatattgttaaaattaattttaaaaatgtaaaattgaatttcttatatttctattggtatattttagaggtatattctagaggtatatttagcaacaaatttatcctgtcaggtttaacaggaagtgatttcttctccaagtgctttatgtggggacgcctatttacttcacgtccccagttaatatagaaagtcaatctataatcagcaaacagcaaacagcaactggtattgctttggtatttacctagacactcttccactgatctgtaatccaaatctcaaactctcaggtctctctttttcttttttttttttgagacggagtctcgctctgtcgcccaggctggagggcagtggcgcgatctcggctcactgcaagctccgcctcccgggttcacgactctcaggtattcttgataatgtatttggaaaaattatctgtctttgacatctgatactctctcctgaacacaattctttgtttgaacttaaaattcatgcaccttcagctatagagattttaaaaatatttttagaaagctatgattttttaaatttattttaaatttttttcatggatatttttgctatcaacataccaataaccatccatcatccatgaccccatagaaccatatcaatttggctgacctgcttgattttgatactaggggtggagaactaaacacaagctatattgttcagaaagcagtcaatcaatgggaacgtaaacattgttctatgagccatggtgagcattttagtaccagttgctttgacaattttctaggcaaatatcatcttgactgtatgcaatggtattaaacttcagggacaaattgttgacttatttataagttgatgaaggttctgtgtgctctttgaagttctggcctgcaagaactttctcatcctatcttctaatgaaacaatatagaaaactaaactttgggggaatatttacccccaaaaatcactttagagaagctgatattagatagataagctgatattacatagaaaaatcagtaattatgataaagtcggatgctcaacaaatagtattcttgtcttcctgtgcccatttacccaattcagcaaaaataagtgtaatgaatctattagaatttctgccctagagaaactttcattctgaaggtcttactcttgaattatggaaaaactaacaacagagacaattagatacatggacatgataaaatatgtcttgagtaggcagtgcagataactgaatggagacaatgaggtagagtagcatgggagaggtctgccttgggtcaactcacaattcttttctgagctgtggtttccttatttgtaaaatgaaggggttggatttcaatgttctattcctgtgatttataaataaaccttctgcccttaaattctgatgtcagcagctggaattagctgtcatcagatgtcatcctccacatttttctctgtctttccttttttttttggcaatgcataaatctattataaaatttatcaaaaattcaaaattttgagacaagatgcagcacttaagtactcttgcatccagggagaataaacattcctatgcttatttaggtaatgttaacttgaacccctaggagccaaactatattagaaacaattatggtaagggataactatagctgttaagagggattttggtaacactaaactaacaattgaggttatgctaatgaaataataaaaaatcgattacaaagaaagttgagatgaagagattttaagagggtgttgagtacccccttgtacatgtgaaagttaccaggttacagcaaaataaaggaattttgtttgcaaacctctacctacaaaaaacctgggggcaggggcaaaggcattcaagcttggaactctcagaagcctaagggttctaggatttctaactctcaagagaaatgatgaaactctgaccatatggggaaggagtgcaatgcttctaagaagggttcggagggatctcacacatgagtttccagatgtcttcagccccatcaagggtataagagcagctctgtccaatacatataccacataaatcacatatatagtttaatattttctagtagccacattaaaaagagtaaaaagaaccaagatagtaattttattaatattttatataaccaacatattcaaaatatcatttaacatgtaattagtataaaatattaatgagatatctaatattcattttttcatactgttttcaaaagccactgtgtattttatgcttatagcacatttcagtttggactaaccacattttttaaccacattttttaatagccatatgtggctgatgactcccatcatattggacagcaaaggtctggaggaagacaatgtataaaattactaattccccaaaaaggtcaagattggtccctgttccctgggaccaagaccttagattacccaggacttctaccataacccactttatccgggtcaagaaaggccatatatttggagtaatgcgtggcttctctaggcaacctcaattccatcagctggggtcagcacactcagaatgaactcaggacttacaaccagtcttttgttaacaggcatcaagagagagccccagattaccactgtcctctacatgccaacactcatagcttcactggcattactcatcttgaatatctcatgatatcctttatccatgtttatgccagtcaacacaagaagcattattctcccaggtcatctcctgcattcaaatctgcataaaactctaccactgactgcagtagcatcaaagaccccaaacaaaaatgcccaactgagcccagtcaacccacagaagaagcataagagataataagaaattggttgttttaagccattaagttttggggtggttttttatggtgcaataaacaactgagacatttaggttaaaaatcttggactcatctccttcccatatctagtcttatcaggaaattctggtggttttatcttcattttatttttttattttcattttctttttgagacagagtcttgctctgttactcaggatggagtgcaggggtgcgatcacagctcactgcaggcttgataccccaggctcaagcaatcctccgacctcagcctcctgagtagctgggactacaggcgtagtcctaccatgggtggctaattcttttgattttttatagagatgaggtcttgctatattgcccaggctggtctcaaactcctgggctcaagtgatgctcccgccttggctttccaaagtgctgggattacaggtgtgagccactgtgtctggttgttctgtcttaaaacatgtatagaatgtagacttcctactacctctatactactaccctagtactagcctccatcttttcatgcctggcttgctgcaacagcgtcctacttgtctcactgcttctgcccttgccctgctacaatcttttctcaagacagcaatcagaatggtctttcaaaaacatttcagatcatatcattcctatgctcaaaatctcccaaaagttccccatttcatttgtgtcaaagtgaacaatctcatgaggtcttgtgtgatctggtctctcatttcctctctgacctcatttcctacctctcgctccctccctcagttccactccaaacaactcctggaacattccaggcataaagcagtttcagttcctctcctgattgttctgtctgccagaaatgttctttcactagatagccgcaagctcagttccttcatctttcaaatctttgctcaactgtcaccttctcaccgtacttaaaattgcaatccacttctgcttctaatcccctttccctgctcttttttctcccatactttgtatcatttcatataatattatatacttatttaatatgtttattatttactttatgtctctctccaatagaatggaagctctctgaatgcagggatttttgtctgttttatttacaaatgtatctgaggcatctagaacagtctagtacctggtaagcacccaatagatacttgctgaatgaatgaaaatctgttgtctgggtgctctgaggctgtttcccaggcaattctcacaattatacctgaggacacccctctgaggctctgtttgcactttgtcattctaatgggtcagaggcatatctaatcacaggaaaaataacattgcccaatataataatgagagaagatattcttttccaatggcagttgtgctcagacacattttaactctcctgcctcagggagcatttcctatatatgaacttcttccacagaaaggggaagactttgtatctttgtttttgtgggccatactgtttctattcctgatcttgttcacaggttatcataatccttaaactcttttaggtcttttgcactaagtttgaaatcctcttcaacaccacaggaatgctgctcctgagatctggatgctgaatagaatttctataagttctggaaaacgtgttggggtaggtggttaggaaatcttacagcaggattgttaaaaatccaagcctcgtaggatttcctcctacaaaggaactgctacagttctgaccactaacctgaaataacagaacaagtcaccaggagatgtgtgtacacaagggccctgaatcttcttggagtgaactcctcttcccctgcctatcatacatttaaatattaaatccaaatacatatttcttctctcaagaactgttcctttacaaaacctgtctataaagcctgcaaaaacaactaatcttcttaggttctttgtaaattctattgcctgcctttctcaatatcaaaacagacaaaaaaacaaaaataaaaccttgggcccccctagaatatgggatgactcatggtactctgctaggtcacatttacacacacacacagagatacatacacacacaaacacatacagatacatacacatacacacacacatgcacacatatacacatatatacacacacacatttttctctagaaaaatataccctttcctaattttccctagaaggggaaaagtatacatctattggcttttgatatgtcatttaaatttttagtaggttcccttttatatttcttcctcaaaaatgcctttttcttctattcttgtagtctgaattccaatttctgttcggtctctacttgcagtgtggtaagactatagtgcactctcagcacattgtgagtagtaacaagccaaaaaccaggggtcatgtccaggttcagatgctcatgtgggagaggtaaaatattgatatatagaggcaaaagtggagtaagggggaaggcaaaggctggagctgaagttttgaaagaaacataccttatttaatgctactgactgctcagaagtcctagcatgtttaatttgccagaacttcttaatatcaaattgctcttgtgtctgaaatcctggttctcttgaattctctttttttttgagacggagtctcgctctgtcacccaggctggagtccagtggcacgatctcggctcactgcaagctccgcctcccgggttcacgccattctcctgcctcagcctcccgagtagctgggactacaggcgcccgccaccacgcccggctaatttttttgtatttttagtagagacggggtttcaccgtgttagccaggatggtcttgatctcctgacctcgtgatccgcccgcctcccaaagtgctgggattacaggcttgagccaccgcacctggccggttctcttgaatcctttgttgtgtagtaatgaatagttttctatcttctttagtattaagaaatggcttttctgatcttctgagaaactaaaacattatttctaattttagatttcccctcacttctcaaggcctcaaacacaatatcctctaatgacattgtctttggggtgacccaaaattatcatttatttcttacttatgagcagagagtttgcagcttttacttgccttgtctcttttaatacctacagccaccccctgggagcagaggagggagtgtgtataaagtatcacatttccacagtttgccatttatttccacttaagctgattacaggttgtgtttacttttcgttattccacagcatctctttagctctgtttcaatagtaaatccctccaacgtgccagtctttctccctcaactggattcgatctgaaaagtaacttaataaaatcctaactgtagactccctctcccttggggtcaaactagaaccccactgaggaaggaactcctacaaacaaaaaagcaggagtagcccttcttgagctggcttgacattattgattctgcgtgggtgccaacatcccagtcatctcaaagaggagattttgtgaatgaaacaacatgaagaggtgaactgtcttttgagaacataagccagaggtagatgtcctgggaatgtgagtgctacagcactgggtaggtgaaaggagatgcctacttccacactcaaacagaacactgcacctcatgatttgctgtgcagtgggagtgggtggttgacctagaggctttgattcagacccacatcacaatttccctctagaatcttcttatttaataactgctgaccctgctataataggtctctgggggatacaccaattctctttcaatgttctggccaaagagtggacaaaaatcccttcccttgatttcccaagacttgggactctcaagatattttactaaatgacaatgaaaaacaaataaatttaaaaaattataaaaacaataatatccattgcagagggtacaacagttacttaggaatgaggaatacaaagtattgtgaaaagtctgaagaattgacaaatatttgtggctggtttctaggaaatttctccttgctgagaatagctttatctggctacccagaaggtttaagtcccttccacagagtcagttcctaggagtcactcaggatgtggtcttggtgattgggcagaatatattgctataaagtctgagaaaagttttaggaaaagtgctgggctcagtgactcatgcctgtaatcccagctcttaaggaggcagaggtgagaggatagcttgagtccaggagttcgagacctgcctgggcaatatagtgagcactcattctcaaagaaaaaaaaacattttaagaaaagtttaaacatatttgtgttttttaaaggctaccttagatacaaaatcattgtcctgaaattttacagttggactgaggtggggtatagtatatctcttgggtaagcagagtatagatggcctgagaacaatttgttgctccttcctttgccacctgcatatgtgaggataacattcttttgcctgtatagaaatgaagtgtgcatttaattttcagtgtatgggtattcccctaggaatctctctagtcctagccatgatcacaatgtctgaatctaccataaccagccccctctcagacccatataccctgtcacattctctgtaagatactctccacagaatatgtctctagctctgctggcacctccctgggggtctttactagcttactcccaacttgccactccatggagcatacgttgctatacttcccaccctggactgcatcctgtatgccttgactctcaggaggtccagactatgggcatgataactagcaaccactatggcgagcaagattcccactgcaccaacagtggctctccacctgctctgggaaacattcttccttaggcactgggaatgagcacccttttcaggtaaaataccacccactaaatacaggggtgtcactatcttctcacaggcccatccataaaagagtagcataaagatagtaattaaattatttaacattttctgatatttttgttattattctaagtactttatacaattaatttatctgacattatttaaccttcaaaacaactctataaggcagttactattttattttattaaatttacaaaaataataatttttttatttaataaaatcccccattttatttactttttaattaattttatagagatgagatttcactctgttgcccaggatggtcttgaactgtctctattatcttctaatcttgacttttttccttatacgctacaatactccaatgaatattcttgttgattttttttttcacacctaagtgtttctattggatgtattttttgaaatggaatttttaggtgataaggcttacaaatttcaaatgtttaatagatagtgcctaaatccccttcaaaaatgtttgccaatttataaccccattatttgtgttccatttttgaaagatataaatatgtgtgcaaatcaactgctccgcatgggtagttccttacaatttctgtaatggaaaacatagagggaaaactacttgcagtttcagtgggagaaaaggttcccgtttcaagaaaagaaaatttcagtaggagaaaatattgtgaaaaacaaggtaattttctactttaagtttctgtcctatgggtataaaaaatagctggacattatcttcttcccaggctcttctcccctcttctccgtcaggctgcattgctggtcatttttggctcctgttggaagcaaactgctctaatgcctttggataagattttaaccaggaattatctttttttttttttttttttttttttttttgagacggagtctcgctctttcgcccaagctggagtacagtggcgctatctgggctcactgcaagctctgcctcccgggttcacgccattctcctgcctcagcctcccgagtagctgggactatctgccaccgcgcccggctaaattttttttgtattattagtagagacggggtttcaccgtgttagccaggatggtctcgatctcctgacctcgtgatccacccgccttggcctcccaaagtgctgagattacaggcgtgagccaccgcgcccggccgaccaggaattatcttaaacagaaaaagaatactctaaggaggggtataccggccagcagaacagtaacccctccccggggttttcacaaggacacaagctggtgtgtaatagacttatctataaagcagactcaactcctaactggaattgttcctgattggttagcagaaacagaattgaggactgacgacagctgcacaagaagatgaaaccatttccttcctcttttctaagcttgtctcttaaaacccactggacgttggcacagtgctgggatgactatggagacccaaatgtctcagaatgtatgtcccagaaacctgtggctgcttcaaccattgacagttttgctgctgctgggtgagtgagggtcattctgaaatggggcaatttcagacactcctactgcctggactccaggtaccagtgtggtaaggagcaggcctgggccctggaagcaggggatagattgaaagaggagagaggaccctgaattcttaagtgttccaatggttcctaaggtcagaactcagaggtagtttcatagtccctggaaagtccattctgcaccaaacattcatgtgtactttgtagtcatgaggaggaacaggaaatgagataaaggggacatatgaagtgaatacttttataaaagatcaactggaaacaggatcttgagatgggtcctggagaaggaagagcccaagctcacctccccagcatttcacatacgcagctaaatttgaagccgtgttctcctgctcgacgttgatccactctcttctcttttacagcttctgcagacagtcaagctggtgagtatgccctttgcttccttgtattgacagtgttgtatcctcataatatgatgctgtgtttgctggggcggcgggggggtatgtctattccactgaaaatcaagcttgggttcagcatgggcagttcccccattttagtggggtctgggatttgcttcttagatccactgaagacccaagggaatgaggccgctgcaagtacagatcttgaactacatctacaataggactcttgggtgcctgacctcccttgggagctcctttggcatccacagtcccttcagggttatttattccacacccctttccactctgcccctcagcagctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccggtcagtggaggaaggccccagggtggacctgggagggccaggacggatgaaatctgtttacagacagaggtttgcaggaaagagtgggcgtggactgcttactgggaagcactgttgtgagttgctcattcattccccatttcacccaccctctttgcttagcatgcgtggtgggggaagggggaatttctaataattttctcagcatgtgttaggttgtttttgcctcagtcttgattgagcaagggggttacgaggccacaaacagctgagtgtgggagaagcagaaggaaatccctactttaaaaaactaccctcctcctgtggcaatgcggtaaagcagagaggttgggggaaatagacctctaaaggctctaaggcaggaggctgccagacaggtgtgtggaggtgggagtgtagaattcagtctggaagatgaggtcagaggtgaggggagggtgaagggtagatcaggcagaggctgataggctgttgcaactattttgacttttattcctgagtgagttgagatggctttaattaaaggagtcacgtgatctgatttagctttatgtaaacatctgacagtgttcagtttaatagagtctgtagagaaaatgcttctagatagtatttcttttttttttcccccaagtagctgggactccaggcacacaccaccatgccaagtgacttgtttttatttatttttatagagacagggtctcagtatgttgcccaggctggtcttcagctcctggcctcaagtgatcttccctcctcaggctctcaaagtattgggattataggcgtgagccaccacgcctggcttagatactgtttctacctgcttccaatgtctgaaaatataagcacatttctattgttgtttacttgagctgcactcttggtgcataaaccctggagatggtcacaggtaaacattcagtgttttagattctcctgttcaacactgaaagggtgatttgtttttgtggtcctttaaggctgctgctgtaccagagagatcctggctgtggagtcgctttctgttgatggtgctttactgaaggggaataaataaatattgagttgacctcaaaagctgcctaatgacatcatagctcctctctgtattggcttcccagagacagccgatagtaattctgactcttcttatgaaaatgtaaaaatatagataataaaaattgagggctgggtgtggtggctcatgcctgtaatcccagcactttgggaggctgaggcaggaggatcacctgaggttgggatttcgagaccagcctgaccaacatggagaaaccctgtttctactaaaaatacaaaattagccgggcatggtggcgcttgcctgtaatcccagctactcgggagactgaggcaggagaattgcttgaacctgggaggtggaggttgcggtgagccaagatcacaccactgcactccagcctgggcaacaagagtgaaactctgtctcaaaaaaaaaaaaaaaaaaaaaaaaaattgagatctgaagcattgttagagagaaactacctagtcccacctatccattgtacaaagaaatgcaactgattagacccaagagctcagcagttaatggcacagccaaaatcgcaatcctgactttagtttctgttttatgccatctcagtaatggtacctggcctttcatatacagaatactttttttttttggccaggcacagtggctcatgcctgtaatcccagcactttgggaggacgaggtggatggatcacttgaggtcgggagttcgagaccagcctggccaacatggaaaaaccccatctctactaaaaatacaaaattagccgggcgtgatggcgcatgcctgtaatccagctactcaggaggctgagggaggaggattgcttgaacttgggaggtggagtttgcagtgagccgagatcgcgccattccactccagcctgggcaataagagcgaaactccatctcaaaaaaaaaaaaaagaaaaagaaaactgtttttttaaatgaatttttatttaaataagatcgaataaattatatttattcctatgatacagcaatttgattttcatctttattaagtctattgaaactttgttaatagatttgtcctccgaggtagctgaattttggaatctgattactctgccatcagtgaagggaaggaattgttgggagtgaggatgtttgtaggcaaaaaggaaaaagtgattttaaatttaaaatttttcttgaatgccccttttattcagagtcacaaatgaatactgaattcacctgtgtgaattcaagtcatgcctttttatttcttatgtggatggaagattttatgcagggtacagtatggtctgaatgtttctgtgcccccaaaattcatatgatatgaattaatcaaatagcaacccccagggtgatggtattaggaggtgaggtctttgggtaggtgattaggtcatgagggcagagcccttataaaagagggccgagggagctcaaaggcctcttccgccatgtgaggacacagtaagaagcctcagttctgtgaaccaagaagtaggctcttatcaaagaagctgtaagcaccttgatcttggactttccagcccccagaacagggagaaataaatttctgttgtttataaaccacccagtttatagcattttgttatagcagccagaacagactaagacagggtggatgagggatgattaaggctctatttttttttttttttaaccagcaacagcatgtggaaaaaaggggggaagaaggctctacttctttgctaatacagttcaaggctgcccaccctcacttcccaaagcttgtacaaaatttaccattaaattagtaatccccagaccacaaaaactgacggcttcaggccctgtcgagtagcctctacagttactgaaatgcgctcatttctctactcaaacgtagtattttaaattcctcagaattgttttaaatatctgctctgcatctttgaaacctctgaaaacttctgcttttagaagtcccacagatataataccatatattgcctataagagaatgctcacatctgtcatgaagcatcttcatttctgtctgccagacatcatgtcaagttctgtgagtaacgtacctctgagactgaaaaacccttggaatctatccttacaactttttcttatcatatttgtgtctttcagaatggctggtgctccagacccctcacctggagttccaggagggagaaaccatcatgctgaggtgccacagctggaaggacaagcctctggtcaaggtcacattcttccagaatggaaaatcccagaaattctcccatttggatcccaccttctccatcccacaagcaaaccacagtcacagtggtgattaccactgcacaggaaacataggctacacgctgttctcatccaagcctgtgaccatcactgtccaaggtatggggagtctgccaagatgtagggaggggagaagaggggatggacaagggctgaggtcacatgggcctacatggaggtctgagaaagcccatagcagcaaaattgggcactggagcaaagaggagtggggtggaagcctggctaagtattgaccaacaagtaggggccagagcttggagccctcacgtcccaggtaataggtagtcaggctgttgtttcactttgaaatgtaggccccagactaaagatggcagtgaagcagagctccctcattgatgcagaggttccctaagctcctgggcattcctaagagctgaggtttgcctcgtttcttctcatggctcatgttatagccattcactccagaaagcctggcacgtcatggactgttcaaggctgtgctccatagagtaatgatgcctccagctatgcgaggctttgggcccaccctccgtactgtccccaggggctaaggggaatccttccctctgctcctgcatgctcaccagtgtgctttcattcatttggtggagaaacctgggtagggaggaggcacaagtccagccacagaaaccctgtgccagtgaggctggggatgtggtgaatcttgcattggtgagtgactcagacacagaagagcttcaggtgacaagcactgggacatagcattggaggtgggaggtgggacagggagaatacaaacgttgtcattaaaatagtaaccccccatcctgccctaatgtctgtcttccctagtgcccagcatgggcagctcttcaccaatggggatcattgtggctgtggtcattgcgactgctgtagcagccattgttgctgctgtagtggccttgatctactgcaggaaaaagcggatttcaggtttgtagctcctcccagtcccttttgttatcagtttccatttggcccagggcctaaccccagacattgccagaatcccgctcttagggctagatatgcattccgatctaggcccaccttttatttattagttcatttattagttcatcctcaacaagagcactaataggagtcacctcacagggttgccatggggatgaaagaggctgatgctcttacaccagtgcctggtaggcagtaacagcacacaaacagggctgttgccattctggaggaggtggtatgtgagggcagcgcttagctagggaaggaggactctccaggcactgggccaaggcagggactgaggctgggtggggcttatatgaggggggagtagatagggtactgcaagcctctgagaaagagaaataatcccactaacacctcacaaagcactttgcaattggttcatagccaacacctcagttactgatgataagtaaatacagagaaacagagagagagagaggcagactgtgagacacaggggtgtttttaaaaggcagagcaagcctcagacagatgccatggcgtggcctttctgacactcctgggcgtccccatgggtgagctgaattctgcctctggactagcccttttccaggtgggagcagcccctgagcaggggaactgggggtgggaggacaggaaacatctgccagagggaaggcctgagctggtcccatccaatcctggccctggtccttggtcctgaggactcaggccccactgcctaatcctgctaacctcctgtgtgtccctcccagctctcccaggagaccctgagtgcagggaaatgggagagaccctccctgagaaaccaggtgaatacagagttgtctcagggattcagtgatggctcaccagggctgccggctggacctgagccagcgagaaggggcttgtgcgagttcagctgggagccagggagggagcagcgatggggggatggccagggctcaaatcgcttggtcaactctgagtctaatttctgggcctaaagaggacctcgctggagatgagaagagaaacaccagtcccagatacagaggagagggcggtgttcaaatttctaggaccaggaatctggtgatatttccagagcaagaaatcagagatactttggtctttctgtggagctttggcagagctggcagaggatggggttaggggctgtaagactgaggccaatcggacgtgggaggcaggagtctaaggggaaaggaggaggaggcctggaaacccctcaatttgctgaggaatctgcctctgtggagggatggggtggagtggccaggctcagctgtctgtggaacactaagaggaggtttgggcttgagaaaattctggggggctaggggcactagtgggctctactctgtgggcaaagctcggttccaatgcccatgcactcaaggttgactgaattttggcctggttctgcccccatcacacagtggagccctgagcaagtcagtctccctgatggggttcagtctcctcactgaggaaatgagtgggtggccagggtgacctctcaggccttctaggtctgacattcaggtgggagtatgtaaaggaacttccaggaggatgccaggcaacttccagactgtagttaaagtcagagcataaaggaaaccagtgctttctctgggggcttccatgacagtaggaacaggcaggaaaaaggctgtcaaagaccgcacctcagatggctggagtatgatttagagcagagccaacagatttaagagcttgagcaaaatatcacttgttcagctgtgcttgcagcaaggttgcacgtccactggccaggcccagtggtgataggggcctgtgttcacaccagggccaaagcagatctggaaaatacaaagtccaagcaactggattatccgtcttgttgtgtggttctgtctacactggcataagcacacttcacgaggcacttttgcagccaggcatgggggctgcataaatggttttttaaaaatcctttcgcaaaaggcaaagctgggttgctggaattgttggggaatgtattagaatgggaattcagaatgtggtttgctgcagaatttacagcatggcaataaaggctctctgtgttcagggggtgagagaagagactagatgcattgtctcagatgtctcccgacttcctgagaaatgccactttgcaaatactggggctacttttcacactggccaagtcagtttatgacaaaaacatgaggcaattaggtgtgttttggacactaaccagagaaagtccttccttccctcccttcctccctccctccttccctccctctctcccttcctgccttccttccttcccccttccctccctccctttctccctccctaagctccctccctgcctctctttttctctctcatgttactttctctttctgtcttcctttttaatgccatggagtactatattcttcaaagttccaacaaagatgcactacatttggacaatgtggaaatggccctcagccttctcttcctgatgtggtcagcaaaaatctggactttacttcactctgatgctgaacaccctgctccacgtcttccccagtatctcagatccccaagctgtctggtttgcttctaggaaagctcagcaattccctgaaaagagtgtggcccaagtgactgcttccctccaccagtgtggcccatggggaaggcttgtggctgggtgaccccaagggtgggtacatgaggccatatttacttagcccttggccttacaggactgtgtcaaggggtcagcagtccttgctttgagtctggttatggttttgcagcctcagcatcagcgtgggcaggcccttttcaacagcagtgccctggctaatctttttctttttccccacagccaattccactgatcctgtgaaggctgcccaatttgaggtgagtaatcccagccatctccttttcctcctgccttgtcccttctctcctgtttcctctcatttttgcctttgttaatgcaaaattaaaatggagactgggcctgaaaactcctgagcaaacaaagccacccaggccttagaaatagccttatcattgcttaaactgcaaacataagtgaaactcaagttggattgtaactaaaaataggtaatacttaacttggatcatttctggtaaatgtttatgttagacagaaataagatttaaccctagccaatcgtaagcagccaactaacataattatgtgactaagaacacttcagtaaggtacctcacccaaaagacaattatgtaactgcaaacctatcaaatttctttatttttcttccacattttccaaattaatacttgtctctgactttctgtcattaaaacattagacctcttttggtttggtgtcacccaattcatgaattgcttcttattcaaatgaactctttaaaattgtattgtgccttagatttttctttaacagtttggtgtcagaagtaggatataaagtagaatctcccccaaagatccctaagagcaatgggtgaccaggcataggtacccattaagcccattgtgttcactggtttcttcctgcatttgtgagtcactaggtaagtccctctcagatatcaggcttgcaacttgtgtcctgagctctctgagtttatttgagtaattttatttctcatttgattcagcagttaatcttggtatttgacaagttcatctgtttccaacaggaactatactaggtccagtatagtgtactagtttccagacaaggtctgatttctggattgggatccagaggtcaaattgggtacttgacagattgaactaggtgttcaacagaaaccgaactgggggtccagttggagtcctcaggtaggtaaatttcagaagggcaagatattatggctttgtcagaatgtacagagtctgggactcctccatctgaaacacagtgatttctatgttcagataatatgggcccagaacctgtgactttctagagaaataggtgtgccttacctattgagccttaccagagatgacttaaagttgcaatggtcacagtgaggatgtttaaatctagaaaaaattgttcatttaagggatgcattgggaaaaaatgagatcccaaatgtctcagaaacaatgataaataattttgattggtatgtaaaggtttctaaaagaatgatttaaaaaaatagtctctctaagtaaatctttacaatgtgctaataagaaagtattctaaacctattaacctctttgattgcttgctttttccatctgaacctactcaatgctaacgtccttaaaaaattagatcctcaaatgagccaggagtatctacaacaactaaatttaactcttgttattgcacacatgaactattataaaagcaaccactaaggctaaaaataataaaaactaattggaaataggccagataaactaggtgtctcgttagtcactcatttaaaatttaatccagtctcaataagattgactcctaataataggtgaaaatgccccaaaactccttcttggagaagcttcgtaccctttctctgggcctttgagttgtgtaaatgtttttaaaacacaagcttcagcaaaatgactcatcaaaaagaaaaaaggaggaattttttagaaacaaactggcaaatgaaaaatcttaatagtcctctccacaaatatcaataaaaagtgccagccatcagaacagctaactttaactagaggctagatccaactaattagttttatattattatacctggcacatggctaaaatttcagaacaaaagccatgaatttctgtttgcatctttctgtatgtttacatatatctacacatgtgtatgctatttgtacataatattattctacctccagatggtatttattagaaacagtattaaaggagctcaactggcctagagaaaaataagcacttatataaattacatattttctcagaagaaaagaactttgccaaaatgcttttcaacttcatatgacctgagtaatctttaataaatgagaatattggtattaatgaaagtgaatattccacctagttttacccaaataagctcatgttgtctgctatacaatttgtcaaaaaaataccttgagatgacaggtagttggttttgttaatattatgtttgccactttaactatgttaaatgaaatgacaggtattcattaaatatctacaccatttccagataagacaaactactaaaacaaaaataaaaaagtgttccacttatctttttctctctacctgattgtttcagaatttggaaactcttattaagtatttttattttcaatctgggtatttgcataggttcaataagaatctattctccttgtaacaggacataattgggcaagtccttggcttggcttcttagcctagagaggcttttaaaggtctaatctgagatttctcaattactagatagtttttaaaaactaaagttgactgataaaaagtcagtaaagtctcttggatatcaccaaagctgtggctaaaatatattttaaaattactgtttttattatacctatataaataatcaggtcaaatttaatgaaactagatttatttttgcaaaaaagttaactttgattttcggtaaaaatggaaaataaaaatatttttctccagaataaaaaagattatattttagtagaaaactattgtgcatccattgtcaaattctaggcctgttcattttctttgaagttttattatctccctataaaccagattgactcctgaatttttgttttttagttccactaaaaactaaaactgcccttttccaaagctctgcaaactgaaactggtgactttaagcttcagaaaaatcactgcaacagagcacttatgccttaatgccaatcttaatgcctgctgctatctgggtcactcagagagtttaccagaatgtttaatgaaataaccagagacattcaaattgcaaaccagtaaagcacatcacattgcaactgctatcttcagtctaccatttaaacttgcctcaaactcacctctagaaattgtttcacctagctgccctctaaactcaaaaactaagatcataatttgctccaaatattaactttgtttttttaatagaagaatactctgaattcctttcaagcaatacaatctaaaatgagcaagttagcctcaatagcaccccaaaatagaagttcttgatatcttaacagcttaacaaggaggagcttgtgttcctactgatgtcaaaagaaatggttgaagatctcagctggctttatggtgattctagaactgggcaacacttgcctccttaaattagaataaggtttccaatgagttacagcagaggagattggcttcatagacagaaaaaggtctgaagaaagcagaaacaaagaatttaaagtggattggctattttaaaactggttaaagttgcaaaagacaggaataggaaaacagaataataaataactggttggttaacatcaggttactcttttgtaaggatgccaattgaaactggcctgtttgggaaattagatttttaggttattaggttattatctctctctcctgatttttccaaaggccagataagaatgtagtttctgtttgatgacttgaaactttatcatgggtgattccactttgatttttagtctgttctgtttgggcctagtgcaggagcttagtgcaaaacaatagcctcctaaaatttaaaagactttaaagaacatacatgagtttttcatcagataatatttatttgtattcattaatttatttgattggttaagtcttggctcccgagaatctttgctcagaggaatttttcaatccttggctattattctccttatagttattgtatttacctccccggtgtattgaattatcctatgggttttaaatgctttcctgcagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatactctcagcttgctgagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaaaccaaccgattgcctttattttgcttccacattttcccaataaatacttgcctgtgacattttgccactggaacactaaacttcatgaattgcgcctcagatttttcctttaacatcttttttttttttgacagagtctcaatctgttacccaggctggagtgcagtggtgctatcttggctcactgcaaacccgcctcccaggtttaagcgattctcatgcctcagcctcccagtagctgggattagaggcatgtgccatcatacccagctaatttttgtattttttattttttttttttagtagagacagggtttcgcaatgttggccaggccgatctcgaacttctggcctctagcgatctgcccgcctcggcctcccaaagtgctgggatgaccagcatcagccccaatgtccagcctctttaacatcttctttcctatgccctctctgtggatccctactgctggtttctgccttctccatgctgagaacaaaatcacctattcactgcttatgcagtcggaagctccagaagaacaaagagcccaattaccagaaccacattaagtctccattgttttgccttgggatttgagaagagaattagagaggtgaggatctggtatttcctggactaaattccccttggggaagacgaagggatgctgcagttccaaaagagaaggactcttccagagtcatctacctgagtcccaaagctccctgtcctgaaagccacagacaatatggtcccaaatgactgactgcaccttctgtgcctcagccgttcttgacatcaagaatcttctgttccacatccacacagccaatacaattagtcaaaccactgttattaacagatgtagcaacatgagaaacgcttatgttacaggttacatgagagcaatcatgtaagtctatatgacttcagaaatgttaaaatagactaacctctaacaacaaattaaaagtgattgtttcaaggtgatgcaattattgatgacctattttatttttctataatgatcatatattacctttgtaataaaacattataaccaaaacattctgtttaccttttcagggctgtattgattggggtgtagactgaactatccggggtctgtttcttttcggtgatgaaagtcttgagaaggtagtaatggataagatgtgagggagaggagagagggagatttggagtgtagggtgagtgcccctcttcttagaactgaatactcttcttctaatgaacttgtattcttgtttccatgtcttcttccctttccttctatagcaaataaagcattcactttgttttggaacacaagttgtcagaaaggcaaacttcaggtgaattgtcagtggagactgctgacttcctgcactgctattttcccagtgcagttaccagaaggatgtgaccttctcagagaagtcattccaggcagattagaaacatgacccacagtctccttgatggtttggtgagtgcccttaaagagccttccattttcctgggacacagcatcactgtgcacaattcttgcatttgaaaagtagcagctttctctgttggatagtttacatcgatttttaaggaggctatggagcttccacccacccttccaaactctatgtattagtctgtctctatgtattagtctgttctcacgctgctatgaagaaatacctgagactgggttatttatgaagaaaagagggttaattggctcacagttccttatcgctggggaggcctcaggaaacttacaatcacagcagaaggcaaaggagaagcaggcaccttctgcacatgatggcaggacagagtgagtgcaagcagggaaggtgccagacacttataaaaccctaagctctcgtgagactcactcactattatgagaacagcatggggaaaccgtcgccatgacccagttacctccacctggtcccacttttgacagatggggattatgaggatgacaactcaagacgagactttgggtggagacagagccaaaccatatcaccctagacagaggctcctcaaatatgtaaagccttgttaaatcctgcttttacattaaaatgcacccaacaatctgactgcttctcagtattctactcctaccaccctggtccaagccaccatcatttctcacttggattactccaatagcctcctgactggcctccctgcactcacccttgccatcctatagtctattctcaccataacagctattgtgatcttttaaaaatgtgtgtcatatttgtcacttcttttccccaaatcatatactatcttccccttgtggttggagtaaaggctagagcttttccaatattctacaggatgctacaggatcttgctcttcactctctctgacctcatctcctactgcttttccttgcttgctgttggtcactcttgctcttccttgaacgtgccaattatacttctgcccagagcctatgttatttcctgtttctggaatgttctttctcatagacccacattatgcctcattatgtcctttaggtctttactcacatgtcaccttatcagtgaggtctccttgatcattcggtataacctgtcgccctcccatactcttaatgtccctttccttcttcatttttctccattgtgcttattactactgatgtactattaatatatgtttactgtttgttttgtgtctgacttccccactcctctcattagaatgtgagctccaggagaggtctttgtctgttttgttcactaccacatactcagagcccaggtcagtgtctagtgcatagtaaagcgcttaataaatatgtgcggaatgagtaaattctttgacgtttgaaatcagagactttaaactggaaagtccttagaaacaatgtagtccaatctcttcattttaaaacggaggaagctgtggcccagacaggtgaaatgacttgttcaaggacaaacaggtagtggatgtcactgacttttatatatatatagtttggattatactacaaattttgttctatagtgaaatggtttggctgtgtccccacccgaatatcatcttgaattcccacaacacatgggagggacccagtggaaggtaactgaatcatggggcaggtctttcccatgctgttcttgtgatagtgaataagtctcatgagatctgatggttttaaaaaggggagtttccctgcacaagctctctcttctcttgtttgccaccatgtgagacatgactttcaccttttgccatgattgtgaggcctcccagccacgtggaactgtaagtccattaaacctctttcttttgtaaattgccccgtctcaggtatgtctttattagcagtgtgagaatgggctaacacatacaacttgctttttttttgtactcaatattgagtcgtgagctttgcaccacattagaatgtctatttaagtcattactttaaggtcggttctatttttaaagctactcaaactaagctactaaacataagtggatatatttaagtgtatgtataaaatttatactaggccagctgcagtggctcatgcctgtaatcccaaagctgtggaaggtagaggtgggactgattgaggccacgagttcaaggctgcagtgagctgtgattgcatcactgtactccagcctgagggacagagcaggaaccagaaaaaaataaaataaaaagaaacaaacaaaaaaacccccaacaaccctacagtggctcttttagaaaaaacaaacaaacaaaaccaaaactgtactgcatgcataagctcccctatgctatgtttgaaccactctgaagagatcaattaaaaagaagtgagtgatattggaagcatgcctctgtgatgctgtggtaacattcataggctgcgttagggctatgcctgtaactcttggagatgagtgggtaagtggggttttgaggtggctgggggctggaagagaaggttggaggagcccacacaagacagccccttaacacgccggggcacagaaccccaggctgggccaacttttccctgctgaggtgaagacccgtctcttgcaggccgttggcaaatgtcttgactctggcatccaggtgtgaccagcttagaccctgagagtgagtgaatttaaagttgacagcttctttcccttttggaattatgaaataggttacttcttttcaaggacagtttgattttccactgtgtaagtcatatattgcacatttctttaaacattcccttttttcctgaactgatcaccttaccagtacggctgatcctctcaagcagcaaactctaccagctgtcactggtgctctcggagagacgattaaccaaggaacccagcccgggaacagtactgacctctacttctggactcctgcctccctcttaaaaagtcccttgaacttcctagtgggttctaacctgtcaaaggagaaaatagccatctatggagtaagggtttttagtttctctttttacaaatggaagtttcctctgaatcaggcaagtaacgttaaatagaagccaacttttaagtttctctaacacactgctaaattgtaacaccagactgtaccacatactctccagctgccagctattgcagttgccatccttgttactatagtggtgagtatctctgcctgtcatgcgtgagagagggggtcgattccccgacggggaggtcacgggaaattgtgtgaggattttgtcaaccttcagaagtctcagaaatgtctccttgttttggctttcagcggaaatccgaacgccagcagatctgaatggaatgttctggattgaagaaagtgggaaatggcctcaattcacaaagtcacaacctgataaaaaccagtgtgactttactgcccagtgaacccatctcgtcctccagcctttaggaggtaggttggactggagcctgcagtagtttactctccacctgagtcctggtctccagctgggaacccacttaggccataaagaaaaacgcacactgtgcctctccaccgggcctctggagacgaggctcctcggggatacaaacagtggggagaacatgagggacatcccgaccgtactctgcgtcctcctttcccaggtgttgcgttctctcttgggctgagtggcgaggtctctcccgagtcccagggccacagtgcaatgtcacatctcctttgtggaaagtgactggtaaaggagagagaacaaaactggaggaatgtaaagtcttcagccacctggtttaatttattcaagagtgattaatcctagatgagaaaaagaattgaaatggatcggaaaaaaatgaaagtgcattggccgggaatcgaacccgggcctcccgcgtggcaggcgagaattctaccactgaaccaccaatgctactgtcagctaaagacctgcagtattgtctcttaaagctcactatctctggccattcactaaggaaccaggcaccgtcttaaatcgcggtttggaaaatattttgttcaagataaaactgttttaagatatacgtgtatatatcttatatatctgtattcgcatggtaacatatcttcggccttcctgagccgctgggctctcagcggccctccaaggcagcccgcaggcccctgtgtgcctcagggatccgacctcccacagccccggggagaccttgcctctaaagttgctgcttttgcagcctctgccacaaccgcgcgtcctcagagccagcccggaggagctagaaccttccccgcatttctttcagcagcctgagtcagaggcgggctggcctggcgtagccgcccagcctcgcggctcatgccccgatctgcccgaaccttctcccggggtcagcgccgcgccgcgccacccggctgagtcagcccgggcgggcgagaggctctcaactgggcgggaaggtgcgggaaggtgcggaaaggttcgcgaaagttcgcggcggcgggggtcgggtgaggcgcaaaaggataaaaagccggtggaagcggagctgagcagatccgagccgggctggctgcagagaaaccgcagggagagcctcactgctgagcgcccctcgacggcggagcggcagcagcctccgtggcctccagcatccgacaagaagcttcagccatgcaggccccacgggagctcgcggtgggcatcgacctgggcaccacctactcgtgcgtgggcgtgtttcagcagggccgcgtggagatcctggccaacgaccagggcaaccgcaccacgcccagctacgtggccttcaccgacaccgagcggctggtcggggacgcggccaagagccaggcggccctgaacccccacaacaccgtgttcgatgccaagcggctgatcgggcgcaagttcgcggacaccacggtgcagtcggacatgaagcactggcccttccgggtggtgagcgagggcggcaagcccaaggtgcgcgtatgctaccgcggggaggacaagacgttctaccccgaggagatctcgtccatggtgctgagcaagatgaaggagacggccgaggcgtacctgggccagcccgtgaagcacgcagtgatcaccgtgcccgcctatttcaatgactcgcagcgccaggccaccaaggacgcgggggccatcgcggggctcaacgtgttgcggatcatcaatgagcccacggcagctgccatcgcctatgggctggaccggcggggcgcgggagagcgcaacgtgctcatttttgacctgggtgggggcaccttcgatgtgtcggttctctccattgacgctggtgtctttgaggtgaaagccactgctggagatacccacctgggaggagaggacttcgacaaccggctcgtgaaccacttcatggaagaattccggcggaagcatgggaaggacctgagcgggaacaagcgtgccctgcgcaggctgcgcacagcctgtgagcgcgccaagcgcaccctgtcctccagcacccaggccaccctggagatagactccctgttcgagggcgtggacttctacacgtccatcactcgtgcccgctttgaggaactgtgctcagacctcttccgcagcaccctggagccggtggagaaggccctgcgggatgccaagctggacaaggcccagattcatgacgtcgtcctggtggggggctccacacgcatccccaaggtgcagaagttgctgcaggacttcttcaacggcaaggagctgaacaagagcatcaaccctgatgaggctgtggcctatggggctgctgtgcaggcggccgtgttgatgggggacaaatgtgagaaagtgcaggatctcctgctgctggatgtggctcccctgtctctggggctggagacagcaggtggggtgatgaccacgctgatccagaggaacgccactatccccaccaagcagacccagactttcaccacctactcggacaaccagcctggggtcttcatccaggtgtatgagggtgagagggccatgaccaaggacaacaacctgctggggcgttttgaactcagtggcatccctcctgccccacgtggagtcccccagatagaggtgacttttgacattgatgctaatggcatcctgagcgtgacagccactgacaggagcacaggtaaggctaacaagatcaccatcaccaatgacaagggccggctgagcaaggaggaggtggagaggatggttcatgaagccgagcagtacaaggctgaggatgaggcccagagggacagagtggctgccaaaaactcgctggaggcccatgtcttccatgtgaaaggttctttgcaagaggaaagccttagggacaagattcccgaagaggacaggcgcaaaatgcaagacaagtgtcgggaagtccttgcctggctggagcacaaccagctggcagagaaggaggagtatgagcatcagaagagggagctggagcaaatctgtcgccccatcttctccaggctctatggggggcctggtgtccctgggggcagcagttgtggcactcaagcccgccagggggaccccagcaccggccccatcattgaggaggttgattgaatggcccttcgtgataagtcagctgtgactgtcagggctatgctatgggccttctagactgtcttctatgatcctgcccttcagagatgaactttccctccaaagctagaactttcttcccaggataactgaagtcttttgactttttgcggggagggcggttcatcctcttctgcttcaaataaaaagtcattaatttattaaaacttgtgtggcactttaacattgctttcacctatattttgtgtactttgttacttgcatgtatgaattttgttatgtaaaatatagttatagacctaaataagcttttaaaactccttcttgtttttcattccaaccaatcgaagtacaaaagtacccaaaggctttcagaagcagaaaatgttggggtgggtgctgaaggaggaatgtgaagaatattcctgagaccgtgtacatgattcctataggggaaggcaggatttggaaaagaatttgaggccaatacattggaacagtactgaagagttagggctggtaaagaggagaggattgagacttacaatgcaggaagagagagggagagatgtggaattggaaaagcagagaatgaagagaaacttaagtactggcagtgtttccatgtgtgatcctatgattcaaattctgtatttttgtcataggaacctggttgagtttgtcagtctagctgttttaataacactaacaaatagtttacatgcttattagctgtttgtaatcatgtcactttatccattgttcttttagagaaaagactctgagtcctggactctggaggatggtatatgtcagaggaagtagatctggtggtacgattaaagttactattgactttatctatgtcagagaaatagtatgatcccatgtggtttctgcccatggcataatgaggatgttggaacaagactctatagattttcagccctgccactttatatactgtgcaaattaaactctccaagcttcagtttccccttccctgcagtggggatgatgatgatgataacagtaccaacctccagactgttgtgagggttcaattaattaatatatgtaagaggcaaagaagaaaggtgtataatatactatcaacaaacattagcaattactattaattgttagttgggtgataactatgtatcaggtacttgacatacacaatctaacttaatcttcacagcagcattatggaatactatcttctttttgaagatgagcattatgaggttcaaagaggttaaacaatttattcaaagacacaaagctataaagtggggacaggaaggctggaatgaagaaccctgtcctgcctgagtctagagcctcagcatgccaccttacaaataggccataactccacttattaccagaccttcccctagatgttttgaaattggtcatattattcctttgaaacacagctggatgctgagccccgtgagaaaaagtgtgcattttattgtatacttgcagagacagagtcttgctctgtcgcctaagctggagtgcaaaggtgcgatctcaactcactgcaacctctgcctcccgggttcaaccgattctcctgcctcagcctccccagtagctgggattacagttgcctgccatcacacccagctaagttttgtatttttagtagagatggggtttcaccatgttggtcaagctggtctcagactcgtgacctcaggtgatctgcccacctcagcctcccaaagtgctgggattacaggtgtgagccaccacgcctagctagttgtgtgttttttatagcaagtgacggaatctgcaaaatatccttaggcacaactttactgccagttgagtcaatgacaatataaaagcaaggatatttgcctttgctttgttggtgtaaacaaaataatcaaaaggataaacttgtgttagttcccagtcaatccaatccagagtatatttgccctatgggcattgggagatttatttttatctcagaaattatgggagagcttggctagaacaatgctacattatacattatatttcttaggttgattttttaaagacggagagaaggttacactaacaactcacttgtccctggctgtcatttcacatttttaactgccctcttttcctggccctggcccaagtcttacgcagcctggcttcacatggaaggaacctgaaaaaaaaaaaaaagagagagagagatggagtaacacgtacatcctgcattacattcttcctttcctgaatctcatctcaattctcaacattgacccccctcaacctgtttgaacttctcaagaggattgatagtactcacttttttatagtttcttagtattttgatagtatgccttttatccttttaaaaaacccaacacacacagaatataagaagaaagatttttatcgtgtttagttgtgacatctcagatcctcccatttgagtgcaatctatttttctatagagaaatataaacaaactttatttacttttaaacgtctgttgatcattttggtttagtttctttggggactgtttcttgtatactaggtatctaaaaatccttatattgtatgtagtcttagtttgattattgtaatcacaactatgtcacccagttccaaagggggggaaaaaagtttgaacaaattaaatcagaacacatgcccattattaaaaaaatcaattcttggtacaagcagtttcttgcccccttcccaggtcctactcctcacaggcaaccactttcaagttgttggttttttaaaagaatttttgattttgcaataattttagatgaacagacaagttgcaaagatactacataaagtcattactctatatcctttctacttcccctaatgttaaaaccttacataaccatgttatatttatcaaacctaagaaattggcattggtataacattaatgactaactgtagattttattcatgttactttttt

SEQ ID NO: 1255 - DNA, 23880 bp, Homo sapiens
acaaaaaaattagccaggtgtggtggtgggcacctgtagtcccagctacttgggaggctgaggcaggacagttgcttgaacccaggaggtggaggtagcagtgagccgagattgcgccactgcactccagcctgggcgacagagggagactctgtctcaaaaaaaaaaaaaaaaaaaaaaatctggaaaagataataaagttgtgaatgtaggttggaactaaactgtggaagtccctgaatgacttcaggagtctaggactttaactgtgttagccaggcacccagcattttagtgagacattctgctttgtagcatttgcattgcgggcacagagagtggaggtggcgctgggaagcgtgctcctgccagccacatttttctcctcactggggaaaagaaaagagcctggtggtggtgattggccatgatgtcataggtcagttaccggcaaaagccctacaagaggcaggggagagcacctgcaaactggggtgcaacagaagggacgtggggaagcagaggctgaggagaccaacccatgggaaggaaggcccgtggaggctgctgcagtgggcagtaacgaggggctggacttgaggattggagaaatcactgcagaatgggcttaatggaagacaaatttttaaaggaaaaatagtgactgatttgtaaaaaaattagatgaccgaaattttaagcacatattactgatagagtgttgataccactggcaaaatgaaaaggcaaggaaggatgatggcttccatgttggacatgttgagtttgtggtaacggcaagaaaacctgttagaaatctccagacttagaactatggacccacgtggaactcaaaaggtcagtttcgatatgtcacttgaataaaatagttttgaaggcatgagagtagaaaagtagagaatggaaagcctctcaagaccctgctgtacattttgaacctcctcttttctttttctcttcctaagtattacttttgtctacttcaggttcgcaatatcatcttcagaaaagcagaccaaagatcaaggaattgttcatttttggcttgagccctttttcttttctctttagctctgtgagtttgtgcagaaggatgagttgaaaccagcagtgacccagctgctgtgggagcgggccaccgagaaggtcgcctgctgtcctctggagcgctgttcctctgtcatgcttcttggcatgatggcacggtgaggctcaaatctagcaggcaatggggtgggagagcaaaggaaggttctgagagggctccttttccttcagtgacattgtcacagtgaggcccaactgagctctgctgtgagttataacgccacctaaatggaaaagcaaatagtgagaggaccagccctcctgcctagtagtagtgggattcagtaaagcaacaggacccaagaggctggccctgcggcagagccacgctatagtgctccacggctctagacaccacatgaggtgctggtacctacccctattggccctttctcccccgatgagtccaatccatgactgcctttaactctgtggcttccttcccctagaggaaagccagaaattgtgggaagcaatttagacacactggtgagcatagggctggatgagaagtttccacaggactacaggctggcccagcaggtgtgccatgccattgccaacatctcggacaggagaaaggtatgtgggggtggttccaaactaaggagagtggagattctcgtgtccaccctgtacacacacccacgttgtcttgctctccacagccttctctgggcaaacgtcacccccccttccggctgcctcaggaacacaggttgtttgagcgactgcgggagacagtcacaaaaggtgagctctcagggaaggccttgggcagaattgggccctttgttgcagtaaacaacttctccctcctcctctgcaggctttgtccacccagacccactctggatcccattcaaagaggtggcagtgaccctcatttaccaactggcagagggccccgaagtgatctgtgcccagatattgcagggctgtgcaaaacaggccctggagaagctagaagagaagagaaccagtcaggaggacccgagtaagtgggcaggggttgacccactgcggcagccagcttctgttctccctgcagggccaggagccactgccaccaccactatctgcaacaacccttagtgtacactgtgtcgtttttgtctaagttgaagttgggccagttcccacccccaactcttactacttcactagtttgaatagcacgtgagcaaggggaagatcagtaaaaatcggattcaggtttgatgggacttaaaaatgtctctttgccccaccttccctctccctctcctccagaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaaggtgtgtgaatgtcctcagcacttcccagatttatttcatacctcagctcagaactgagctgatccccttccggcaatctctgctcctctgctattacatgaagcgaagagtttctgcctctctgtggctactaccgtaggaaaggttcgtgtgaacaatgacgaaactgtcagtgatcacccaggaaggaaagatttaggtaaatgcagagtgtggagttagagacctcagcataaaacagaggctttgtgtctgaggcagggtttgttagaacacgcacgtacccgccggccttttccatcagcttccattgctggcctggccccggatggggccctgtgttccctccactagaggcaatgatgtcttgcagacaaataagacacagagccttgcagcgctggagaaaagtctgacctctgtgactttgaaccattgtctggcgtgatccatctgtttaccatatataggaaacgatgtcttccatgaggaagaggtgcagaaacacgctttggcaacttaaaacaaatggggacctcattgttcccctgcttaattcaggaatcctttctctttacagacacatttgacaattctctaaatgtttttgtagaatttgcccttcctcactttgttcatgcaaaacaaagtatgggctggaatcaaaaatgttgtctctgcttatccatgatccccaatttcattccctttagaatacgagctctgagaccaccatggaggaggagctggggctggttggggcaacagcagatgacacagaggcagaactaatccgtggcatctgcgagatggaactgttggatggtaagaaaaatggctgcactcagcagtttcttcccaattaagataacctgtcccaaacctgcagttactcttccaacaggcaaacagacactggctgcctttgttccactcttgcttaaagtctgtaacaacccaggcctctatagcaacccagacctctctgcagctgcttcacttgcccttggcaagttctgcatgatcaggtaggccgtggggttggtacccccttctcaaggaagatggggatgaaatggcttccctaatgatcctcttcttgctcttagtgccactttctgcgactcccagcttcgtcttctgttcaccatgctggaaaagtctccacttcccattgtccggtctaacctcatggttgccactggggatctggccatccgctttcccaatctggtggacccctggactcctcatctgtatgctcggtaagagacccctcacaacgtggtggcagttcccaggagccccggagtctgttgagagtcagtgtgagaatcaccagggctcttcccctaggctttggcatcaccgcgaacatctgcttgatacttgacctgtacaggcccctggctaagagtcaccccagtgggactgacacttctggttagaagcttcacctctttcccccactccagctttcaactctagacagctttctgactgcttctggagtggcagagcatgggataattgattcctgctgagggccttttctaccagtgttagggtgtagcccggaggtctcggtccccatgacccgcaattccattcctagtctccgggaccctgctcagcaagtgcggaaaacagcggggctggtgatgacccacctgatcctcaaggacatggtgaaggtgaaggggcaggtcagcgagatggcggtgctgctcatcgaccccgagcctcagattgctgccctggccaagaacttcttcaatgagctctcccacaaggtgagaggcagagaggcactgagggctggctgcagagggaatctgtaggtcacctcatctccttaacatggctctctctgtcttacagggcaacgcaatctataatctccttccagatatcatcagccgcctgtcagaccccgagctgggggtggaggaagagcctttccacaccatcatgaagtattgctccccgggccctggggcacattttccacatagcacgggcttaggaatcagacacacctgtatttgaattccacctcggctactctttagctgtacagccttcggcaataacttagcctctctttgtgcctatttcctcttcttttgaggctgatgatacttaacccttagttcttgaaaatattaaatacgataaagttcctaacatggtggcagacatacagtagcactcactccctagcagctgctcctgttaatttccattcacagtgaaaattcctgagccgggggcggggtggggtccctctctgctgaatgggacagggcaaggggagtggtgaggcagacaggggccgtggcagagaacatcagagaagacgagtgctgggggagggtccagggttggtcttagtggatggcagagctggccctgggccatcgaacatcctcatctccccttcctgcagacagctcctctcctacatcaccaaggacaagcagacagagagcctggtggaaaagctgtgtcagcggttccgcacatcccggtatgctgccctccctgagggttctttgtgctgagcggggccctgcaggggagaaaggcccatccctcaccccttcaatgcccccactgtggcatccctgggactggggaggctgatggggaaggttgagcctttactagctggatctcccagttcctcacaaagcccttcctatctgcagaactgagcggcagcagcgagacctggcctactgtgtgtcacagctgcccctcacagagcgaggcctccgtaagatgcttgacaattttgactgttttggagacaaactgtcagatgagtccatcttcagtgcttttttgtcagttgtaggcaagctgcgacgtggggccaagcctgagggcaaggtgagcagcacaggacacttcaatgcctgttgggttctgggctggctaagacatctgccggccctgggcagcatacggctcttgcagtcaccttcccgtcctccttatccccagctgggttgcaaccaaattgccagagtgacctaagaccagatctttgtctccagttctttttttattactccaaaaacacaaccaaagcagcatctcatccaattcttgtttgtttgtttttaatagtttttatttttcagagcagttttaggttcaaagcaaaattgagcagaaagtacagggagttcccttctaccccttgcccctacacatcacagccttccccaccttcaacatcctgcaccagggtggcacatttgttacagctgaacctacacttacacatcatctcctaaagtcatggtttaccttggagttcactgcacgtaatgacatgtacccaccattgcagtatcatacagaagagtttcactgccttacaaatcccctgcactccacctatttatccctctctccccacaacccctgatctttttactgttgccatcactttgtcttttccagaatgtatcattggaatgatccggtatggagccttctcaccttggcttcttagtaatgtgcgtttaaggcctccatgtcttccatggccttgtttctttttaatcagaagtaactgttttcaggcctgctctgaatctccttttctccctccaggctataatagatgaatttgagcagaagcttcgggcctgtcataccagaggtttggatggaatcaaggagcttgagattggccaagcaggtagccagagagcgccatcagccaagaaaccatccactggtacgtaaggcagcctgtgcgggcgagaccagactgggccctcccctcctgcagtgatttgtttcttcttcttttttaaatcacgttttcctgccttttctaggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaaggtatgatgctcccgcctgttcccggccgagaaggcacacagctagggtgcagagggctggtttccataggacctgctgcgggggcctgagtgtagatgctctgccccactgccgcagaagggcctctcctgtacagcttggattttatttcttctgtgcggtgtgggattgtctcacttgttctctgatatctattttttcaccatctttgtgactcagctttttcttattcctttaattctttgcatagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctcttttttttaaaaaaaaaaaaggccgggcactgtggctcacgcctgtaatcccagcactttgcgataccaaggcgggtggataacctgaggtagggagttcgagaccagcctgaccaacatggagaaaccccatctctactaaaaataaaaaattagccgggcgtattggcgtgcgcctgtaatcccagctactcaagaggctgaggcaggagaatcgcctgaacccagaggcggaggttgtagtgagccgaaatcacaccattgcactccagcttgggcaacaatagcgaacctccatctcaaattaaaaaaaaaatgcctacacgctctttaaaatgcaaggctttctcttaaattagcctaactgaactgcgttgagctgcttcaactttggaatatatgtttgccaatctccttgttttctaatgaataaatgtttttatatacttttagacattttttcctaagcttgtctttgtttcatctttcacattagcccagtttcatgcagcagagagagggttatcagtgcagagagagatgagtgagcccagagtcctagggcctgtcccgggatggcagatgagcttcctgccccgtcactgccacctttcccctctcaacctctggaccctgcacagtgaccagacagcctctctggggagaattatgcagtgcctaggctccagatcagtgcttctgaaccgggggcaattttgtctgccagaggacatctgacaacacctggggcctgttttgttgtcatagcctataggggaagaatgctaccagcatttgtgggaagaggccagggatgtggctcaacatcctgcagtgcacaggatggcccctcaacaaagaatcacacggcccacaatgtcaatagcgtcacagttgagaaaacctgctctagaccaagggttgctttctgccgtgtgcctcaccccacccccactcgtgttccctaatcccatctccaaaggttggcagcagaccggcccaggctcgtggaagttcagatcatgatcccctccagctctgcaggagacaagacctgtctcccagcattcctcattgttcccgggtctgcagagggcgtgagctatgctgcaggcgggctgccccctgaagcctgcgcacccctctccagctcctcaagtcttctctgctgagtcaccttcgaaccggaggctgtgagctggctgtcgtgaccacactggtgcctctgctgtcatgacaacagcacactacgtcagtagtgctccctgggcactgagctccctctttgcggggagaagacagtaatgaaaaatgacaagcatgaggcagaggggaagatcacgcttgggtggtgcaggagcatggaggtgctcttaatgctctcaatgagaaagggttaacggtcctggttgcaggaatagctgagtcagaggtggggcttcctccactcccccaccccacccctttcaccattagggaccttcttgccttgctcttgctactctgctctgggtggtcattgtgaaaagcccgcaccaaccatgccagtggcagccagacgaggacacagcctggctctgggtcccagcaggaaaggcaatcccagaaaggcagggtcagggactggagtcctgtgggtgctttttaagcaaagattatcaccaggcaggctaaacttagcaaccggcttttagctagaagggcagggggctggtgtcaggttatgctgggccagcaaagaggcccgggatccccctcccatgcacctgctgatgggccaaggccaccccaccccacccccttccttacaagtgttcagcaccctcccatcccacactcacaaacctggccctctgccctcctaccagaagaatggatcccctgtgggagggggcaggggacctgttcccaccgtgtgcccaagacctcttttcccactttttccctcttcttgactcaccctgccctcaatatcccccggcgcagccagtgaaagggagtccctggctcctggctcgcctgcacgtcccagggcggggagggacttccgccctcacgtcccgctcttcgccccaggctggatggaatgaaaggcacactgtctctctccctaggcagcacagcccacaggtttccaggagtgcctttgtgggaggcctctgggcccccaccagccatcctgtcctccgcctggggccccagcccggagagagccgctggtgcacacagggccgggattgtctgccctaattatcaggtccaggctacagggctgcaggacatcgtgaccttccgtgcagaaacctccccctccccctcaagccgcctcccgagcctccttcctctccaggcccccagtgcccagtgcccagtgcccagcccaggcctcggtcccagagatgccaggagccaggagatggggagggggaagtgggggctgggaaggaaccacgggcccccgcccgaggcccatgggcccctcctaggcctttgcctgagcagtccggtgtcactaccgcagagcctcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccaggtgaagacgggcggagagaaacccgggaggctagggacggcctgaaggcggcaggggcgggcgcaggccggatgtgttcgcgccgctgcggggtgggcccgggcggcctccgcattgcaggggcgggcggaggacgtgatgcggcgcgggctgggcatggaggcctggtgggggaggggaggggaggcgtgtgtgtcggccggggccactaggcgctcactgttctctccctccgcgcagccgagccacatcgctcagacaccatggggaaggtgaaggtcggagtcaacgggtgagttcgcgggtggctggggggccctgggctgcgaccgcccccgaaccgcgtctacgagccttgcgggctccgggtctttgcagtcgtatgggggcagggtagctgttccccgcaaggagagctcaaggtcagcgctcggacctggcggagccccgcacccaggctgtggcgccctgtgcagctccgcccttgcggcgccatctgcccggagcctccttcccctagtccccagaaacaggaggtccctactcccgcccgagatcccgacccggacccctaggtgggggacgctttctttcctttcgcgctctgcggggtcacgtgtcgcagaggagcccctcccccacggcctccggcaccgcaggccccgggatgctagtgcgcagcgggtgcatccctgtccggatgctgcgcctgcggtagagcggccgccatgttgcaaccgggaaggaaatgaatgggcagccgttaggaaagcctgccggtgactaaccctgcgctcctgcctcgatgggtggagtcgcgtgtggcggggaagtcaggtggagcgaggctagctggcccgatttctcctccgggtgatgcttttcctagattattctctggtaaatcaaagaagtgggtttatggaggtcctcttgtgtcccctccccgcagaggtgtggtggctgtggcatggtgccaagccgggagaagctgagtcatgggtagttggaaaaggacatttccaccgcaaaatggcccctctggtggtggccccttcctgcagcgccggctcacctcacggccccgcccttcccctgccagcctagcgttgacccgaccccaaaggccaggctgtaaatgtcaccgggaggattgggtgtctgggcgcctcggggaacctgcccttctccccattccgtcttccggaaaccagatctcccaccgcaccctggtctgaggttaaatatagctgctgacctttctgtagctgggggcctgggctggggctctctcccatcccttctccccacacacatgcacttacctgtgctcccactcctgatttctggaaaagagctaggaaggacaggcaacttggcaaatcaaagccctgggactagggggttaaaatacagcttcccctcttcccacccgccccagtctctgtcccttttgtaggagggacttagagaaggggtgggcttgccctgtccagttaatttctgacctttactcctgccctttgagtttgatgatgctgagtgtacaagcgttttctccctaaagggtgcagctgagctaggcagcagcaagcattcctggggtggcatagtggggtggtgaataccatgtacaaagcttgtgcccagactgtgggtggcagtgccccacatggccgcttctcctggaagggcttcgtatgactgggggtgttgggcagccctggagccttcagttgcagccatgccttaagccaggccagcctggcagggaagctcaagggagataaaattcaacctcttgggccctcctgggggtaaggagatgctgcattcgccctcttaatggggaggtggcctagggctgctcacatattctggaggagcctcccctcctcatgccttcttgcctcttgtctcttagatttggtcgtattgggcgcctggtcaccagggctgcttttaactctggtaaagtggatattgttgccatcaatgaccccttcattgacctcaactacatggtgagtgctacatggtgagccccaaagctggtgtgggaggagccacctggctgatgggcagccccttcataccctcacgtattcccccaggtttacatgttccaatatgattccacccatggcaaattccatggcaccgtcaaggctgagaacgggaagcttgtcatcaatggaaatcccatcaccatcttccaggagtgagtggaagacagaatggaagaaatgtgctttggggaggcaactaggatggtgtggctcccttgggtatatggtaaccttgtgtccctcaatatggtcctgtccccatctcccccccacccccataggcgagatccctccaaaatcaagtggggcgatgctggcgctgagtacgtcgtggagtccactggcgtcttcaccaccatggagaaggctggggtgagtgcaggagggcccgcgggaggggaagctgactcagccctgcaaaggcaggacccgggttcataactgtctgcttctctgctgtaggctcatttgcaggggggagccaaaagggtcatcatctctgccccctctgctgatgcccccatgttcgtcatgggtgtgaaccatgagaagtatgacaacagcctcaagatcatcaggtgaggaaggcagggcccgtggagaagcggccagcctggcaccctatggacacgctcccctgacttgcgccccgctccctctttctttgcagcaatgcctcctgcaccaccaactgcttagcacccctggccaaggtcatccatgacaactttggtatcgtggaaggactcatggtatgagagctggggaatgggactgaggctcccacctttctcatccaagactggctcctccctgccggggctgcgtgcaaccctggggttgggggttctggggactggctttcccataatttcctttcaaggtggggagggaggtagaggggtgatgtggggagtacgctgcagggcctcactccttttgcagaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgtggctggggccagagactggctcttaaaaagtgcagggtctggcgccctctggtggctggctcagaaaaagggccctgacaactcttttcatcttctaggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccagttacttgtcctgtcttattctagggtctggggcagaggggagggaagctgggcttgtgtcaaggtgagacattcttgctggggagggacctggtatgttctcctcagactgagggtagggcctccaaacagccttgcttgcttcgagaaccatttgcttcccgctcagacgtcttgagtgctacaggaagctggcaccactacttcagagaacaaggccttttcctctcctcgctccagtcctaggctatctgctgttggccaaacatggaagaagctattctgtgggcagccccagggaggctgacaggtggaggaagtcagggctcgcactgggctctgacgctgactggttagtggagctcagcctggagctgagctgcagcgggcaattccagcttggcctccgcagctgtgaggtcttgagcacgtgctctattgctttctgtgccctcgtgtcttatctgaggacatcgtggccagcccctaaggtcttcaagcaggattcatctaggtaaaccaagtacctaaaaccatgcccaaggcggtaaggactatataatgtttaaaaatcggtaaaaatgcccacctcgcatagttttgaggaagatgaactgagatgtgtcagggtgacttatttccatcatcgtccttaggggaacttgggtaggggcaaggcgtgtagctgggacctaggtccagacccctggctctgccactgaacggctcagttgctttgggcagttactcccgggcctcactttgcacgtgtgcttacctagtggagacaaaagtacatacctcggtagagcgcgcacgcctgtaaccccagcactttgggaggccaaggtgggtgtatcacctgaggtcaggagtttgagaccagcctggccaacatggtgaaactccgtctctactaaaattacaaaaatcagccaggcttcatggcacatgcctatagtcccagctacaggcatgctgaagcaggagaatcgcttgcaccccggaggcagaggctgcagtgagctgagaccacaccactgcactccagcctaggcaacagagtatgagactccatctcaaaaaaaaaaaaagtacctacctcagagttcaaactagtgaatattaggaagtgcttgagacagtgacaccaaagtgcacaataaatactcgccagtttcattattattaaagaatccatttgaatgtcagctcaacacagcctcctataccgaggcattgtgaaccgcatctccccagcttctccaggcttttccaagaatcagggacactgtagcctgttggtctcagtgtatgacagacacggaggaagcacatctttagctgatacttaaacagagaccctgagcgcacatacacccgcgcacacatgcatggagcttcaccttctctgtcattctgcagtgaccaggagagcaagagctcccacctcccttcaaaacactgtgcccatcccgggcactaaggcctctttaaagcacggcacctccacgagggagggccacagccacatacactccacctggcaggtggacagcgtgagcacgtggaccatagcagggacaaggtgccccggccagccccaacgccctctgccgctgacagggacagaagccctctccagctgcgtgtgctgcagaggccatgcgtagcctccagctgcattctattccactccagtgcctgggccagttagcaccagtgtggaagacagtgagctggctccggacaacagggatggaggaaaggtcccacattcacattcctgatacgtggacaaggtgaggggccgcaatcgctctggcagcattttaaagatggggaagtagcagacacccacgcgtgaaggcaggagagccccaactgtggtggaaatggccccagaatggtagggccaagcctagctccagacaccccagagccctggagaagccaagactgagggagaaagcctgagggaggagcgccccagtccccagggaccggcctggtgcagagctgcagctgatgttcccctctgtgcagccccaccctctgcctcgctgagctccctgctgcgagggcctcgggtgcaagggggaggcaggtctctatctcatggagctgtcagatgagacatcgcgatcggagtcctcagcctcgcttggcggcggcggcgggtcgctaagcgggaccgcagtgaaagcaggagactttctagaaaaaaacaccagttgtcaaccttggggcaggcaggaatcctgaagacggacggcactcctcctcctgctgcctcaccctctggcagcccgtgagaagtaccggaagcgagggcggggccgcgggatggcgagggagcggcagggactgaactctctccaaacccaccctgacagggaaatgggccccgcctgtgtcttgggaactcagaggctgaggtcaggcatgatggctcacgcctgtaattccagcactttgggaggcagaggcgggtggatcacgacgtcaggagttcaaggcaagcctggccaacatggtgaaaccccatctctactaaaaatgcaaaaattagccaggtgtggtggcgggcgccttggaggctgaggcaagataatcacttgaacctgggaggcggaggttgtagtgagccaaaaaaaaaaaaaaaagaaatagctgaagtcacagtaggagagaagctgctgagcctccagcaccctgactctagggccttggctttatgtctatctgcagtatttttgtgatttttaaaaattcactttcttgttgcggtgtaacttacacagggtcaaatgcacaaatcatggccctgactttagataaaaatctgcccccacaacccttctgttccttgccagtttttaaactgcctctaaccaggggaaccaccagagctggtggccttgggaggtttcagccctcccgtcatgaatggacatagctcatccaactgccaagggagagagctgtgggtctgggccagccccaccaggtaactcccaaagggcagccccacagcaagatgtgacccagtcattgcctgagggtctctggggctgtgttccaacctttctccccgctgtgtccccctggaaggccccatgcccaggggaggcgcctaccggtctccagactgggtgatgagccggcggcaggtctccatctgcacgtccaggccgcgcttcatgctgcacatctccatgtactcgtgcaggtgccggttcatgtcgttcttggccgtggccaactccagctgtggtggggcaggcagggccatcggggttaacaggtggcgttcacagcgcctctgttgcccccgccaggaggccaacacgccaagagcagtggctgggccgggggcccaggcagccattactgaaggctcagattttaaaataaaccagaccaaggcagaaggcagcgaatacaccattgtttcctctgcttttcctggaaatctttgcctatggaggaatgcaaaggtactgctgcaggctgtgttcttttaagactgataagagtggtgaggaaagtcagtgtgggcgggatggagcagatccacaggctcccagggccacacaggttcctatggggcccggctcacccctcatcccctgtactgcgctggtcctgggctgtcccctcactgcactgtgagctcccgtaagggttagcgacaggttttcctcatcctggcagacccagacctcgaagggaattaactctctctgtgacccgtggcatacaagcctggctaactgctgaaaggggcccaatcctcttaccattctctccttatcactttattttctcacctaaaagccattttcagacactaaaaggaagactcccatattggaggtgccattgattctgagacctgtcctgatttcagaaatgtcacacgtggaaaacacggggctcagaatcaaagaaatccggtctccctccccgggcccattctgcagcccacactctgaggcaggcggagaggcagggcccaggcagcacaaactcagtgccagggacagtcgactgcctctctttgttttgggtacaaagggcaggggccgcaaggggaagcaaaatgaaacttcctggagatgacgttcgtgactgcctgagtgaagagaacggggaggataccagctgccataatgtggattggacagagagggtgggaacttagagaaagaaggaaacaggttacagggccagacagcagagatggtcaggacagtgacatttggggtgagatggcggctggctgggtgagaagccctagtggggacagcttccctggcaggcttggatccacagctggggccccacagtagtgggaggagcaggacacggtgactgttcaacccagggggaaaatacagtgccaccagcccttgttcagatcagctgcctacaccccaatttctccaccttggaagaaccggagtgcagggagctgggttctggaaccatcactcagggagactgggaagaaggaaatgaaccaaatatattctactgaaatacaaggctagtactgccaccagtagtctctgcatatgtctatgtccccacttaattcacaaatttacagcaggaacaaggtcaggaggtgaacgtgcatgtcaggagatgtccttgacaagccaccttgaaaactgcaggctcgctgtgtgaacagacttgggggtgggacgggaggagacagagagaggtgaggagcggtggggaagaactgcctcccgcccaccactctgggccttggctttaccttgctccatcttagtgaccctgagagatcaaaggtcacaaagataaaggcaccttgggtactcctgaggtcagcaagtcctcctaacggttcccctaatgcagaagtccccaaaccccaggccacggaccagtacctgtctgtggcctgttaggaaccaggccaaatagcaggaggtgagcagtgggcaagtgagtgaagcttcatctgtatttacagctgctccccatcactggcattacagcctgagctccacctcctgtcagatccgcggcggcattagattctcacaggatcctgaaccctaccttacgtgaactgtgcatgcgagggatctaggctgtgtgctccttatgagaatctaatgcctgatgatctgtcactatctcccatcacccccagatgggaccgtctagttgcggaaaacaagttcatggctcccactgattctacattatggtgagatgtataattatttcattatatattataatgtaataataatagaaataaagtgcacaggccgggtgcggtggctcatgcctgtaatcccagcactttgggaggccgaggtggtggatcacctgaggtcgggagttcgagaccagcttgaccaacatggagaaaccccatctctactaaaaatacaaaattagccaggcgtggtggcacatgcccgtaatcccagctacttgggaggctgaggcaggagaattgcttgagcccgggaggcggaggctgcagtgagccaagattgcgccattgcactccagcctgggcaacaagagcaaaactctgtctctaaaaataataataataatttttaaaaatagtaataaagtacacaataaatgtaatgtttgaatcatctcaaaatcatttcccccgggtcagtggaaaaactgtcttccacaaaccagtccctggtaccaaaaaggttggggactgctgcctaaagtcattgcactgggagagaggaggagtcagatgatttgaaaatacttttttttttttttttcctgagatggaatcttgctctgtcacccaggctgtggtgcagtggcacaatctcagctcactgcagcctccacctcccagattccagcaattctcctgcctcagcctcccaagtagctgggattacaggtgcccaccacaatgcctggctactttttgtatttttagtagagacggggtttcacatgttggtggccaggctggtctcacactcctgacctcaagtgatctgcccgcgttggcctcccaaagtgctgggattacaggcgagagccaccacgcccagccaaaaatagcttaaaaggcatgattccatttaagatattattttcgttctttcagatcatgttttacactgggcacttgaggtccagggaagactagggagagatggcagcccgagatctcttctcacgaagatggccgcacaaaggcccctagttggttgaaggcacagtgaaaacacaaaccttaaatccaccatccaaaagagggagacaagaatcaggtcaggcaggaggaggaaacagtgagccgcggtagacgggagggtggggagtactggtttcccttgccatgtctttagctagcagcacaaatccaggaaacctcatctacctggccaagaaaaccaggtttgatgcaggagcaggacagtttgatgtgtgttgggagaatgagtatataggaaaataatttctcgacttccttctcaaacacctccaatgtgacagcaataagaataaagtcaaggccgggcgcggtggctcacgcctgtaatcccagcactttggaaggccgaggcgggtggatcacgaggtcaggagatcgagaccatcctggctaacatggtgaaaccccgtctctactaaaaaatacaaaaaattagccgggcgtagtggcaggcgcctgtagtcccagctactctggaggctgaggcaggagaatggcgtgaacctgggaggtggagcttgcagtgagctgagatcgcgccactgcactccagcctgggcgacacagcgagactacgtctcaaaaaaataaataaataaataaataaatgaaaagaataaagtcactctctccttatccactggtttcactttccacggcttcaggtacccaaggtgaaccttgatctgaaaatattaaatgaaatattccagaaataaacaattcctaagttttaaattgcacgctgttctgagtggcctgataaaatctcactctctctgccgggcgcggtggctcacgcctataatcccagcactttgggaggccgaggtgggcggatcatgaggtcaggagatcgagatcatcctggctaacacggtgaaaccccatctctactaaaaaatacaaaagaaattagccgggcgtgatggcgggcgcctgtagtcccagctactcaggaggctgaggcaggagaatggcgtgaacccaggaggtggagcttgcagtgagccgagttcaagccactgcactccagcctgggtgacacagcgagactccgtctcggaaaaaaaaaaaaaaacctcactctatccagaccaggacatgaaccctccctctgtcccaaggatccacactgtctatactgcctgcccattagttacttaggagccatctcagtgatgagattgactgtcgtggtatggcagtgcccgtgttcaaggaacccttatttttacttcataatggccccaaagcacaagagtagtgatgctggcaatttggatatgtgaaagagaagccaaaatatgctccctttaagtgaaaaggtaaaagttttcaacttaataagaaaaagaatccgatgctgaggttggtaagctctacagtaagaatgaatcttctatccgtgaaattgtaaagaaggaaaaagaaatttgtgccagttttgctgtcacacctcgaactgcaaaaggtaccgccacagcgcacgctaagtgcttagttaagatagaaaaggcattgaatgtgtgggtgggagacatgaacagaaacacgttccagttgacagcaactggacccaagctatcaggaggtcagtgctatctttggtttcaggcatccactgtgggtcttggaacacatgccctgaagataaggggggactacgtatgaatctcccatgtgggcctgaagagaggctgagacgcagagaaggctccatgcctctcccaaagtcagagcgtcgggaaaggaccacctcaccaggccaggagagctcacgggggtcccgtccatccctcctcccacagcaacagcaacctccattctgtggttccacaaatccttcttcctttgtttgtatttttgagacggagtcttgctctgtcgcccaggctggagtgcagtggtgcgatctcggctcactgcaagctccgcctcccgggttcacgccattctcctgcctcagcctcccgagtagctgggactacaggtgcctgccaccacggccagctaattttttttttttgtatttttcgtagagacggggtttcaccgtgttagccaggatggtctcgatctcctgacctcgtgatcttcccgcctcggcctcccaaagtgctgggattacaggcgtgagccaccgcgcccggcctccacaaatccttcttgcagctcctaaagcctagagtttgagctaaagcaccagctccacttgcctctaggtacctctagaaggtacttcaaggcttgggaaaaagcatggagatttctctgttatctcaaaggctgagtggaagaaacaggaaagtcccagtccatctctgagtgccatggcactgatagtgttaataataataaaacagtccccactatgctacactcgctatgagccagacactgccctaagctctatatatgcattatttcatctgatcttctaaacaaccctataggtgaggtattattaaattcctcattttacaaataaaaaggcccggcacagtggctcatgcctgtaatcccaacactttgtggggccgagttaggaggactgcttgaatccagaagtttgagggcagcctggaaaacatagtgacaccctgttctctgtaaaaaaaatcaaaaaattagccgggcgtggtagcacacgcctgtggtcccagctacttgggaggctgaggtaggaggattgcttggatccagaagatcacggctgcagtgggcctggagtgacagagcaagaccctgtctcaaaaaaagaaagaaagaaagaaagaaagaaaaagaaacaggtgtagggctggacacatggctcatgtctctaattctagtactttgggaggccgaggcaggaggatcacttaagcccaagagtttaagacctgcctgggaaacacagggagacaccatctctacaaaaaaatacaaataaaaattagctgggtatggtggcacacacctgtgggcccagctactcagaaggctggggtgggaggatcactccagcctaggcaacagagtgaaacagagtgagaccttgtctcaaaaaagaaaggacagaaagacaagggagagagggagggagggatagagggggaggggaagagagagagagagagaaaggaaggaaggaaggaaggaaagaaaggaaaggaaaggaaaggaaaggaggggctcagagggaacaagtaacttattacaagttcagggtggttgtaagtaacagagctgagatttgaaccgatatctgtctgtttccagagcctgaggtcttcagagcccaccaggaggactatagctgagagatcactcctcctcccaagaccttggtctctagggtcctgcagcagggatgaggccactgcgcctgcagccccactcaaaaccctctgggacaccacgcccctggcttccgctcctgcccttacctctatctggtcaatggtctcctgatactccttctcccgggttttgaacagggactccgtatctttaatcaccttctccaggctatcttcctgctgctggagtagaaagggaagcgggggaggccagccaaggagggatgggatgggacgcattccaaagggccaagtcagggagagagagagagaggaagtctggttaaagaaactggagaaagaaaagcaaaaggataaaggaagaggggagacgcaggtagaggatgacagccacatggggggacagagcaaggagaggagcgggggagtggg

SEQ ID NO: 1256 - DNA, 86405 bp, Homo sapiens
cagtgcaccagcatggcacatgtatacatatgtaactaacctgcacaatgtgcacatgtaccctaaaacttaaagtaaaataaaaaataaaaaaaataaaaaaaaaatgagggcttccaatttaatctcattcagggatgtctattgatgtgcagaagttttgaaaaagatttcaggctgggcatggtcactcacacctgtaatcccagcactttgggaggccaaggtgggcagatcacctgaggtcaggaagtcgagaacagcctggccaacatggcaaaaccccacctctaataaaactaaaaaaattagccaggcatggtggtggacacctgtagtctcagcttctcgggagggtgaggcaggagaatcgcttcaacctggaaggtggaggctgcagtgagctgagatcaagccactgcactccagcctgggcaacagagcaagactccatctctaaataaataaaagggccgggcacggtggctcacgcctgtaatcccagcactttgagaggccaaggtgggcagatcatatgaggtcaggagtttgagaccagcctggccaacatggtgaaaccccatctctactaaaaatacaaaaattagctgggcatggtggtgggtgcctgtaatcccagctactcgggaggctggggcagaagaatcacttgaacttgggaggtggagtttgcagtgagccgacttgcaccattgcactccagcctgggcaacaagagtgaaactccatctcaaaaaaataaataaataaaattacataacaagtcttacctttgttcactgccatcttgttttaactgggtcttcacattcttcttccttggtttgggcaaatgatgctacagtatttagatctgaagtctcagcttgatgcttttttttttttgagacacagtcttgctctgtcaccctttctgtagtgcagtgatgcaatctcagctcactgcaacctctgcctcctggattcatatgattcttgtgcctcagcctcccacgtagctgggattacaggcatacatcaccacgcccagctaaatttttgtatttttagtaaagatgggattcgccatgttggtcaggctgctctcaaacttctggcttcaagtgatctaccagccttggcctcccaaagtgctgggattacaggcatgagccaccacccccaactagctctgtgcttttgagatataaattttctaccttgttccacctaagagtcatccctttagacatgcaagtttagggctgcttagctaacaattgtttagggcattgaaataggtaattgaaagactgatagtttgaatggggaaaagaaaaactacttgaaagctggcaaatgagtatttgttaaggaagttataagttctgcttctgtctgtgtgtctctatgtctatatgtgctgtgcatatgtgataatatttggtaaataaagctagtttttaaattattagtaaaatgaaattggaaggccggatgtggtggttcacacttgtaatctcagcattttgggaggctgaagtgggcagattgcttgagtccaggcgttcaagaccagcctgggcaatatggcaaaactctgtctctgtaaaaaatacaaaaattagccaagcatggtggtatgtgcctgtagtcccagctattcaggaggctgaggtggaagaatcacctgagtctggggaggttgaggctgcagtgagccatgatcactccactgcataacatcctgggcaacagagtgagactctatctccagaagaaagaaagaaagggaagggaaggggaggggacgggaggggaggggaggggaagggaagggaggagggagggaggaaggaaggaaggaaggaaggaaggaaggaaggaaggaaggaaggaaggcaggcaggcaggcaagaaaattggaaaggctcctcctctccctctccctcctctccctctccctcctctccctctccctctccctctccctctccccacggtctccctctccccacggtctccctctccctctctttccacggtctccccctgatgctgagccaaagctggactgtactgctgccatctcggctcactgcaaactccctgcctgattctcctgcctcagcctgccgagtgcctgcgattgcaggcgtgcgccgccacgcctgactggttttcgtatttttttggtggagacggggtttcgctgtgttggccgggctggtctccagctcctaaccgcaagtgatccgccagcctcggcctcccgaggtgccgggatggcagacggagtcgcgttcactcagtgctcaatggtgcccaggctggagtgcagtggcgtgatctcggctggctacaacctccacttcccagctgcctgccttggccccgcaaagtgccgagattgcagcctctgcccggccgccaccccgtctgggaagtgaggagcgtctctgcctggccgcccatcgtctgggatgtgaggagcccctctgcctggctgcccagtctggaaagtaaggagcgtctctgcccggccgccatcccatctaggaagtgaggagcgtctctgccaggccgcccatcgtctgagatgtggggagcgcctctgccctgccgccccgtctgggatgtgaggagcgtctctgcctggccgccccgtctgagaagtgaggagaccctctgcctggcaaccaccccgtctgagaagtgaggagcccctccgcctggcagccacaccctctgagaagtgaggagcgtctccgcctggcagccaccccgtctgggagggaggtgggggggttagccccccgcccggccagccgccccatccaggagggaggtgggggggtcatccccctgcccggccagctgcccgtccgggagggaggtgggggggtcagccccccgctcggccagctgccctgtcggggaggtgaggggcgcctctgcccggccgcccctactgggaagtgaggagcccctctgcctggccagccgccccatccgggaaggatgtgggggggtcagccccccgcccggccagccgccccatccgggaggtgaggggcgcctttgcccggctgcccctactgggaagagaggagcccctctgccgggccagccgccccgtccgggagggaggtgggagagtcagcccctggcccggccagacgccccatccgggagggaggcagggaggtcagccccccgcccggccagccgccctgtccgggaggaggcgggggggtcagccccccgcccggccagccgccccgtccgggaggtgaggggcgcctctgcccggccgcccctactgggaagagaggagcccctctgcccggccagccaccccatccgggagggaggcaggggggtcagccccccgcccggccagccaccccgtccaggaggtgaggggcgcctctgcccggccgcccctactgggaagtgaggagcccctctgcccggccaccaccccgtctgggaggtgtactcaacagctcattgagaacgggccatgatgacaatggcggttttgtggaatagaaaggggggaaaggtggggaaaagattgagaaatcggatggttgccatgtctgtgtagaaagaggtagacatgggagacttttcattttgttctgtataagaaaaattcttctgccttgggatcctgttgatctgtgaccttacccccaaccctgtgctctctgaaacatgtgctgtgtccactcagggttgaatggattaagggtagtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttatctgctgaccttccctccactattgtcctgtgaccctgccaaatccccctctgcgagaaacacccaagaatgatcaattaaaaaaaaaaaaaaaagaaagaaagttggaaaggcttcaggattgtcagttaaatctaattgtttttgcctgggtctactgacagacaggtttacatcgtctctattaccttttttttttttttttttttaatttgttttttgtttttgagctggagttctgctctcattgcccaggctggagtgcagtggtgagatctcagctcaccacaacttccgtctcccaggttcaagtgattctcctgcctcagccttccgaatagctaaactacacatgtatgccaccatacttggctaatttttgtatttgtagtagaaacaggatttcaccatgttggccaggctggtctcgaactcctgacctcaagtgatctgcccaccttggcctcccaaagtgctgggattacaggcatgggccaccgtgcccagcctattacatgttttaaggtcataaaactgctacttctggaatatttcttaaacttgcttgatttgtctaaattgagctaaagctgtaaggtctggctgctgggctccctgaaaccttgcacatatcttactgtatgactgtatttcgttttgagtctctggattctggggtttggacagatgaccatagtgaggcctgcagaaatatgcatgtcctcagtgtttggactgccagctgcaaggcagagccaaacccaatatggccccatcatccctggctcagctgtgctacctggccatgctggaaggggtttgatcttccaggaatttgcttcacagctctttcctgtcccaagatctatgcctgatgtgtaaattcaggacccaaaagggcacaaaaaagcaataactactaaatataaggaaaacaactctgtatacagcatgtataaagaaaagcaagatgtatttggggagataaaagttgtaaaggcattaagatgtgtgtttgttgagaaaaaataaatttgtgcatttaagaagttacttaaaagttgtttttttgtttgtttgtttgtttgtttgttttttgagacagggtctcactctgacacccagtctagagtgcagtggagcaatcatggctgactgcagccttgacctgacaggcccaagcaatcctctcacctcagcctcttgagtatctggactacaggtgtgtgctgccaacccagctgattttctttttcttttttctttttttttttttttgagatggagttttgctcttgttgcccagtctagagtgcaatggtgtgatctcaactcaccacaacctgcacctcctgggctcaagtgactctcctgcctcagcctcccaagtgggattacaggcatgcgccaccatgcccagctaattttgtattttttaatagagacgaggtttctccatgttggttaggctggtcttgaactctcgactttaggtgatccacctacctcagcctcccaaagtgctgggattacaggcgtgagccaccgtgcctggcttacccagctgattttcaaactttttttgtaaagatggggtctcacaatgtttcccaggctgatctcaaattcctgggctcaagtgatcctcctacctcagcctcccaaagtgctggggttacaggcatgagccactgtgcccagccttaaaggttgtttttaaatgaagaaaaaagatatcaataacattaaatgaatgtagaaagttgggaagagaaagagaatagaaaaaaatgtgtaagagattataaaatgtttatgaaaatcttgtgggtcaaaagctgactgaaactggatggatttatttataagcttttaattatttatttatttttagaaaactgatgtttattttccatgaaccttatttccacattgcttaagagactgtggaagaatagcttaagcccactcagtggttgttcctacccatttagtggcctgtgcagtgggagctgcctaccagtcttttgtggaaggctgagcactccagtcttcagtaggaacctgctaaacaggcacagagggcacctgcatgccttcagaccagtgtgcaacttcaggctgagcagcggtgaatacaggaggtggagcagtctatttactctgaagttccttcttgatcacagctttttcagcagctcttccttctcaatcttccttctcaatctcttcaggatctctatagaattagagatcaggtataacctcccttgggtgtccaatggagatggtgccacgcatgctcagaacttcccaggccagcctccaccacatcagacccactgaatgagctctcttcttgttgcatgtaatggcaatgtccatacagtgcagaggagaatctgtgttacacagagctatggtaggcaggttaacataaaaggcctatgtaggaggccagtggtcagccctgggaccagtaaccaccagaagacatggcccccaggaggctgtctggatctggttagtgtaagttccaggaatgaaacagccagcaataggagtggctccaatggcagcagcaaacttcagcacagccaaccagctagtattcctggaggatgatgctgacatcagcagggttttcaatagcacaagctgccaatagaagcttctccagatttatgatgtcgatgccattacttttccttttatagatgtgctgttccatttggaagtcaaggttggtgctacctaagtggcttcctgctgcaaggaacttgaggacaccctcctccttaatttccagaacatcagtgctccaaatatcgtaaaagtttccctttaagttatgacagggctggacacagtgtttcatgcctgtgatcccggcactttgagaggctgaggtgtgaggattgctcaaacccaggagtttgagaccagccctggcaacacagtgagaccctatctctattttaaataaataaataaaaagttggccaggcgcggtggctcacgcctataatctcagcactttgggaggccaaggcgggcagatcacctgaggttgggagttcaagaccagcttgaccaacatggagaaaccccatctctactaaaaatacaaaaattagccaggtgtggtggcgcattcctgtaatcccagctactcaggaggctgaggcaggagaatcgcttgaacccgagaggcggaggttgcggtgagccgagatcgtgccattgcactccagcttgggcaacaagagtgaaactcggtctcaaaaaaaaaaaagttatgatgggaatccagaacaatggatctatggacccttctctaagaagtgaggaaaggtaaggtttcattaaagttagctttagtattgataatacactatatggaactaaaatttgattttctcttttgagtaagaattttgtatagtttgttttttttttttttacagagtcttgctctgttgccaaggctggagtgccatggcatgatctcagctcactgcaacctgcaccccctgggttcaagcgattctcctgcctcagtctcccaagtagctgggattacaggcatgcaccaccatgctcagctaatttttggtagagatggggtttcaccacattggccaggctggtcttgaactcctgacctcaagtgatctgcctgcctcggcctcccaaagtgctgggattacaggtgtgagccaccaaacccagcctgtgtaggattaataagagatagtaaaatatttttgtttatctttgagtaaactgcaaaaaaaaaaaaaaaaaaaggaagagaagagacagattctatctcaggctgtctttattaggtcttttgattgttagaaaaacagacttttctatcaaagaataaaggtttttgctttttaaaaccttttaattatcactttggctaaataaatattattttacagtgatctgtgatcctatttttgttgcttgtttgtttgtttttgagatggagtctcactctgtcgcccagactggagtgcagtggcaagaactcagcttactgcaaactgcctcccaggctcagctattctcccacctcagcctcccaagtatctgggattacaggcactcaccaccacacctagctaatttttgtatttttagtagagatgagttttcaccatgttggccaggctggtctcgaactccccctcagcctcccaaagtgcttggattacaggcgtaatccaccatgcccagcctcctattttggttgttttaaatttttgacaggcttctcaaaatcaaattttaaattcaaaattaagtcttttaggccacaaactaactttgcaatgctacaggaggcccctgcagcatccaaaagagagacaataagcaggcttatttaatattttaagtgacatgggaagcattgtcaaataagaaatgatgtttaactttctttttttgttgttttgcttttctgcttttttgagattgagttttgctcttgttgcccaggctggagtgcaatgacacaatctcggctccctgcaacctccacctcccaagttcaagcaattctcctgcctcagcctcctgagtggctgggattacaggcatgcaccaccacacctggctaattttgtatttttagtagagatggggtttctccatgttggtcaggctggtctcgaactcccgacctcaggtgatccgccttcctcagcctcccaaagtgctgggattacaggtgtgagccaccgtgcctggcctgatgtttaactttcaaattacattttggatatgttattaatgtatgttccaaaattggctgggcacagtggctcatgcctgtaatcccagcactttgggaggcgaaggcaagaggatccttgagcccaggagattgaaatcagactgggcaacataggaatctcttctctacaaaaataaaaaatttagccaagtatgttggcatgccctgtggtcccagctactctgaaggctaaggcagggggattgcctgagcccaggaggtcaaggctgagccatgatcatgccactgcactccagtgtgggcgacagagcaagatcctgtctcaaacaaacaaaaaaaaaacaaaaaaaacaaggcatggtgtggtggctcatgcctgtaatcccagcactttgggaggctgaggtgggtggattgccagaggtcaggagtttgagaccagacttgccaacatggtgaaaacccatctctactaaaaatacaaaaaaaagtagctgagcatggtggcgggcacctgtaatcccagctactagggaggctgaggcaggagaatagcttgaacctgggagatggaggtttcagtgagccaagatcgcaccattgcactccagcctgggcaacaagagcaaaacttagtctcaaaaacaaacaaacaaacaaacaaaaacaaaataagactgtatgagattcctaaaattctgatatgtcttggtataagtcacagttatggctattatgttaaattattacagtccacagaaataaccaaatttccttgtcaattgggtctttaactatgacgattttaaattgtttccacagttaattacttaattctgatgcattttctgaaagctctttacgagcaagtaaaatcatagagtgttgtgtcttcaaggaggttcatggaaagaatataaaggaccctgacaagcacatctttttttttttaaagacagagtctcattctgtcacccaggctggagtgcaatagcatgatctcggctcattgaaacctctgcttcctaagtagctgggacgacaggcatgtgccaccatgcccagctaatttttgtatttttttgtagagacaggattttaccatgttgcccatgctggtcttgaactcctggactcaagtgatctgcccgcctcagattcccaaagtgatgggattacaggtgtgagccaccatgaccggccattgccagattttcatgctaaatcagccagtactgaaattgttaggatatgcagtttgaatgaactccatggtccaagtcagattacctgtgataacccagtttttacctatttatttattttgagacaaggtctggctctatcacccaggctggagtgcagtggtgcaatctcgtttcactgtaacctccttcgccaccccttccccatcccccacctaagccccgcaagtagctgagactacagacatgcaccaccacacctggctggtttttgtattttttgtagagatggggtttcaccatgttgcccaggctggtcttgatctgtgaactcaaagatccatctgtcttggcctcccaaagtgctgggattacaggtgtgagccactgcaccaggccaacccagttattaaacagtactattcacctgaattggaaaaacaaaattggtattgaagaagatatacatccaatgttaagcataaactcatggagagcctggacagctgcctcatccttcctgaatccttaaagcttccactcttagaagctctgtactccatgacacattatggtagagattaaatgatccaaatagaaaatgtgtgtgtgtgtgtgtgtgtgtgtgtggtgtgaccgttttaaattgctaaaatggtttttgaccaatgcttagtttgtcaaatccataatcctggggaaacaataaaaacttcaggtacacttctgctacctgattggccatttgaacatttatagagggagttcattcaattgtcattcggaatgcatattttctggttgtatagaagctttcccacgaaagaagtctgatgatataacagtagctaaaagtttattaggaagtgtgtttttttcagggggcattcctggagaaatctccagtgataaatgtatttgtttcattgaacaaattgtaaaacagttaaataagaaactacagacaaaatagtactaggcaaagctaagtaaatcaactggattgtcttggtcaaaggtattgcagattgatgacaattagatccactttcagcagaaaacatcagttgaccctttataaaacagtcactggaaggcctatgcccctaataatagaaactcatgactaggcgctgtggctcacgcctgtaaccccagcactttgggaggccgaggcgggtggatcacctgaggtcaggagttccaagccagtctggctaacatggtgaaaccccgtctctacaaaaatacaaaaattagccaggcatggtggtgcatgtctgtaatcccagctgctcgagaggctgaggcaggagaatcccgtgaacccgggatgtggaggttgcagtgagctaagactgagccactgcactccagcctgggtgacagagcgagactctgtcacacacacaataaaaccacacacacacacaaacaaaacaaaacaaaacaaaaactcatgtatcttctgctcctaaactttgatatggctaactgtggctttaatgcattatgccaaagtgcattttcaccaggtaaggaaggttttcatgatccactgactgaggacaattaaatccttcatgatcaagaacatagagattgggtcttctagaaacaacacaccttgccacccacactgcagcaaaactttaggactttgaaccttgggtctgtaatctcacaactcagaagggcccctccagactcttagaactgtatatctgttggagacctcaagataaagctaaccagggaagtttctcaccagaagcagatggaatcctagatgtggaaagctttctcaagatgacagatcaagacttctttgccatcatgagactcttacctctcttaattttttcctcgcttatgcctttatgaagactagaactagaaaaagtcttgtgtggacccatggggtatacttttatttgtggaggatttcaccgctaaccttatgcatgagcaaccttatgccttgatggatagaagatgaagggccaaagtgggtgaggaattttcacggtacctttgtagctccataatcagtcagaaacagaacattggtctatttcttttaacctacattataggttgaagcaaacgttgccaggaggccttcacccttctgaatgggcataattcgttaggttgctttttccatgatttggggtaaatgaggcaatgattagaaatttgtccctcatagtagactctatagcagattcaactataaacactatgctaaagacttctttaaactttttgctaaagttgtgctacataatagaactgctctaggctacttactggctgaacagagaagaatctgtgcagttgctgactacatatatatatatatatatacatacacacacacacacacacacacagagagagagagagagagagagagagagagagagagagagagagagaggagagagagagagacaggatctcactacgttgcccgagctggtttcgaactcctgggctcaaacaatcctcttgcctgggcctcccaaagtgctgggttataggtgtaagccaccatgcccagccaattgctgacacttcttgttgcacatggatgaatatgtcaggtactatagagattcatttgcaggggattaaaaaactggctgcttggtcgaaactcgtagaccatttatcaagcttattctttaatctatttaattttagttggttcagttcatggggaccctggctaagcagcatactccaaactcttggtattgtccttctggtagtcataatagtcatctccctggtgaaatatatcctctcaaaaattgtaaatgtttaatgcagccatgcatagaatgtcaaatggtctctcttcaactgggatgacaaaatctcaaagaaatacataatcatgaggacactataacctatgaaagacatgttgagaccagaaacccaaaatgatcataactgagagtagcaattagcgatgttttggtcacactctcacttaagtgacaacatgatcaaaaggggagaattgttcaacaaaattatgggaggccattgttttggactgaactcatgcactaggccccaacagactagattggatctaaccaaatggagtcaactcatgctaaatgcagcacaatcaaactaaaactttaaggaagcatatggatccccaaagagaccagattttttttctccagaaaagaggggattatagtataataaggaagtcgtctctgctctaccctttacaaaaagggaatctaaattcctcgtttccaccttataaaacacagtgttccactatttctcagtgggatttgaaaccaagtaagtctatttgctatggtgacaaagtgacagcaatacataaagtttggtcaacctcttcattttaagaggttgactaaaaggaagaaattgttcaattaagtttagcctaaagctgcctgcttacatattttaagtttagtctgtaaacatattaaactgtaacctaactggatgtgtaaacagacagtaccaatcactgagttttagcaaatcacaggtggtcaactgttcaaactatgttcaaataaaataaacaccgatctgtaaccaatatggctatttctatacatcacttccattttcttttttaattttatttatttacttatttatctatttcgagacgaaatcttactctgttgtccaggctggagagcagtggtgcaatcttggctcactgcaacctccacctcccaggttcaagagattctcttgccttggcctcctgagtagctgggattacagatgtgcgccaccacacccggctaatttttgtatttttagtagagaaggggtttcaccatctggccagcctggtctcaaactcccgacctcaagtgatccacccaccttggcctcccaaactgctgggattacaggcataagccaccacgcccagcctgacttccattttctgtatgtcattttcctttttttgtttttgttttgttttgttttgtttgagaccaagtcctgctctatcatcccccagactggagtgcagtgggatgatcgtggctcactgcaaccaccacctcctggcctcgagtcatcctcccacctcaccctcctgattagccagaactataggtgcacaccaccacgcctggctaatttttgtatttttttgtagagacagggtttcaacatactgcccaagctggtcttgaactcctgggctcaaatgatccgctctccttggcctgccaaagtgcagggattagaggcgtgagtcaccacgcccagcccattttccttttcctgtccataaattcctctctgaccacatggcagcatcagagtccctctggttcagggagttaccggattcatgaatcattctttgctcaattaaactctgttaactttaatatgtctaaaatttttctggctgggcatggtggctcatgcctgtaatcccaggcgggtggatcacctgaggtcagaagttcaagaccagcctggccaacatggtgaaaccctgtctctactaaaaatacaaaaatcagctggatatggtggtggtgcctgtaattccagctacttaggaggctgaggcaagagaaacacttgaacccgggaggcgggggttgcagtgagccgagatcgcgccactccactccagcctgggcgacagagggagactctgtctcaaaaaaataaataaaattttcttttaacatgtgtaagaggctgggcgccgtggctcatgcctataatcccagcactttgggaggccaaggcgagtggatcacctgaggtcaggagtttgagaccagcctgaccagcatggagaaaccccatctctattaaaaatacaaaaattagccaggcgtggtggcaggcgcctgtaatcccagctacttgggaggctgaggcaggagaatcacttgaacccaagaggaggaggttgcagtgagccgagatcgtgccattgcactccagcctgggcaacaaagcaagactctatctgaaaaaataaaacaaaaacaaaacgtgtaagaggaaaggtctcatacttactaatataaacgaattgagaaccaaatgctccattcgcctgtcctgctgctctggagatatcacctctcccctactgcttttgaggcccaggttttcagttattcccagtcttctttgtcctgtcgtccttgccttccctcaagcactcatgaccaaagaataagtaggccaaatagataacgttctttaaaaagagtacagagttcctgacctattcatctccactttccaaataccttttggcttcagcttatctcatttttgcagctttagcaccgaatgaaaactgtgcatgaaggagcaggcaggttctcgctttgtgaagcgtctccttgtgcctcgagctgggggaagggctagaattgcagtaacagcaagagcacccaagaaatcggtctcagtttccttccccattttcagaggacagtggagatctcaaacaaagccagctaggcacagatttctttagagctttgggttctttcctctaccaaacattttaaattgtcatgtaaattatacatttgtcagctttatcctttatggcttttggtttttcagtcttgcttggaaagaagtttcctaatcccaagacttagttcttctttatttatttctggtactttcatgttgcttaactcttcaatccatttgaaatttattctgggactctcccccaaattaatggcttaatccctctaatagcatttctccacttctttgaaatgccccctttaagaagaaaatattcttctattcccatagttgtttctgaattggattctgttccattgatttattccactgattcagggtcagcaccacattgtttttattcttatagcttcaaggtatcttttgatatctaaaaggacatcctcttgtttttctgattttccaaatttttcttggttgttttatactttagttttgcaacctagagcaagttatataagtctgtgtctattttctcacctgaaaaggttaagattgtgggctctgcagccatattgtctgggtacaagtaagggtccacccagggaaacagagtcttctaggtctctctggcagaaggaatttaatacagggaattggcagcactggaaatggaaggactgagaagtctaatggaagcacaagacgctactatacagggagttacgtaggaggaggtagtgcagctagagcccagagtgggggccatctggtgggatctgaaaccccatagaggctgcctgatgggagctgagatcatggagggagggcctgtagagtagatgtgagagccacctaaggacataactgttgccagagacactacaggaagaagagaaagagagagagataccttggcttctctccacctcctccctctctcccagctttccattggctgaaccaacctggaagccagagagcaagggagcctgggaaacgcagttctctgtgatatagcacaaaggctcagaaaggcagagaattactccgagaggaaaaggcagttgaccacagccgtttattagttgtgtgaccttgaggaagttagttaacctcagttgccttagcttcctcctccaaaaagtggagatgaataatagtagtactttcctcacaaggccactgcgaggattaaatgcattagtacgtgttacatattttgtattatttaacttagtaagtgttatttattattattgtataaaatgaagatagcaatacctatcttgcagagtactataagatgtttgccggccaggcgtggtggctcatgcctgtagtcccaacactttgtgaggtcaagacaggaggatcacttgaggccaggagtttaagactagcctgggcaacacagtgagacccagtccctacaaacaaatttaaaactggggcaagggggagggtttcaaatttaaaaaaatttaaaattagccttggccgggcatggtggctcatgcctcccagctacctgggaggccgaggcaggccaatcacctgaggtcggaagttcgagaccagcttgaccaatatggagaaacctcatctctactaaaactacaaaattagctgggcatggtggttcatggctgtaatctcagctacttgggaggctgaggcaggagaatcgcttgaacccgggaggtggaggttgcagtgagctgagatcgcaccattgcactccagcctgggcaacaagagtgaaactccgtttcaaaaaaaaaaaaatcagccatgcatggtgatgcatgcctgtagtcctagttactcaggaggctgagatgggaggatcacttgggcctaggagttcgaggctgctgtgagccctgattgcaccactgcactccatcctggctgcccaaaaagaaaggtttgcaccgtgttgtgcacatagtactgggtacttcataaatgttagtcccccttgtagcccagtgtgctcactaatatctgtagccgataataacaatggctttgacctggggaggaagcagcctccccagagtagggagggacattcttcttgcattaccagagatctaggaggactctggagggctgggacttcagtagtccaggcagtgcacacccctacatcagccaatatgaacacacagagatgcatttggagtaacatctgcattcttttctggaccttctcttcttgatcccattggtgtcccttctttgattttagcctgatttttttttttttttttttggctcatgctgataattatctgtttttgcactcacatacatgctgccaacgttcatgagcatacaacttcctgtgcgcattaaatactttaccacttattgccccaactgatcctcccaacaaaccccctgatgcagccagggaagcttcactatccccattgagcagtagcagaagccaacactttgagaggacacgtgtctgacccaaaggcccacagggagtaggctaagtagtcaggacttgggacaaggccttctcactctagctcaggactcttcctgctaatatcccaggctgcctccacagcatgtgtgagttaatgcacacacacacactcacactcacactaatacacccacccctaaacacacacataatagattcaatatctctgaaggaagggttcatgccttatcaatttcctgctacagataaactacctggcagctgaaatataataaatgattgtggaattgagttgacattgactgctacactgcacccccttgggggactaacagggagcacacagatgaggaccacagccagagccagagccagagtccaagtccatcttgacaactcagagaagactttggcccttgcttctggctctgtccacgcccttcgtagcacccacggagcagaggggcctggtcacagggagaggctgagatgcccagagaaatggatctggccacctgagctgaggcttctctgaaggtgagtcttcaccgaccccgccctagtagtggtgaatcgcgtgtcctgccctgttctctgctgcccctgagcagtgtctgaaccaggggcgccttttaacgccacagattctgcctcagggcgtggaacaccttcttctagaggggcgcgtgagaactctggtaggcaggagcttgctctgaaactactgtgctagtcaaccaattgcctcagctggccacccagggcctggcatccacactggtccctggcaagccgttctgcacagaggttttcacacacgtgggtacggagcactggcaggaagtacgagacattagaaattagaagcccaagctaataacacagatcaccatcggggcttcactttttgccagccacttctacgtaaatatatctggttctacccttcactcagccaaggcatgggcgctactggcctctgactcagcgctcttcattggcctcagctgttaaacttgctcccttctgatattttgcagatgctaagcactcaactggtttgttgtggctttgcatcgtgctctttctcataatcctgagatgagaggccactatgtcctctgggtctgcgggacttctggggcaagggtgcggggcaggcccagcacaggtgtccagggagctgcccacactgccgctgtgtgctcttgggagtcctgttggctgttccattctcctctctgcccacagaggtcacagtgcccttgcgagtaagcaggagaaggcagagtcatgaattagcaactggaaaggataaatgccaaaggccttgctatgaaatcgaggaccccgcaccagctgccccgaggtccctctggctcatttcctcctgttctctcctcacgtcactcctcatttttcctggaacatgccaggcccactcctgccccagggcctttgcatcacatgccatccagataacctggtgctcccttccggattcctgcttagctttttgttctaatgtcttttttctttttattttttatttttatttttttgaatcgtggtcttgctttgtcacccaagcgaggctgcagtggtgtgatcatggctcactgtggctttgaattcctgacctcaagtgatcctccagccttagcctaccaaaagctgggattacaggcatatgccacggtgcccagccctaatgttacttactcattgaggccttccttagctgctgtctctacaattgcaagcccccacccctccccaccccccaccatctgctttttccttggtgcctctcaccgtctatcttatctcgttaatgtttggtctccccacctcagtgttttcatctgtttgcctgctgctgcatcaccagcactgcaacagtgcctgacacatagcatgtgctcagtgatatctgttatatgcatgaatgagtggggctggactgtgagctgatgaggttcttgccatggctaactccaggcagtcatgtcatttggcccagttccactcccttctgggcctgactcaattcatctgggtaatgaggagggcacaggagctgctgcgtaagctgccctccagcagtaataattgatgagtccaggcagtatccacttaccacgccaaagaggtccaagcagcaggcaacaggggaagggaggcaggaagcagctgccaggatgactaattgggatctcatgtcattggctccacgtgccaatccttacagacctcagcaaagctcaggactattagctcctgagactcatgcagtctcctggtctgacctgtccctcagtgacactcgaaaaataactcagccaggcgtgatggcacacgtctctatttccagttacttgggaggctgaggtgggaagatcacttatgcccaggaggttgaggctgcagtgagccctgatcactctgctgcattccagcctgggcaacagagcaagattctgactcaaaaaaaagaagaaaaagaaagaaaaagaaaaaataactaataacttcatcttacagtggtgacacggagacctggagcaggaatacagagatgtgccaaactttgtacagaaattttgcaaaactagattcagctctcattccacaaataccaggacctcccctgcaccaggcactgttctaggcaaggacagagcaatgaagaggggaagctcctcacctgtgtttcctcgtgaggcctgaagcgcctgctttcccttccacctcctgctctccagcctcttaagtcccctcactctgtggtcaatctaattggatagaaccctttcatctcaaaaccaaaacaacagcgacccatgcacactcctagtagaccaatgggactgtagcactgatttcaccatatgcccctcctgcatcccagggacgtcaactctgcacttcagtccagctttcaggaaactccaaatctctcccccattcccacctcttcctgtctatggtcccactgtgagccgatagagttctcaccacggctgacaccaggcagccatgtggttggggccagtcccattcccttctgggcctgattcagttcatctggctaatgaggagggcacatgagccttctgtgcctgttgggccggctgcctcagtgaccactgccaattgtgtgttccccttattcagcaccttcataccttcttccggttttgcccatctgagctgaatcaattcctccatcttcacagggaggtagccttctctcagtccccaaacccttgataagggaacgcaccaccacctcgcaggcctgcctgacttgagtgcatcacagttctccacctaattatttgttgtcccggattgtttcatgtatgtatgtctgatctctccataagactgtaaacttactgagggcagagatgacgcttacctttccatatcctacatgctttagcctggtgcctactcactgggcaatccatcagtgatgagtttacctggatttactaattcgtgatatttacaaagaatacatttgggaaaatgtgtatttgtttacagatgttaaaaggaaaacgtaaaatacaagattgtatgtacagcttgataatcacagtgtcaattacgtgttcatatgggtaaaactggaaggcaattggtaaaaataaagagtagtgtgagggctgttagattatgagtgatttgtttaaataatctgtgaatattgttactgcactgtttatgcatttgaaaagccttttttttttatcctaaccagtagaccaccagggataaaatgatttttaaaaatacatagagggctttaagagtcattgaaacattccactcttggatgtaagctcattaagtctttcttagtcagcaactactagggaatgggaacagggtgggtggggggcttggcagtcttttagagactttactcacggaatatttatacacaaatagctgagcaaaggaggaaaacttctcaaagttgatttttttgcctgcaaacgttaattccgtggggaaaggacagaaagataaacagtttaaaataaccaaatgaaatcatgtgagcttgtaaagattttttttctctctctctcaacaaggatgggatgtccatgaagtcctctcggagcttcccggattttttgtgctctgaagctccagcagtggggagcggggctgagagagggagatgggtgatgtggcgcccatccctccaggcaaggactgccctggcacagctttcctcttgattccctaaccgctctttacatgtttattttatctctatcagactatgggctctcacagatgaagaccatactcttcctgcaaaacactcggtcccacagcacatgtaatatctaagaggaacctgagaggtcactggtctaatcccctcatcagacaaaagaggaccagactcagagagagaggcacgtgccatagcgacacagccagtttctttggaggcctggtctcagctctggactgctcaagcctatccttgacagtggcactgctcagcctggacatttagagtgtccttctgatacaaatgtattgagtctctgcccctgagctagaaagatggcaaaacaaagataagaaaaggccaaaaaaccaagctccctaacattaaggatattataattcagagggaaagatagggcactctcacagacaactagaatacaagcagaaagtgaggatgagttgcaagaggcatacacctagttgggaaagagcctgctggggagatggaccaaaaagggctccactgggattaagccagcccttgaatggggatcaaaataatgcaaatgaagtcagaggcactgaatcagttcatttatttaacaaacactgactaccatgtgccaaacaaggatctagatactcaggaaacacatctctactagcctcatggagcttacattcaaagaagggtaggggacaggcactaaacaaaatatataagtaaaagtaggttagataggctggtgggaatgtaaaatgatgcagccattatggaaagcagtatggtggttcctcaaaaaattaaacataaaattaccacttgatccaccaattccacttctgggtatatacacaaaagaattggccgggtgcagtggctcatacttgtaatcccagcactttgggagtccgcggcgggcggatcaggaggtccggagttcaagaccagcctgaccaacatggtgaaaccccatctctactaaaaatacaaaaattagctgagcgtggtggcgcacgcctgtagtcccagctacttgggaggctgaggcaggagaatcgcttgaacctgggaggcggaggttgcagtgagctgagatcttaccccggcactccagcctggacaacagagcgagattccatctcaaaaaaaaaagaattgaaagcagggactcaaagagatatttgtatactcatgttcatagcagtattattcacaatagccaaaaagtggaagcaactcaaatgtcctttgacagatgaatggataaacaaactatggcatatacagaccatgcaatattattcagtctttttttttttttttttttttttgagatggggttttgctcttgttgcccaggctggagtgcaatggcgcaatctcggctcactgcaacctccggctcccaggttcaagcaattctcctgtcttagcctccagagtagctgggattacaggcgtgcaccaccacgcccagctaattttgtatttttagtagaggtggggtttcaccatgttagtcagggtggttcaaactcctgacctcaggtgatccacccgcctgggcctcccaaagtgctgagattacaggcgtgagccaccacgcctggctagtcaatcttaaaaaaggaacagaattctggctggacatggtgactcatgcctgtaatcccagcactttgggaggctgaggcgggtggatcacctgaggtcaggagttcaagaccagcctggtcaacatagtgaaaccctgtctgtactaaaaatacaaaaattagccacgtgtggtagcatgcacctgtagtcccagctactcaggaggctgagaaaggacaattgcttgaacctgggaggcggaggttgcagtgagccgagagattgcgctactgcattccagaatgggtgacagagtgagactccaccttaaaaaaaaaaaaaaaaaaaggaatgaaattctgacacaagctaccacatggataaaccctcaaagacactgtgctaagtgaaataaaccagacataaaaggacaaagattggccaggcttggtggctggccgggcgcagtggctcatgcctgtaatcccagcactttgggaggctgaggcgggcagatcgcctgaggtcaggagttcgagaccagcctggctaacatggtgaaacctcgtctctacaaaaattagcaaggtgtggtggcaggtgcctgtgataccagctacttgggaggctgaggcaggagaatcgcttgaacccaagaggcggaggttgcagtgacccaagatcgcaccactgcactccaacctgggcgacagagcaagaatccatctcaaaaaaaaaaaaaaaaaaagagagagagagaaagatcctagtgttacagttacatgaggcacctagtgtagtcaaattcatagagacagaaagtagaatggtggttaccaagggctggggggagtggggaatggggaggtagcgttcaaagagtatagagcttcaacagttgaggaagatgcaaaaggtctggagatggatagtggtgatggttgcacaacaatgtgaatgtaattaatgccaccgaactgaaaacttacaaactattaaaatggtaatttttgtgtggtgtatattttaccacagtgaaataagtaaataaaataatagggaagggagtaggttagatggtttaagtgttacaggaaaaaaatgaataaatcagggaagagggatggggtaccggagtgaagcatcaatgttaaacagggcatccagggtggccagggaaagtctcactgagaaagcagcatatgaataaagatctgaaggaggtgagggagtgagccatatacggcaatctgggggaagagtggtccaaacagaggaatcagcaagtgcaaaattcctgaggcaggaatggcaatagggccactgtgctagagccattttctttattttattttatttatttatttatttatttatttatttatttatttatttatttttgagacggagtctcgcactgtagcccaggctggagggcagtagcaggatctcggctcactgcaagctccgcctcccgggttcaccccattctcctgcctcagcctccgaagcagctgggactacaggcgcccgccgccacgctcggctaacttttttgtatttttagtagagacagggtttccccatgttaccaggatggtctcgatctcctgaccttgtgatccgcccacctcggcttcccagggtgctgggattacaggcgtgagccaccgcgccaggccattttattttattttattttattttattttattttattttattttattttattttattttttagatgaagtcttgctctatcgccaggctagagtgcagtggtgtgatctcggctcactgcaacctccgcctcccgggttcaagcgattctcctgcctcagcctcccgagtagctgggattacaagcatgtgtcaccatgcatggctaattttgtatttttagtagagacagggtttctctaggttggtcttgtctcaaactcctgacctcaggtgatccacccacctcggcctcccaaagtgctgggattacagcacttcaccatgttggccaggatggtctcgatctctcgacctcgtgatccgcccacctcggcctcccaaagtgctgggattacaggcgtgagccaccacgcccggccaactctgtgcctctttgatcaattccagtggtaccaggtaaactgcttatgagtgaaatttagaaaaacctcccccagcagtgggggaaaatgcacagtgcataaggccttatttgggtgaggagttgggggagtgaatgtattaaccttgtagtgaagtcaccttagattctagtagttatgcttctttcaggaatatgaccactcagaccataaaagctggatgtgaccatggtttcatttctttggaaatgattctgccagaacaggaactgagaattttttctctgtgacctctgggtgagtttgtgttccatgagaacattgggctttgcatttctcagtacactgctctcatagctcttgggtttggaagaggtcactgtcatcaaactttttatgactttagccctcagagaaccaaggataaaggtgaataaagaacgcatccaaggtagaaagctccaacacccccgagatgtttactttctataaaacctggagtctcatgccagagggattatataaaaataaagccagggtagccaagtgcaaaccgtagagttatcaacagtgctgtgagatgaagtcttttgttcaaggtcctttaattgccagatgcaaaagatagtaaaatggattcttttattcttgaaactttgccagcctcgtggctaatgcccactacagctgcattaaaggctctgaggatctctgccaagatgtgatgatggccaagaaccagtgatgacttcaggggacctttctcaacctgccagccctgccatcttggcctagcccacaggccactgcctgacccagtctgatttatagctcccatgggatcgctgtcaaaaaaggatcctatgggatccttccatagaggctaatattcacagaacgctttagaaaacgagcttaaagtttaatgttgagggatgttgtgggccaaagggtggtcctgaagggaacttctctgaaattctgtgctaggagctaggactcaggcacagtgttatgtgtctcaggcacagtgttatggaaagagcataggatcaagggacaagaagtccgagatcagttttttttttcagctttatttcagtataactggcaaataacaactgtacatatttaaggtgtacaacttaacggttttttttttttggagggggtggggttgttttttttttttttcttttattttgttttgagacagagttttgctcttgttgcccaggctggagtgcaatggcgcgatcttggctcactgcaacgtctgcctcccggattccaccaattcttgtgcctcagcctcccgaatagctgggattacaggcgcctgccaccacacccggctaatttttgtatttttagtagagatggggtttcaccacattggccaggttggtctcaaactcctgacctcaggtgatccacccacctctgcctcccaaagtgctgggattacaggcataagccactgtgcccagcccctgtttttcatttttttagagacagggcctctctctgctgcccaggctgactgcagtggcacaatctcggttacactgcaaactccacctcccaggctcaagtgatcctcctgcctcagcctcccaagtagctgggactataggtgcatgccccacacctggctattttttgattttttgtagagatgaggtcttactatgttgcccaggctggtctcgaaatcctaggctcaagtgatcctcccacctcagccttgaaaagtgctgggattgcaggcatcaaccatcatgctggtccaacttaatgttttgatataggtatacattatgaaacaatcacaatcaagaccattaacatattcatcacctcacataattatctattcattattatcatattattattattattttgagaccgagtcttcctctgtcacccatgctggagtgcagtagcatgatcttggctcactgcagcctctatccccgggttcaagtgattcttgtgcctcagcctcccaagtagctaggatgacatgcatgtgccaccatgcctggctaatttttgtatttttagtagagtcgagctttcgctatgttgcctaggctggtctcgaacacctggcctcaagtgatccgcctgcctcggcctttcaaattgttgagattacaggcatgagccaccatgcctgacctattattttttattttgttttgttttgctttgttagagtctcactctgtcgcccaggatggggtaaagtggtatgatctcagctcactgtaacctctgcctcccgggttcaagtgattctccagccttggtttcccaagtagctgggactacaggcgtgcaccaccatgcccagctaatttttgtattttttagtagagacggggtttcactatacgttggccaggctggcctcgaactcctgacctcaggtgatccacctgcctcggcctcccaaagtgctgggattacaggcatgagccaccacgcccggccctactattatttttttaaaggaagtctgaggtttactcatggattcacctctgtgctggatatcttctgttgcctactccatccgggagccactccctactctctctcttcagtgcccaggagactgacctgtgtagaaacctcagcaggctcccttgccctctggcttccaataaggccaacgagggtctcctttaggggatcagaaggagggaggacagaggggttgggtgttaattatcctgagttcttagacctaggaggtctctgtgcactgacactgcaggcctctccagttctggtgacctggccctccttcctccctccatggcaagcctatgtagctccccacaacaacacactgtccctgtggcttccctgcaccctgcccctatttttgtaaagagttcctttattaggttctgctgaaattacccaactggagtgtgccctctgtttcttgccaagaccctgaccaatgcagccaccaatgagtccagtgaccctggtcacaccacttaggccccgtggctttggtttcttcatctttatttatttttaatttttttattttttaaaattttatttttatttttattatttttgggtttttttgagatggagtctcgctctgtgacccaggctggagtgcagtggcaagatctcggctcactgcaacctccaccctccaggttcaagtgattctctggcctcagcctccccagtagctgggattacaggcacctgccaccatgcccggctaatttttgtatttttagtagagacggggtttcaccatgtaggccaggctgctcttgaactcctgacctcaagtgatctgcccaccttggcctcccaaagtgctgggattacaggcatgagccaccgtgcccagcctaaaatgccagttcttacacacttgcttcacggggctttcataaggattataatagatataaagcactaaacaaacataatctttaaaaaaaaaaacataatgtgctttctaagtttcacaattccagaatgcgtaaaaataacaagttgtcttttatatcaagatgctgctgccaatacgcaactgctcaaatatgaactctgagcagtttttctaaaattcacgatggtttttattgagtacgcaaaaggctaaactagatttcactctgataaacataatgatattacgtgacccaataatattaaatcctaaaatctatcccaaacccaggcagataagacagctaagataaaaacatttttaatatgttgtacccaacagggtagtaatgatttgtattttattagaaaaactctaaataaagacattagtatatttttcattttagaaaaacaaaaacagctttgttatcaccattggctaccaagatatggtgctggaaaaaatatattgctagatttaaaagataggtccccactttaagtgcaagttttgatgcattctgtgtgaccttaagcaaagcatttaatccttctaatgttttttatcaggtctgtattcaggtgagagtctctcacttaaatattagatcaaagtgaaagtcctttgtaactgaaattgggctatttgtaattgatcccccaaggcttctttaaatactgtcatctctgattattcgtatctgattaagatatggagaggaggcactgagggctgccctgatttgagattcacaggggaatggccctaagtctttgaggaagacagtgaggggaccaggcagagggccagaagtcccaattgaattgacctagcaatttttttttttttaagaaccgagtctcactctgtcatctagactggagtgcagtggcgagatcttcgctcactgcaacctccgcctcttgggttcaagcgattctcctgcctcatcctcctgagtagctgagactactggtgtgcgctaccacacccagctaatttttgtatttttcgtagagatgaggtttcaccatgttggccaggctggtctcgaactcctgacctcaggtgatccgctcacctcgacctcccaaagtgctgggattataggcatgagccaccctgacctagcttttaagaggtttcagccatgctatgttggctacggtccagacacagaagtgagctcaggggcgagtaagacaaaggtcttgccttcaaggactttactctatagctagggagctcggtgtaacatgaggaaaattagtgcagttcacacaaaaagcttttcaggatgcaagggagaggctgagcctcaagtggagcctgggtccgagacaggacatggcacctgtgcagggggaaggctggttgtggggtggggcaaatgaccctaggaagttaggactgggtgggctgcccaggtcttcaaagtcaagcttgataaagtttgcattcaatgcattaagaaatagaagactactgtgcattttttagcaaaacaataccaaggtaagaccaggcaagtttgctcagcctgtaatcccagcactttgggagactgaggcggggggtggatcacctgaggtcaggagttcgagaccagactggccaacatggtgaaaccccatctctactaaaaatacaaaaattagctgggtgtggtggtgtgcgcctgtagtcccagctactcaggaggctgaggcaggagaatcgctcgaatccaggaggcagaggttgcagtggcctgaaatagtgccactgcactccagcctgggcgacaaagccagtctctgtttacaaaaaaaaaaaaaaaaagggcggtggggggcggaataggttttgcagagataggcaggatgaaggggcaagaatataggggaaaaaaataacacgaagcagattttttttcactcctttaaagacaactagatacttgcggtgtagcccaggatgggtggttttactcctctcacagaaaagtccttcccacaataatatttgttctccctttatcatatttttttaaaacaaaggtgtaaaatcaagcaatgctctccctttaaacatcgtttatctacccttcagagcaagaagcttgtgctattgtgaggtgagtgtcgtggcactacaggtcccaaatcatatggggactctgctcagcaccctatggattcacaaccacagattcccactcctcacactccagctacaaaaaaatatattgtatagacatatatatgtgtgtgtatgtgcattttttaaaaagcattcgtgcttatgcaatattaacccactggtatttcagagatggtgacagaggtcccatctggcacccttagtttctttgggaatcagcattcctttatcaactcaccctgcagacttggtttagcagcagaaacctatccggctctcccaggcaccggctttggcccttcctgcacagcctcggaagtgcctggatcacctccatcagcagctatcgacctctgtctgaagtccaagttgtttgcttacctttcctgggctgagtcattaaaggaaatgtattagtttactttttcaacttctctattctctagaatttagcttccttattttacacacgaaaggataaaggagttatactggatattttgtagcagattgggggtgggggggcgagggtcgggggagacagaaggagggcctaatctgcaatagaaaaagagagaatgattcttgtattaatgtttgtttttcatttatttatttttcctgcatgatcatgttcaccatcatgtcctgaaaggcaacacctacaggcaaagaagatgtggaagggcctgcaccacctgatcgccatcatccctgccctctggggcctggcaatccagttgggcagcctgcacagaatgacctgtattttctgggccaggacagaagtcaagaggaaggggagatgcacaaaggccaaggtagtcagagaaggtttagatgagaagaggccctgaaaggtggttgggacctggaaacagcagagtggtgggttctgggcagggagatgcccaaagtgcagctgtggcagggcatgatggctcacgcctgtaatcccagcactttgggaggctgagatgggtggataacctgaggtcaggagttcaagaccagcctggccaatatggtaaaatcttgtcactactaaaaatacaaaaattagcggggcatgctggcgcgtccctgtaatctcagctactccgaaggctgaggcagaagaatcgcttgaatccaggaggcggaggttgcagtgagccgagatcatgcggctgccctccagcctgggcaacagagagactccgtctcaaagaaaaaaaaaaaaaaaaaagaaacaaaaagaaaatgaagctgtggaggccaagacaggctggatgtgtctgaagaacgtggcatgttgcggggctgggagtgcagagaggggatgataacctgggaaggcaaagccttgtcacagagcaggcacttgaaacccatggtctttcgccagctgcaggggtcctgagccctgaaactgtccttcaaatggggtgtgtttgtgtaagcttctgcagagatggccataggagtcaaaggagtttggggagagattcatgtgccttggctaaatgatctgaattttactctgtggaagccaatgagtttgagagtggagaagaagcgaggtatcatgagaaaaacagtttttagatgtgggttttgttgttgctattcttttagtttttatttttatttatttatttttttctgagatggagtcttgctctatcagccgggctggagtgcagtggcgcgatctcagctcactccaacctctgcccccaggtttaagcaattctcctgcctcagtccctggagcagctggaactacaggcgcatgccacaacgcctggctaatttttgtatttttagtagagacagggtttcggcatgttggccaggctggtctcgaactcctgacctcaggtgatccgcccgcctcagcctcccaaggtgctaggattacaggcgtgagccaccccgcccagcctagtttttattttttaaagattaatccaggaatggtgagttagaatggggaggaactcagacagggaacttttaagtttcagtcccttttggtataggcatgacgtggaaaaggccccaaaacaatgaaggaatgggcaggagaaacatcagaaaagatgaattggcaagattttatgactgcatgtgatcggagaaaaagagtgtgctagtgacccaaaggtgactaagattttagcttaggcaaggtgtaactaggtttctgcacaatactagcttatttctataagttactgttttgggtttttttgtttttgttctttttttgagacagagtctcgctctgtcacccaggctggagtatggtggtatgatcttggctcactgcaacctccatatcccagattcaagcggttcttgtgcctcagcctcctgagtagctggaattacagacatgggccaactcgcccgactaatttttgtattagtagagatggagttttttcatgttgccaggctggtcttgaactcttggcctcaagtgatccatctgcttcagcctcctaaagtactgggattagaggcataagccaccgctctcggcctaacttactgattttaacaagaggttttgcttacaaattgtaccaatcacaatttctggaggatcattttcttgaaggatcaatgtgccttctcaaaaagatgtatgagtggtcaataaactgagctccttcctagacagaaaagttatgccaggataccctatcgagctgacagtatcaaaataggtcagtttccaggagaaagtcacgaaaggccttagggattcactcactagttttcactattacatccttcttttaaattattattataaagacaatgtgtagagtagaaaaaaatagaagaaaggattctacttttggctttggcaaatagatccctgaacaatcctactgactgaagtaacaaaatgctcaaaaaagtttaatatttattgaaagcctactaccatcaaaacaattttgaattttaaaacaatgaggtgtttttctttttttttttttttgagacggagtcttgctctgactcccaggctgaagtacagtggtgcaatcttggctcactgcaacctccaggtcccagcaactcctgtctcagcctcccaagtagctgggattacaggcacaagccaccatgcccagttaaacaatgacttttaaaaaaattgagacgagggtctcactatgttgcccaggccggtctcaagctcctgggttcaagtgatcctcccaccttggccttccaaagtgctgagattacaggcatgagccactgtgcccagccaaagcaatgatttttaaaggcaagctataataaggaaattaattttttaaaattccaatttcacttagttgaggaaatattaaaacctttattagcttgaaaagaaaataagtggattagtaaaaaacactgcttgtttccagatacctgtttagttttcactgggatgttttggctttgggtcaacagagtttgctcttgtctgtatggctctgagtggtgcctgtgagatggagagaacaccacagaggagatccccctaatcacctaggccaagttgtcaccttttgctcccagaagtgtggccactgtggtacaagctgacaagcttctccctggccctgcctcagagtccctttccaacaggtctaatagaccccaaagatgaatgcagcagggcctgaggcttgggactacatgggaaggtggagaactcctccggaaaatcaatcgaacatcataaagataagctgataatgtgcaaactttaggacccagaaatatccccagagaaactcttgaccatggaccccagtagtcacacacaaaaatgttcatagcagcatttgtgtggccaggcatggtggctcatgcctgtaatcccagcactctgggaggccgaggcgggtggatcacgaggtcaggagttccagaccagtctggccaacatggtgaaaccccgtctctagtaaaaatacaaaaattagccggtcgtggtggcaggtgcctataatcccagctactcgggaggctgaggcaggagaatcatttgaacccaggggtggaggttacagtgagccaacattgtgccactgcactccagcctgggtgacagagcgagactccatctcaaaaaaaacaaacaaataaacaaaaaaaacatagcagcacttgccagtaatagcaaaaaatctcaaggccaggtatggtggctcacgcctgtaatcccagcactttgggaggccaaggtaggtggatcactgagtccaggagtttgagaccagcctgggcaacatggtgaaaccctgcgtctagaaaaaaaaaagaaaaattagccgggcatagtggcacacgcctggggtcccagctacttgggaggctgaggtgggaggattgcttgaacccaggaggcagaggttgcagtgagtcatgatcctgccactgcactccagcctgaatgacagagcaagaccctgtctcaaaaaaaaaaaaaaaaaaaggcaaacaacccaaatgtccattgataggagaacggagaagaaaacagcagaagggtcacacagtggaatattagagagctacagctgcagcaaagagatgtcacatacatcatgtggagaggtgagaatagcaaactgaagaatacatgcagtatgatttattttatataatgttcaaaagcttgcaaaaacagcatattgtttacagatgcatattttggaggtaaaattatgaagaaaagcgagatcattataaacaaaatttaggagggggctgggatggagaagggcatgcaaaagggctttaacggtgttggttgtaatctgtatcttaaactgggtgtgggtagtagggtgtccagtttttatactctgttcatgtgatctcttcttttgcaagcatttaatatttaattaaattttgaaaaactagatgtggcagaggtctcctgcaaaaaaaaaaattacaaaacgttatcctcctaatcccagaactcaaaactcatcaactctctctgtttaacagtcagacaaacaaacaaacaaaaggaccaagtttacatatagagcaaatatagatggagaaaaatgacccaagtgcccgagtttctctctcttctggatcacatttgtcttttagcaattttttttttttttttttttttgagatggagtctcactctgtcacctaggctggagtgcagtggctccatctcagctcactgcaacctccaccctccaggttcgagcaattctcctgcctcagtctcccgagtagccaggactacaggtgcgcactactgtgcccagctaatttttgcatttttagtagagatggggtttcaccatgttagccaggatggtctcgaactctgacctcaggcgatccacctacctcagtctcccaaagtgctgggattgcaggtgtgagccaccatacccagcctagcaatttttaaaaatatttcatttaggccaggcacagtggctcacgcctgtaatcccaccactttgggaggccaaggcgggcagatcgcctgaagtcaggagtacaagaccagcctggccaaaatggtgaaaccccatctctacaaaaaatgcaaaaattagctgggcatggtggcaggcatctgtaatcccagctacgtgggaggctgaggcaggagaatcgcttgaacccaggagacagaggttgcagtgagatcatgccactggcactccagccaaactctgtctcaaaaaaagaaaaaaaaatcattcattattgtagtcacaaatacttcttcagcatctcataaaccaggcaataaagataaacaaggacagatgctgcacagcaaaagcactggaggctggaggagcacagggcagccacaggcaactgggccttgggacatgtacttcatttatttattgtattttttgtacagatggggtctcgctgtattgcccaggctggtcttggactcctggactcaagtgatcccacctcggcctcccaaagtgcttggattacaggcgtgagccaccactaccactgggatacgtactttagagcaagcagtggtccctaaactttttggcaccaggaaccagttttgtggaagataatttctccatagacagtttggtaagggggatggtttgtggatgattcaagcacattacacttattgtgcactttctttctttctttcttttttttttttttttttttgagatggactctcgctctgtcgccaggctggagtgcagtgccgtgatcttggctcactgcaatctccacctcccgggttcaagcgattctcctgcctcagccacccgagtagctaggactacagttgcatgccaccacacccagctaatttttgtatttttagtagagatgcggttttaccatgttggccaggctggtctcgatctcttgaccttgtgatccacgcgcctcagcctcccaaagtgctgggattacaggcgtgagccaccacgcccagcctgggcactttatttctatcattattacattgtactatgtaatgaaataatatacaactcaccataatgttgaatcagtgggagccctgagcttattttcttgcaactggatggtcccatatggggaggatgggagacagtgatagatcatcaggcattagattctcataaggagcacacaacctggatccctcacgtgctcagttcacaatagggttccagctcctatgagaatccagtgctgctgctgagctgacaaaaagcagagatcaggtggtaacgcaaactctgtttgcgtactgggagtggctgtaaatacagataaagctttacttactggcctgtgctcacctcccaatgtgcagcctggttcctaacagggcacagactggtattggggtgacggattggggaccccctgctttagagagtagtaagagcagatgtttgttgcatggcaggccatattctaagcattttacatattccatacaacatgtaggaattcactggatcctcaccgtgcaacaatcctaatgaggtaggtgttatcatgatccccatttcacagaagaggaaattgataggcacagaggggtcgagtgaccatccataaggtcacacagcttgtaagtgctgaaccaggattcaaagcctgacacactggtgttcctgaccaccacactctgctgcccctcatgcttccctgagaaggtgacactctggctgagacctgagcgatgaacaccagtcaggcagcaatagaggaaggagatggatgaaagttcaggcagatggggatggatgaaaggtcacctgaaggtcatacaaggaactaaaataaacatttagctgcacagagtgtgaaagatccatccagctgagaacagtcctccttcgtttctttcttttggaccttggctgagaagggcagtgcagggatgaggcgaggtttgggggaggtggttcgagctctgtgatcattttctctgggtgagaggcagacctcggtgccaggatctgagggcttctaaaggccctggcaacagctaccagggctcctgagaaagtccccaggcatccaggaccctgcaggcttggcagcccctcaatcccctcttggccttgtttcccaaaggacccaacatcaatcaggcacaagagcctaaaacacgacctagcaaacagctggcaaactatttttaaaatccaatttaaagttgtatatgtataagctccagtggatttctctggggaattctatctttcaagtggaaatttttttttaagtcaaataaggtaatctctattttgattcccatcaaaccccagtgcggggccctgcagccaacggtaagtgctaatccactttaagcacaagcaactcagagcttgggagtcagcgagcctccaggatccacagagaaaggtcaggactgctgatatttatcgtgttaacgctgttagtgtgtgtttggctctgtccagcacaggaaaagaaagaaaagacatgaattttgcctgctggagtggagaagagccaggcttctgggatctgcccatgagttgtgcagctccctaaaccttagattccctctagccctcttccaaaaacataaatgtataaatagaggaaccaaaagagacaagagcagagagcagggttctgaggcaggaaatggagcagagagagcgagaggcagggcagagggatggggaggcagcaggcccagcactccacagccttctaggctaagctcagccactgccttttttgtgattctgcagccaccaagcttaggcctcaggcgctgatggagagataaagcatcgtgtgacagggccagcagcacagtgtaccctgcaaggtcggcagctctttgcttctcccaacaaacacctttttctgcattcagccacccagatttatttgtctcggcttttcatctttctgagatctaaagttacaaattggacagacagagctagagaaggatttctcctgcattttcttccctacagtgtgctctgcaaatgtcattgctcctgcctcacggtttttgtctaaacacaaacaaaacacaaactttagggtaatctaaacggacccttggctacctagggggtcggatctgccgtggctaccctttcccccaccctgcccccaccagaggcatgttccaagcaggccaaggtattgagacattgggaggagagagcaatgctggacagacatcctggggtggaggggagagggtcccagagtgaagggagagaactggaaggaagctcccgacagaaatgctttgtaatttgcctactgtggaggggcccacagaggttacaggaggctgctttcaagaaggaaggcagttccactgggaggggagaagggcagggagccctacctgccccttctgtctgcagtcatgatgtatgtgaccatagtttcaccaggaagttcatgttcaagtctaaccatttaaaaagccattcttggctgggcacagtggcccatgcctgtaatcccacactttagaaggctgaggcaggcggattgcttgagtccaggctttcaagaccagcctaggcaacatggcaagacccccatctctacagaaaaatacaaaaattagctgggtttggtggcacacacctgtagtcccagtgtccagccaggagcacagaacagtcatctgtgaccccactccctcctggttttcctctcccaggtctgatcactccttctcagccttactgccgggttcctcttcttccgcccaacccttaagggtaggtgatctctagagtcccactcatttggcctacacaatttcctcatatcgagtttcaactgccactttctctgatgttgctgtcttcaaaagcaaactgctctacgtctcatctacctcatccatcttcaacccagaattcttgagcactagatccatagatctactcaatgtgttcacatgcagcatgttcctcaactcaccattttctttttttatttttatttatttatttattatttttatttttatttgaaatggagtttcgctcttgttgcccaggctggagtgcaatggtgcaatctcggctcactgcaacctccgcctcctaggttcaagtgattcccctgcctcagcctcccgagcagctgggattacaggcatacaccaccacatctggctaattttgtatttttagtacagacggggtttctccatgttggtcaggctggtctcaaactcccgacctcaggtgatccacctgcctcgcctcccaaagtgctgggattacaggtgtgagccaccacgcccgggattttttgttcggttttggtttgtttgttttttttttgagacagagtcttgcccttgtcacccaagctagagtgcaatgcgtgatcttggctcactgcaacctccgcctcccgggttcaagcgattctcctgccccagtctcccgagtagctgggattacaggctcgtgccaccacggctggctaattttttgtatttttagtagaaacacggtttcaccatgttggtctggctggtctcaaactcatgacctcaggtgatctgcctgcctcggcctcccaaagtgctgagattacaggtgtgagccaccgtgcctggcctcaacttattattctcaaagctgaactcattattttcttccccatccttttctggtcttgaactctctctctccttctgagtgttcccttgggcagaattgccatccactcagtcacccaaggcaaacgcctgcactgtctccttaatccctccttctttctcattcgtctcatccaatcaggcaccaacgctgtcagtttgtcttttcaataacttttcctatctggggctgcccctccacccccaccatcacctcttaaatttgagccctgctctgttgcagaaatcttcttactggtcccctcgactctagtctcttatctcctctccatcttccaggatgcttccctggtggtcttcagaaaaaacaaatgatttggtcacaatgctttcattaatgcagctaaaaaacaaggttgtcctatgtcagaacaaaccataatctcccatctgagggattcctcttctctctcttcgttgtctgtccatgttccttgtctgctttcaaaatatttatttattttcgctgggttcggtggctcacgcctgtaatcccagcactttgggaggccaaagcgggcggatcacctgaggtcaggagttcgagaccagcctcaccaacacggagaaaccccgtctctactaaaaatacaaaaattagccaggcatggtggtgcatgcctgtaataccagctactcgggaggctgaggcaggagaatcgcttgaacccggaaggcagaggttgcagtgagccgagatctcaccactgcactccagcctgggcaataagagcgaaactctgtctcaaaaaaaaaattttttattttaaaaatacgtttttaaaaattagacttacattcacctagtatagaaaattcaaataatatagaaaagtgtcaaacaaaaagcaaaatttaccttctccctccagtccccagagccactctccaaacgctaccaccatttgttttgaatcgttcctgaaaagtctacatatacctgtatacctctttttaatctaacacaaatgagatcatattaccttgcatattgttttctggcataacgtatttagaagtttccctatcaacatatatacttctacctcctatttcagtgattgcatacttttccattacatggatatatttaaccagtctcctgctgatggatgtctaagtgttttccagttttttgttattataatgttgcagtgaacatccttgtacatgattttggcataattttgccagcaaaattaccactagggcaaattcctagtagtagaattgctgaatcaaccagtacctgcactcaaaatgttgacagacactgctaaattaccctccagaagacctgaatctgtttgtacactcccagcaacaaagtatgagggtgtctatttctccatagttttgtaaatactgggcattacaaaatttttatttgttttccaatatgatgaaaagtggaaactcattctgctttacatttctttgactatgagtgaggttgaatatcttttcacatacttattggctatttgtatttcttgtaatctgttcacatcctctgcctgtatggtggttactttatgagtccaggtgtctgaaccattgtctattgtcctagggaagttaatagagtgatagaaccccatgaatttcaccttttcacaagtaggagcctcaatcaatcaaagaagattgaacagccctaaaatgctcaagtaagggatcgctcccggtgctttctgtccattggtgcttggctgaccatctgactgcttgaaactccttgatcatccagagctttcaagttggagcagtcaccatcttctcccttctcccatttggtgcataacatcaggaacaggtggcaagggaactgaccaggtccaaagccacttgtctctttgggaaataactgcagcagcacaaatcaataagctttgacccagtacttctactctgacctattactctactttgggaaatctttcctaaagaaagaattccaaatataaaaaaaacttctatgcacaagaagttcatttacagtgttgtttaagtaatggaaaactaacttcaaacagcctgtatgtccaacactcaggaattgctcagaaaatcctttgaatttattatcacggagtgcttaatgatcacgaatataaagacaaggtgatgacagaaaaatgctaataatacaatgatttaacttttgatgaaactaatacatttacactatttacctataaatatatttaaattatactttttaaaaacccaaaagggatgttaacagtagttttgctaacgagctggcagtataggtcgttttctcttatttttccaaacataaaaagacaatttttgtaattgagatataattcacataccataaaacgcacctttttgatgtgtatcagtgatgtttagtatattcatagcgttttgtaaccattaccactatctaattccagaatatttttatctttccaaaaagaaactccatacccattagcagttactctccactcccttcttccaccagcccctggccaccacgaatctactttttgtttctatggatttgatttgcctattctgcctttttttttgaaacagggtctcactctgtaacccaggctggagtgctgtggcacaatcacagctcactgcagcctcaacctcccaggctcaggtgatcctcccacctcagcctccctagtagctgggactacaggtgtgtgccaaccatccctggctaatttgtgtattttttgtagagacaggttctcaccatgttgcccaggctggactcaaactcctgagttcaagtgatcctcccatcttggtctcccgaagttctgggatgacaagatgagctactgcacccagcctggacatttcatacaaatggaactatacagtgtatgctttttgtcactgatttctttcacttagcataatgtcttcaagattcatctatgttggccgggcacggcggctcatgcctgtaatcccagcactttgggaggccaaggcgggtagatcaccggaggtcaggagttccagaccagcctggccaacatggtgaaaccccgtctctactaaaaatacaaaaaactagccaggcatggtggcaggcacctgtaatcccagctacttgggaggctgaggcaggagaattgcttcaacccgggaggcagaattttgcagtgagccaagttcatgccagtgcactccagcctgggcaacagagggagactctgtctcagaaaaaaaaaagattcattcatgttgtggcatgtatcagtactttattcctttctatggccaaataatattccattatatggatataccacattatatttatccattcatcagttgatggacatttggttgcttctaccttttgactacaatgaaaagttgctatgaacatttgtgtacaagtttttgtgtaaacatgtgttgcagctctcttgagcatacacctaggagtgggcctgctgggtcatatagtaactatgttgaactttttgagaaactacagaactgttttccaatgcggcagcaccagtttacattcccaccagcggtgtacatgtgttccaatttctccacatccttgttaacccttgttagattcaggatttgtcaacattttctctcattctgtgggttgtcttttcactttcttgacagtgtcctttaacacagtttttaattttgatgagatccaatttagctcatctttctttggctgcttatgtttttggtgtcatttctaagaaaccaagatcatgggctgggtgcagtagctcacgcctgtaatcttagcactctgggaggccaaggcagcccaatcacctgaggtaaggagttcacctgtctggccaacatgggaaaatcccatctctattaaaaataatacaaaaattagcctggcatggtggtgggtgcctgtaatcccagctactcggaaggctgaggcaggagaattgcttgaacccaggaggcagaggttgcagtgagccgagactgcaccactgtactccagcctaagtgacagagtgagactccatcacaaaaaaaaaatcacaggccgggcacggtggctcacacctataatcccagcactttgggaggctgaggcgagtggatcacgaggtcaggagatcgagaccatcctggctaacatggtgaaaccccgtctctactaaaaatacaaaaaattagccaggcatggtggcgggcgcctgtagtcccagctactcgggaggctgaggcaggagaatggcgtgaacccaggaggcagagcttgcagtgagccgagatggcgccactgcactccagcctgggcaacagagagagactccatcttaaaaaaaaaaaaatcatggcaggaggccaaggggcagagcctggcagtgccagtgttggtggcagcagtaggcctggcatgggcaggattccagggagagcgcagagtctgtacacaccaggccacgcccacaagggctacccatcaggtaacttatgacacgtagttcccaaggcccagccagactgcagacaccatgagtgtagtccaatctccaagtaagattctcaaactaaaggaatgcctaggacagtattgcccctgcatatagagtatctcaggacactgaagcttaggctgggactgtgacagtatccacgatatgtgtgggggtgggggtgtctattgtgtatactttgcatatttataaaataaaaagttcagtggtccatcaggtgacaaatgacttcagaagaatgaacacaatgaagcatgggttggctgtccttcttttcacagagggctctgcagtggtgatggcacctctgaggcaggttacctggtatttgggagcttccccatagaaggtgtgccatagaaaatgcttgctttggccaggcatgatggctcatgcctatagtcccagcactttgggaggccgaggtaggcagctcacctgagctcagttgttcgagaccaacctgagtaatatggtgaaaccccctatctacaaaaaatataaaaattagccaggtgtggtggcatgcacctgtggttccagctacctggcaagatgaggtgggaggattgcttaagcctaggaggttgcagtaagccaagattgcaacactacatacagaaagaccatgtctcaaaaaaaaaaaaaaaaaaaaaagcctgctttccttgcactgggggagctcactagaatgaaccactactgcctggctcctatagcctgtttattcaccacactccataccctagagataactcacatttgctgctaatcttttttggttaacttgctgaaataattcttacaaatttttacaatttcaaatgacacgagttagtacaggaaaagtataaatcccacccacagagatactcattgtaaagtttggcgtgcagattcccagaatttattctatgaaccaaaaaaatatacacctgtggctgggcatggtggctcatgcctgtaatcccagcactttgtgaggctgaggcgagcagatcacttgagatcagaagtttgagaccagcctggccaacatagtgaaaccccatctctactaaaaatacaaaaaattagtcggtcgtggtgccgggcgtctgtaatcccagctacttgggaggctgaggcaccaaaatcgcttgaacctgggaggcaaagcttgcagtaagctgagattgcaccactgtactccagcctgggtgacaaaacgagactccatatccaaaatatataaatttgtttttttcgtttttttttttttttttttgaggcagagtttcgctcttgttgcccaggctggagtacaatggcacaaaatcagcccaccacaacctctgcctcccaggttcaagcgattctcctgcctcagcctcccaagtagctgggattacaggcatgtgccaccacgcccggctaattttttgtattttcagtagagatggggtttcaccatgttggccgggctggtctcaatctcttgacctcgcgatccacccaccttggcctcccaaagtgctgggattacaggcgtgagccaccgcgccaggctttcctttcctcccctcccctcctcttttctcctccctccctccctccctctctttatcttttgacagagtttcactcttgttgttcaggcgagagcgcagtggcacgatctcggctcactgcaaccttcacctccgggtttcaagtgattctcctgcctcagcctcccaagtatctgggattacaggcaccaccaccacgcccagctaattcttgtatttttagtagagacggggtttcaccatgttggtccaggctggtcccgagctcctgacctcaagtgatccacccaccttggccacccaaagtgctggaattacaggcgtgagccaccgtgcctggactagaatagctttctagaggtgggactgcagatactagggaatgtgaatttaaatttatgagagataccaaaggatttaaaaaaaaatttttttttgagacggagtctcactctgtcgtcccgacagactggagtacagtggtgtgatctcagctccactgcaacctccgcctcccaggttcaagtgattctcctgcctcagccccctgagtagctggaattataggcatgcaccaccatgcccagctaatttttgtatttttagtagagacggggtttcaccatgttggtcaggctggtgtcaaactcctgacctcaggtgatccaccttggccgcccaaagtgctgggattacaggcgtgagccaccgcaccggccctagcaaggattcttaacttgcaatatatggttaagtttcagaaattatacataaaatgtttgtccatgtgtgtgtgtgatttctagggagatccatagattttgtcagatatttaaaaagtttcaagtcactggggtacagggggccggcacttcactacagcagtggaccatgtgtagtatatttgcaggttttgagcaattttatcaaccaggtacttgtccagcaagggtcactgtctgtgcagctaccggaccacctgcaaggagagcagatgacagcattcccacgtatctcctgcccctagagtaaaggtgaagatccatacagaccacagtcatggtaccacctcctctttaggtctgattaatttgctagagtgtgccgggcacggtggctcatacctgtaatcccagcactttgggaggcggaggtgggcagattacctgaggtcaggaattcaagaccagcctggccaacatggcaaaacccggtctctactaaaaatacaaaaattagcagggcatggtggcaggcgcctataatcccagctactcgtaggctgaggcagcagaatcacttgaactcaggggtggaggctgcagtgagctgagatctcgccacttcactccagcctgggtggaagagcaaaactctgtctcaaaaaaaaaaaattttttttttccgctagagtggctcatagaacttagggaagcacttgctcatttttactggttattttaaaggatacaaacaaacagccagatgaagagatacatagggtgaggtctgggagggtcccaagtgtaggagcttctgttaccatggagttggggtgtgccaccctcctggcacgtggatgagttcttattcactttcctgtcagcctccacctgttcagctctccagaaactctctgaacccagtcctctcagcattctttgtcccagggtatggggtaggaccctctctggaatgagggtcttatgacccatgatcagaagggcagggcaagattagagtcctgccttggggcaggtgaaagagaagcaggaaaaagtcagagagattctgtttcctgaggcctgctcctgagtcctaacactctcaacattataacgaaacactgtataacaagggctatgggagttatgagccaggaaccatggataaaaacatatataaattcacacatatattaacatcacatctatcaacgaggttgagcatttttttcatatgtttattgcaatttgcattttctccttggtgagctacctattttatgttgtatatattttcccacagtaaaagagaaggaaatgatttacagctctacatagtatcctggagagacagtcatgaaaattgttaagaaaaaaaaaatccatgtttctctgaatagtaagatgtgtgcgtgtgtgtgttcacagaaaaaggaaagggaggatataaaccaaattgttaatattaacgacctcagggagtatgcagtatttattgtttggctataagaaggggcatgaatttagaggtcagaccaggctcaaggccctagctccactactgatttgatgtgtgacatggacgaataacatgccagtttcttcatctgtaaaacaggaagagaaatagagctgttgtgagtagtagatattacaacagtgcctgtcacaataaagtgtagctattgtcatcatattattatctccttcagtgtcttcttcactgtaccatatctattcttccattcaggacttctttattgggactgtaaaaagatttaagtatcaaaagagaaaaacatagaaataaaaacaaaatacaaaaagcctaataatgagggggttcacatagtacttgtttctgatcccactagaactagcttgcctctgaggccatccgagatatctaagctttggccctaaagaactgccacaaatttggagacgtggcctacatttctttcttcttggtctgtcttcacatagaaggtgctcttaagacacacagcctaggaacctccttctcaacacctccacaccttcacttgctctttgctatccctactgtcaccctcctcttttctcctgccacatcaacagcttcttgcactgcaaatgttttctggaactctccccatgactgacaggctaataaggagttattttatttgctgtttgagtcacaaataccatttttatccaatcccaactttgccttttttgtagggttactgctacattaatgttctctggcttgagaaatctgaagcctttaggcagtgattagatttttcctacgtgctttacaacacttcacattcaacaaattcattaacgataaacaggaaataaaccaacaatttctcctggtttagttcacccttaggacacgcatctatgaaatcagaaatcttattcctgtcagaacaggatggccatgtgcttccctgttaacaaagaagtcttaattttattaattacaatgcttacgactaaaacaaagcaggacctctttccattgatttcacatgatcgccagagtctctcatttctctgcttccttctgccatctttttttttgagacggagtcttgctccgtcgcccaggctggagtgcagtagtgcggtctcagctcactgcaagctccacctcccgggttcacatcattctcctgcctcagcctcccaagcagctgggattacaggcgcccgccaccacgcccagctaattttttgtatttttagtagagatgggatttcaccgtgttagccaggatggtctggatctcctgacctcgtgatccaccccgcctcggcctcccaaagtgctgggattacaggcgtgagccaccgtgccccgcccccttctgccatctttatattcgttcattttccgtttccttcccttcctttcttgtctctccctcttgaacatttctaagcaccttgtgtgtgccaggcattcagtaacaaagcttgagcaaaacagcccaccttctcattatcatggagcttacaagcctaactgggaattggagacattcatcaaataatcaccaaatctataatttgaaactgcacttagtgccatgaaataaaacacaggcccctgtgacaaatctgtgtagatgaaggcttcatccaggaagtggtagctgagctggagtgagaaggataaggagttagccaggcatctccccacatttagagcgccgagtgggcagagaccaggattgttatagcatttgctcctgggtctgactcacagatgtgctcataaatatttgtggaagggaggaagggacaatacgaataatataaaataaatgaaaatgtgtcctcctttgttttgatactatgaaattaataaaattaactgctactaactaaaaaatccaagtagaacacagaaaggagagtgtggcacaaggtaaggttgcagaagtagcagccaaatcacactggggccttgagtatgtagagattttagtccgtatcccgacagcaattgaaagccactgaaaagtaattcacagcaaatatagttaatttttttacagcttacattaaaacaaattatgtactagatactgtgctaaagactctacttgcactatttgaatccttgaaacaatcctatgatgtactattaatattccaattttacagaacgaggatactgatgcatagagaggtcgtgactccaaacccctactcttactgtattacacctacacactattcacaagtgagagaagtaggtaagcaactatgtacagctaaatctcatctccttggcaggcctagccccactgtggagttggtagcacaggggtatcaggatttaatgagccaatcattgactttacgctccttgttctgactccctaataaaataaccttctagttatattctggcttcccatatagatttttctgctgggagataatgcactgaccagcctacacacgcattttgttccagttgacaattttattacacattgtaagttaataaattggcattctcctttaaaaaataacaaaaaaatttaatagtcttatacagttactttcccatgaagggttagcttgaaaagtaaaaagcaacgaataaaaatatcatcacctattgtctcttttgtggtcgaaccttttcttgctgcctgctttgagcgaccgtggatgtggtcactgagtctggggaggagccctttatcttctttgtggatgcccccagcacagcccaagtgcttcctttgtttcccactgagcctttagcaaatcccacctttcctcctgcaccgacggagaggattgttcttgggaatgcaccttgttctactgccgccagcagtaggcagctggagactgttactaggggtctccttcacctccccagcgtaaagtacatcccatgctaggagcaggccgttccctgagaacctcattaaacccggcgttcttgtcacgcgctccgctcagggccaccaggccaccagcccgaccagacctgcaccgaggcccagccccagaacaggctgcagagacccccgcccccaaggcgggctccctccaaacgggactccatactccttgctggctcaagttttgtttcgctctttttccctgtaattcctttattgggcaaaactgggacaaacgcaggtggacattttaaagtgaaagcttcatgaaacagcccattccacgccgtcaagagatctgcttaagcacattcaagggaacgaatagcccccacccaccaaaaaagaaatgttcgttccatattctcctgaacagaggattgaaacatcgattcccccccccttcaaaggaacaggaaggccacggggcaaggacggacttgggagcggcctcctttctctctggagggaaaggctggagcgctgcctccacttttaagtccacgaaccacgaagggtgaggatccctcagaaactttagcgcaggggagcgggcaggagggcgattgtttaaatcgatggcagcaccttcattaatctgctttccggccatcttcagcagagccattcaccaggaaacgactagaaggtgggcctgcgcccctcagatatcccggggccggcaacgagccgggcagggacgccgaaggaaggccgtgaggagccctcgctggccggccaagatggccaccttcacatggccgaccgccaccggctccctgccacccggcatctagaggcgggacggccagaaagaccccagccgcagcacaaaacctccgcgattcccgccgcctccgctgggggacgcgacctccgggaaagctatcccggccaacggtcggaagggaggtgccatgtcaccgcacaggggagcgggtccagcaagccccagtcgctttttctcccacatcaaacaaggaagagcaatcccccacgtctcctcgcgtctgcatttttctcctagctctagcggctcaagatagctgaacggtctctggagggccggattgccacggcacctcccgcggccgcgcagtgtggttcagcccggactccgcggggcgagctgcccttcctcccccgacccccgcgcaagtggtgcattggcgcgcggcgccgaggggcggggcccgagccgggcgcgcgcgggcgctgctctataaataccgggccgcaccgcccgctgcttcgttcgctccgcgccgcccgcctgctacgagtagaacgctgtccgcagcttgcgcatttcgcagccgctgccgcctcgccgctgctccttcgtaaggccacttccgcacaccgacaccaacatgaacggacagctcaacggcttccacgaggcgttcatcgaggagggcacattccttttcacctcagagtcggtcggggaaggccacccaggtgaggggacggcctgaagcgaagcgtggggcggggcagaaggcagcgccaaggtccggctggctgcggccggccggtggtggggcccgcgcgggtcgtcctcgtccgccgggtgatggaagagcggcgaccgcgcgctttcctcgtggcgccgccagggcctggcgcgtggccgccgctcctcttccccctcccctctccacccttcccttcccccctcccttttcattcggtcgcgcgcctaggcatgcggaaggttccagaaaacgtgaagggcgggggctgtggtcgctagtgagttctggccgggaagggagggcactgttaacccctcccggccctgccgtctgacaaacctggagtgggcgacccgccccgcgtgctcgcgtccggccctcgggagcgcgcgccccgcattgcagcggcgaccacgtgtttgccgcatgtggtatctgggcgagggggagccgtgagcctccccggctgtcctggccctcagtttgaggggtggggggcctatgccttgggacgtcgtctggctccactgcctcagtggttaggtcttgactacacactggagaatacgcacatgcccttcggcggatatggccttgcctccaaggtgacggcctctgactaaatatagctcatgtccaagaaggcagtccttatttggaccccttgtgaaaaggatgggaagcatgaattaggagctgccattgctttgggttcgcatttaaagtcttcggtgcagggttttacttgaggctttgtccgctcaaccgccattatggggatcaattggcacgtgaaggaggagtaaagctatatttccaggaactgaaaatctcagcctgagcatatcggctagtaaagatgattatttggctcttttggctgtttctgcccttaggatgaccgcagtagttatctatctggtggctttagggtctggtcagtttactgtgcccatgatgaaatcccacaagtaacttagtggtatgagaggacaaacccaggatcttgatgagtgctgaaggttagctgttacaccagttagtagtagaccgaagttcagagcctgcagtctggcttccacattatgtttggattctgttttaggcggttatagaaaattcagaaaaacgaacttgaattagggagatatttgttctccctcctaacaatagatgacaaagcagggagacatggattcggaatacgtttgagcatcttctacactgttgagcttttgtttcctgcgcaactcctaacagcaaaatcagataattgccattttagtcagaaaatgcttttcatttaattgtttaatcgaattatcttgttgctcattataattggtgttccttaagattagggaaactggcctacctgtggcctcagttctaccagactcccaggtgcagaggggtttggtacagttgtggaagtgaatatgatatagggcaaattctgttctttaaaggatataggactaacagttcacctttctggtgattagatttataatgcaaactttgaattttaggaggaaagtgcaaacacaatgaattaagatgtattaagcatgttttttaaaatctccaaagattttacagatagtaacagggagggagcttgcatacatacatacatactttgtttaaagttaaagaaactgagccaggaatttctcttttccagataagatttgtgaccaaatcagtgatgctgtccttgatgcccaccttcagcaggatcctgatgccaaagtagcttgtggtaggttcagaatgtgcttatcaactggtggaaagatagcataaaaattatttttatagaagtgatgtttgagttgaatgtctctttttattagaaactgttgctaaaactggaatgatccttcttgctggggaaattacatccagagctgctgttgactaccagaaagtggttcgtgaagctgttaaacacattggatatgatgattcttccaaaggtgtgttttaatgattttgctcatttttttctaggtaacagctgtgaggtttgaagaaactcctagaatgttcctgctaatcctaaactccagttgtatcttactatacactaagccctattctgttcattctctaaaaggtccgatggtttaggtatatttgatttcttcagcagtgtttagaattccagataattgctgtaaacagcaggtatttctaggacgtaaacaagatgttgtgttttttgcttataggttttgactacaagacttgtaacgtgctggtagccttggagcaacagtcaccagatattgctcaaggtgttcatcttgacagaaatgaagaagacattggtgctggagaccaggtatcttggtgtagaggctgttttaatctcttctaacattaaattctggagcttgatcacattggtgacttttctttctttagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagtaagtgatgatcataaagcttggttgtctcatttattacatcagcacagaagatccataattttgataatagctaactggaaaaaatagcatttgttttcctatattgtaacttcaggtagagaaacaaatacaaagttattgtttggtgtgatgttctgatgacctgtgttgccttcaaggttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcaggtaatgtcattttgttgcatttttctggatttttgatggttacttaaaattttggctactacatttttttcaggctttctgaaacctacatgtgaatcatcggaggatatttgctgaatgaattcagaataggcaacctaatccacttggaaagcactaggcgtaaagtaacttaaatcctgtaatttcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtatacactctttatataacgaacgattaaaagtcatgtaagtgggagggtatttagtagtaatctacttaactacttgttttataccaacgtattatacaagtatatgggtctttgcaatcactgattcttacgacatttgaatccttttaggtctcttatgctattggagtttctcatccattatctatctccattttccattatggtacctctcagaagagtgagagagagctattagagattgtgaagaagaatttcgatctccgccctggggtcattgtcaggtaaagatggtaaagcctgttgctagtcaagtattgagggtgttgggtgtgtgtgtatatacttaaggctgaggaggtgaaggtgtgaaggaagactcctcaaatgggaatatattttaattcctggaacagttttgaactgctgccttagtgaagacttagttatttgagaaatttaaaattacggtgctccatggcttaggctaaccactctagagaatgttccagatttgatatttgagctttgtgctcttctacttaagggtgttaagaaaatagagataaagtgggttgctcaaggtttgttgcaatgtaaaaaccatggtagggtgtgggcggcgggaccttggtaagtattgtgtgatctcaggtgagctttttgacaattgaaatttctcagaataatgacaagttttcgtatttgttgagccagggacggaaaaacaactatagttactaataaggactgtgcaaggagtttggacaccagggaagtaacacttttgccacaaatttttttcctagcatatcccagagaactcatttgccagagctcttgaaaatgagtcttgctgattgttttgctttattttaatttaatgctacatattaagttacggacttgtatattccagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctaccttaactgtgtctgttactcatttgttaaagtgctttggggccataggtacgtgcctataatcccaacactttgaaaggctgaggtaggaggatcactttaacatagaagttggaggctgtagcgaaccattatcaagccactgcactccagcctgggtgactgagactttggctcttaaaaaatgctatcatatgaataacctgagaatactatatgtgtatctttaaccttgaattgtaatccataattagccataattcaggaaaataacctcaatccctagacccagtgggtgggcattttttaaaagcctaagcaagatttagtcctcctagtccacttaagccaaaattcatgtgtccttattgcagcagccattcaatgccatttttaagttttcaactaaggttgagggcttcaaaccattgaaggcataaaaaccgctaaaagtattaacctggaagtggtaatgtctatctaaagtcctggcaatttaagcctattaatctgcatacatttttaaattatgagcttagttttaagggttgtatgatgttttcatctgagaagttctgaaacgtgatttctagtcaatatcttgcagagataaataatgcaaattagctgaaaatgctataaatttccaaaggcttaaatttcatttatggcaggttgtgtagaaaatccgcagaccacactgctcttgaacctaggagctacatgcatagagaatagccacttggattacatttctaccaacatctgaatggtggtccagcttgtcctgcaaatgtagagccaaggagtgcttgcttatgcctgtttgcatggagacttaaaaacttggaaatttggaggccaggcggagtggcctgtaatataggccactatatagtaatataggcgtgagcctataatcctagcactttgggaggccaaggcatgcagatcacgagaccatcctggctaacacagtgaaaccctgtctctactaaaaatataaaaaagttagccaggcacctgtagtcccagctactcaggaggccgaggcaggagaatggcgtgaacccgggaggtggagcttgcagtgagctgaaatcgtgccaccacactccggccagggtaacagagtgagacttaaaaaaaaagccgtggaaatctgggtatggtagcttacacctgtaatcccagcactttgggaggctaatgcgggtggatcacctgaggtcacggtttgataccagcctggcaaactgaaaccccgtctctaccaaaaatacaaaaaagctgggtgtggtggcaggtgcttgtaatcccagctactcaggaggctggagaatcacttgaacccaggaggcagaggttgcagtgagccgagatggcgccattgcactccagcctgggccagagcaaggttccttctcaaaaaacttggaaatctgttgggaagtagggggagggcaaggttaaaacctatgcaggtgtgtcaattagacttgttccaacttgagaacctgaattttgcatgtaattgaaatgttccagaacaagtctggcagtttcataagggagtttttagatgccaatacattgcagataaccatattggctacattaggggaatgagcatggataggtgcctccaagttggtagaatagcatgagaagttttcaaaagtaaccgctttaaggttatgttcagtatttgctaagtaaacaaagattccccaaccttgagggagcttgtggaccaaggggatagtgttgtcctgcccagcctaggggaaaagtatcctgaaggttaataaggtggtggaggaacattaggccacagggagcagagggaaagcataacagcaggggatgataagggtgattatagtttagaaagcatgaaagtatgacttaaggaaatgtctttaggttgaacattctgtatataacctgcctttctaaagtttcaaaggggatggatacccatcaggggcaaagatccaaatcctgagggtagaatgaggaggatgtatactaaagtcttttggctaaaaggacattgatagcccatttttagaatggctacagttgcaacccaactctaccccactgaacagcttttattaccagtatttacatgaccactttttctttacacctcaccctaccccaatatcttccttgggaaaattggtcagagaggtggtatactaacagtttggggaagggcagcatccttgcccatatttagaaaaatactttttcaagtgtcttctcccaagtaactcttgggacttttgttaccagtcaagtaggtacagtgagtttggcaaacaacatagtggcaaagtatcttctattgtgttactatgagagaagatctgcaaaaggattgaaaatcagcatccctcccacccattcttacaaagtaatcaggggaccctgtgccacagccattgcttgcccatataataccttgaatgaattagagattttccaccaaactccatttggcctcctcagtggtgggggagggtggcaatctgcttgacaactaacatgtcggccctgtcctggtctatccctaactagatgctaatacaaaggttgaaaatacagatataggtagtaatgaaaacagatttggctgggcacggtggctcacacctgtaatcccagccctttgggaggccaaggcaggtggatacttaaggtcatgagtttgagaccagcctggccaatgtgggaaaccatgtctctactaaaaatacaaaaattagttgggcgtggtggtgggcacctgtagtcccagctacatgggaggctgaagtggaagaatcgtttaaacccaggaggtggtggctgcagtaagccaagattgtgccactgaactccagcctgggtgatagagtgaaaccctgtctttaaaaaaaaatagattcaagaggtatccaggaggtaaaattgatgggacttggcaattttaagaaatgcaaggaaaaaggaagagtcaaggctgatgacctagagataacagcttggctaaggtacagagctgccattcaataataaagaataaggaagtctgagttggggatgaatgtaagttctgtttaggatgaactgagcttgatagccctgtgggatatccaggtggaacttagacctatacgtctagggcacaggaaagaaacctagcatcgttggaaatcctggagtagacacaatcatctgaagtatgtatactgaaaaagcagttgcttaggaaagaacccccggaacactgtccaaggaggagtgggggagagtatgggaagagaagcctgcaaagagatgcaatcatttacagaagttactgagactgccaatttactaccggtctctgctacaagtccatgagctcccaaagcagggatcctttttcataaccctgcattctcgcttcctagctcagtgccaaccctttgaattttcactgaactgaggagcttcctgagttacccttgtataccccaacctacaaaatgtctaagcattccctaatcccttactaaatttagttaattcttactttacctccccttctgctcaccaaaggctagaataataccaaatactaagcttatttttagagaaaatctagcaatcatctagatttccttatttaactttgatgctgctattctgactgctctcataactgctagtgaaacactgggtgtatatagataataggaacaaagaaggaaccaaaattgcaatgaagataaattactttgtgtgcatttacaacctgaccaccatccaattatacttttaattaagaaaacatgttttaagctgcattatttcagattatcagtgattctgaaaattacaagtggcagggtgcaggaccttaagtcaaatagacgttaagttcaaaccatcagtccattcgtcactagctgtatgtcttcgggcaaattattttacctctcagcctaatgtaataatgcaggtaacactgctcacgcggtgtgttgcacatagcaaacacttgggaacagttagctattcatcgtggtacattaaattgcttttccccaagagccactttatttatttattttgagacgaagtcttgctctgttgcccaggagtgcagtggctcgatctcggctcactgcaacctccacctcctgggcccaagcgattctcatgcctcagcctcctgggtagttggattacaggcacccaccaccacgtctggctaatttttgtatttttagtagagaaggggttttgccatgttggccaggctggtctcgaactcctggcctcaagtgatctgcccacctcagcctcccaaaatgctgggattacaggcgtgagccacggcacccagcccccaaaaagccactttaaaccttatcctaggaggacagtttcacattgcgtctaacctcttcctggcctcttaatcttgggttgttaaatcttatttgctttatttccttggttcctctaagttgtaatctcggagttaaaaacagctttagaaccccgcccccccaaaaaaaaaaaaaaaacttttgagaatttttttcaaataaatgtccattgcatagaatgggtctgtgactggctgcttctacatctgcacccaacatctggcccccttcagaactctgagtggacaggatcaggatttgactcaggaggattagaatgtgaagaatccgtgtttgagggattcagttctccaactgcctcaaagggtctcaagtttgcataagtcacctcctgggccagctgctccagggaaggacggcctaatatcagatttcgaagtgagatacaagtcatcaggaagctgaaaaacaggaaaaagccgaccaagttcaaactcctgtttcaccagaagaatttcagctaaagcccttagaaggcacctggtcctcactcctcccacacaggcatatatgggaatctccccccaagtgaccctccatctcccagctggaagggtacaccactctttatacagtctggtagaggattccaggatagggtaggaacagcccacagagaggctggagataagctgaggcagaacaagaaagcaggccatcagatataggccacttattcttccagtaaatcaagaagaatggcaggaaaagatacctagagctaaactgtcctttcctgtatgacagtctctagagttactctccccaggggaaagttaccaagcttgccaacatatgatggcaatgacaaatattgttgtgaacttacctgcggcgaaagacatagagctttcgcaacaagaagcggaagaatcgctcatggaaaggagtatttcgccggcgttcaatctcctggagcctttgttggcgtctaagaaaggtctgaaccagaggtgttggctcagggcccccttttacttccccttccaacagaggctgcagctctgggggtagaggccctgtttctgcccggaagacagaaaaaagaggaatcactgagatggatcactctctccccttagaactcctcttctgccagctagagacttcaagttcattcttgaatggctagaacatcattcataaccctgacttcttgaaaccagaggctatctcagcccaaatgttcatacactcaccacttccattctccaccttttcctttaattcttgcagatatgccaggtcttgctccagtgcaagctctgtagtgttgacatagacgtacatgtagcaagaagggctaggtgatgtcgtatacaccttatggtactcaccagcaggcaactgacaagggagaagaaatggataaatttcatcagcttttctctagccagcttatggcctccctactctatgactcttggcttctttctactcaattgtgttttggaatcgaaagtaacggacctctagaatcctggatgaggctcttcacagtcccaggggcccttgttttttgagctccactgcattactgctatggtaaaatattttcagtctataataagtgaatcttgctcatctaagctttctgccattgttttttaaattgttagagatggggtctcactctgttgctcaggctcactgtgaattcctggcttcccacctcagcctcctaagaagctgggattactggtgtgagctactgcactcagttctttctgctgttgttaatcccagcaaaatacctgcattttttctccctctcgaagagtctggttcttctgttctgccacaagctccacagtcacttccccctgcagcagctggatgctagtgttgcccaggtcttcactcacaaaattctccaagtgcagtcctgccagaccaacagagttcatcatcccaccccatggcagagtgaactcactcccagccagaacagagacatcacacctttaccaccatcatccccttaggtttcaaaaacattccctctcccctcccaccacatggaatgtccctggccaaggaagccagaaggaaagacagaaaagcctctcctcactttcctccataccagggaaatctgcaatgaagaccacctcagtgtggttgtctaggctgctcttgatttcctgtaacttggccctccagggagacaggtccatcaagagtggttgcacccaggatgtgcgctgaaagggtgaccaagcggcctgcacgatgtccacacgagggtcaaaaatccttaggaaagaaaaccatgttctaaggacatcacagccacccacccaccagaacttccagttctctccctttcatcatcattcctaaggacagggaatagaagaagaaatggcctgtgtcagcatgttattgccagtccagggcagagaaagaaggcagaagagatctggagcactgggtataatgggggttagtagctacctgagaaggtattatgtcaacagtgtctaaaagaacaagtcaactcacttttctcctggatgatggtgccccctgctggaagcaaccagctatgcccacaaccagatcaagggggacatgcactagaggaaggacagctttttaagcaagacaataccaggaagcaagggctgttcatcttggtaaaaagaactgtgcttcattttttcccactctctgctccccttgcccacctctgctggaagcggtcattgatggagacccaaatatcaaagtagatctggggctcagtgacattatacttgggaagcaggcggctcaggcaagtggcatattgcttcagcatgtctgcatgatccttccatcgccgactctgtgtaaatacctgccccaaacccccatattagtcccacctcatcattatcaacttccaagacatgtcatgcactgccaatggcacaacgagatccctgcctgctgcccattctggctagaaaaaaatggaacttgcctttgggaatgaatttttcattgttgggctagtggtgcttacttttcctgaatctaatctcagttcaaggaaatgaatgcattgccctatctcaacccacataaaagatagttcaatctggctcttgagaaaaggcaaagcagactcaaatttgttttgctttatggtgtgtgtaagacaaaaccagaccccaaagcacaagggggctctgaagaacagtaaattgtcagcatcagacatctcaccccagggttaaggtagcccagttcgccagtgcggccatcacggtaggtgatcttcacgtgctggtgggagcgggagtgcaccatcatgtcccaggaatagccatacagcccatttgtccagttgttatagccctgggaaggcagcacagaggggaatcagctcaatgcttctcacactgaccccatcccctaccaagaaggggctgcaaaaccagccccattctttcccaactattgtcatccgttcctttctaagtccagcctttgctgtacactccacagcccctacaaacctgggtgagaaaatgagaatagggcaggaatagctgctccaggaggtagagcagggtgaaggcagctcccagctgatggcgcagccctggcttctggccacttttgccccggctcctcttatacacacaggaaacactgggctgaggggctgccttgaggggcaacagttgttgcaaccttcgggggcagtaggacaccagcttccgaggccactcaggggagcagaagagagggctgctggccagcatgacgtaggagaacatacctaggaaagcagggagaaaatacatatttcaggagtttggctgggcctcttcaaccccgttcccttaggagacttctcccaggtgttccactgaaaaggaaagtagttcttcttttttttttgagacagtctttctctgtcgcccaggctggagtgcagtggcgtgatctcagctcactgcaacctctgcctcctgggttcaagcgattctcttgcctcagcctcccaagtagctggaattacaggcatgcgccaccatgctcagctaagtttttgtatttttagtagagacggggtttcaccatgttggtcaggccggtctcgaactcctgacctcaggtgatccacccacctcggcctcccaaagtgctaggattacaaacctgagccaccaagcccggccacaaagtagttcttaactgtaagatatttgttcttcctggagattccctactgtacaacatactaactgagcccagaagccccagtcctcttatccccatttatgcctacttcatagtgactgccctgggttcaatttagctcctgctcacaccaccctctcccactcccaaacaatgcctctggctagtcccttcctgcaaaactgtggttcctgtttcctcccaggctacaggtactgaccaatgctgaaaagctgggaattcatgcagtggaagtaggacacaaagaacagtccaatggatcttgagacatcaaaaaagagcaggaaaccagctgagaggtcaagcagcagcccaccccagtgcacgaccagcaggctagtcagctcctcagacaacagcagtctgcaaacacatggagaaagttcaagcaccagcccactggagaacacatcaaagcacattcacagcacgaatgtgccttggctactccagtggctgggtagatgcctaaggtacataatccacccatgaagacactcctctaggttgtttgttgttgttgttgttgttgttgttgttgaaacgaagtttcactctgtcgcctaggctggaaggcaatggcatgatcatggtgcactgtagcctcaaactcctgggctcaagcaatcctcctgtctcagcctccgaagtagctggaaccacaggcacgtgccaccacgcctagctgtttttttaaaaaatttttttgtagagacagtgtcttatattgctcaggctggtcttgaactcctgggctcaagcaatcctcccaccccagcatcccaaagtgccgggattacaggcatgagccaccatgcccagccccctctacattttcacacactttaggtgttcaatgttttctaacatatcctatgtaataagcaagggcagatctcctaggacaaaatttgactgagatgtgtgtgtgttgtggaagggacgttccccacggaggtcatgagtgagaggacactttaaaaggtgaatgcttggctaacatcataatgaagtcaaacttcaggaactggaaaataacagggaagaagaaagagaataaagtaaaacaagaggaaagaagaaatgggaagaagacaaatcagaaaggtgaccctttgttttgtggaagtgataataatggttttgtcagagcctgaacagtgagtgcccatcttctcagtacatcagctgcagggctctgatgggaggctagagtggcaaggcaaggacacaggcaccatccaaggcagctgctgagggcactggctcactcaccaagtcagccagttccggctctttcctttcctttttaaatttcttttcctttcttgcctatctataccatatatctcccaagagcagctagggctcaatcttttgataccactgactctgcttctgctgaatagggaaatgagtggacaaaggaaggcatgtggcaaattcaggcaaagtaggaacaggtgccattactgagagagatgagtcacctgctctgtacccatgcctcaaagaggcctccaccatgactgccactcacttgaagggactgaagagccagtgccgggacaaatattccatggaatagccttcaacccagtctgcatccagctttttcacacccgcaatgaagtacacaatgaagatctgaaaataaaatgtgacacaaagttcaagcaaaaagaatcttttctacagataggcaagaataaaataaggagcatatagttaggacaacttgaatccatgctcctgagttacagtccttgacccaaatattacagtccttgacccaaataatctacttatatatattttttaaatgaataaaataaatactgatctgagtccagggcccaaggaagaatagaccccatcttctattcattcatctcagaaattcgcctcatccaaacagcatttattgacatccaaccaatgtcagcgacagtatcaggcaccaaggaagaagtcataaagcacagactgaatcctttctctttgtcatgaggattccaatctagcagggacaaagctctagtctttccttgacaaataagataattcagagattaagggattggaaaaaatgagaagccagcctagctttccagcaaagggtaaaaactaaaaacagaagatccagggaggcagcggagagtgtagtctggcagtgggatggccatgctgaccacatggctgtcaaggagctcctccctctgtcctaaaatgctgtacctggccacggagcactgcatagttccaaaggggcacgtgggcattcctcctatgggcattcagcagaccgtccacagacctacaccgagggaggtaaacattgaggggggagctgcttaatgcagctacatctccatccttccttttatacacgataatcctatctatcctgggcacatctcccatatcctccctggttattctgagaccttttagaattatatgagcaaattctaacatgattatacaagtcatagaagaaatattgctactaagttataacagcaaaaagttcagtatttcttgttagctcccagttgagtttgttctaatggatcaaatcaggaaaaaaggactacaatactagaaaattactgaaaaaggggaggaatttgatggagtgtttgaaaagctatgtatgtgtaaataaatatgcggtgtattatctttaaaaaaaaatgaaaaccctcaacagcagagtaacacacaacataaactaacatttcatagacctgggtgccaggatccagtataagagggttcctgctaacagcttgtattctggaagagaactgattagacccaggctactaacaccagatgtactctggggaagcagaagcaaagcaagttttcaagaagtagaagctgggaaaggggcagcttacactgtggtcaagagcactggactctgcagtcatgaacacctggactcacttctgtttcttaactgctagctgaccttaggcaaattcttcactcgtcaataatacttagcttctttatctttaaaatgtgaacaggccaggctcagtagttcatacctataataccaacattttgggaagctaaagcgagagaatctctggagcccaggagtttgaggttgcagtgagctatgactgcaccactgcattctggcctcagtgacagagcaagaccctgactccaaaaaacataaaatgtgaacagcaccatcgaccttacagggttttaatgaggaaaaactctaaatatttagtatagtgcctgcgatgtggaaaaccctgaataaatgataagtgattttttcaaaatgcataaagtcataaaaatggaacttctgactagcctgagcaacatagtgagatcccatctctacaaaaaattttaaaaattagctgagtgtggtggcacacacctgttgttccagctactcaggaggctgagatggaaggatcacctaaacacaagaaggttgaggctgcagtgagctatgatcacgccactgcactctagcctgggcgacacagtgagatgccatctcaacaaatatccccacaacggaacttttcagagatattctatcaaaactgcctcttaattctctatgatcagagctggccattctgaatgagtttcaagttttaccaaaggggttttgtatgtgtgtattaacaaataggccggacacagtggctcatgcctgtaatcccagcactttgggaggccgaggtgggaggactgcttgagcccagaagttcaagaccagcctgggcaacaaagcgagaccccatctctatttaaaaataaataaataaaaagaaaaataaataaaacttaatgactgttaatgaattcaatgtttgagtttttttccccatactcatgttattgacacctattttattacttttcactcaacatataaagaatccttaaggtcaactgccccaccaccttatctccaaatcccttctccacctccccttagagacagtcacctaagccagaaatggggaagggttacctcctccgagaacagcaatgctgagcagccctggtgggccctcttctcctgacatgatctctgcctcacagcaacttctacttttggctctaactctgcccttctggactcacacagagaaagtctgctccctcttctacataaccacccttaaagtatctgaaaacagccatgtctggctttagtattctgtttttctctctaagagggttacaagaggtgaataaatcaaggcacctggggagatagggaaagactgaaggggtgggatggagccattttgctttgtgtcatcccaagcgctccaactagttggccctttcccctcccaaatccacctagatcaaagtgaccttgtaaccatactttgcaaacatgactgaaaaattccagaacctcactgggcccctatctctgataaccatcctgacccagccaacccctcccctttgtcccccctgactcataccagtagtggtttgcatccatgaatgttagctgaaaggccaacaacccatacagataggagtggttgttccatgatgtcttgtccaggagaaacacataccagtatggcagcaggaataacacacagcttatccggtagcacaggcccagcatcatgcccagtgcccctgggatttgtagggagaggattaagaggtcaagagatcaccacaggcccagtttccctggaccaggatatggttggaattaagaaaaatcaagcattgtataatcacataaaactaaatgaaaattaaatgttattttaatattttaaaaagaattatgggatcacagcttaagtgacacacaggtcaacagcatgaaattgatcacagcagaagtgaaataaggtgccaaagactttgaccattcaccagcatgcttctatttctgtgtttctggcaggccagtcaatatttcccacagttcccctcacccagaaacatgatggtgtagacaagatacatccagtcaagtggcagtgggcgtagggcatccagcaaggggaagcggcacacatccagcccatcaaggtatttccggtccagagagctgagcccccgctcctggggaatgtctagcaccatcaagaaccctaagaaggcaataggggagttggtcattgggcctcagctaaggaagcagtagaatacagtggaacacagttgacagtgtgcagctccagggtcagacttcttttctaatcttggctctgccatttattcagtattaattattgagtgcctactctgcacagtactacatctgttgtgccatctagaacagcccctgcagctcggttaaccaattccccatttgtgagaaggggaatacatcacaggactacagagaggattaaattacagaaatgcacaaaatgctataaaaactgttagggtcttgacagctataaagatccatcctattgagcttcagaaagtgctctgggaggccaggcacggtggctcacgcctgtaatcccagcactttaggaggctgaggtgggcagatcacctgaggttgggagttcgaaaccagcctgaccaacatggaaaaaccccgtctctacttaaaatacaaaaaaattagccaggtgtggtggcgcatgcctgtaatcccagctactcgggaagctgaagcaggagaatcacttgaacctgggaggcggaggttgcagtgagccgagatcacaccattgcactccagcctgggcaacaagatcgaaactccgtctcaaaaaaagaaagaaagaaagaaagaaagtgctctgggagtgcttctcaaccttttctgcttcctggcacactccaaaaacagttgcatttcgtcaacaccctgggaataaacagaagaggctactcagatcaggaagccagcttgagataaagcagggtttctcaacttcaggactagtcacattttgggctggttaattatttattgaggggattatccaatgcactacaggacatttaggagcactccctgacctctatagagatgccagcagccacctattcttcctcccccaagttgtgacaactaaaaatgtctctaaacattgccaaatgtctcccagggagcaaaactccctccagttgagaactactgggctaaggggactaatatctctgcacatctgtaaaccattccaagcacaccatgctgcggcctcagttaagaagctcttgattagggagtcacagccaaaaggtatggtccctgtggccccctgctctgtttctctgagtcttctgggcaacttcatgccacaagcaaaatgggtcactgctgcctcgcctctacatatcatatagcatttctagctgggtacggtggctcacacctgtaatcccagcactttgggaggccgaggcaggcggatcacctgaggtcaggagtttgagaccagcctggccaacatggtgaaaccccgtctctactaaaaacacacatacaaaaaaaataaaaaattagccgggtgtggtggtgggcgcctgtaatcccagctactcgggagactgagggaggagaatcgctttaacccgggtggcggaggttacagtgagccgagatagcgccattgcactccagcttgggcaacaagagcgaaagtccgtctaaggaaaaaaaaaaaagcatttctggccaccaagtaaatcctaactgtaggagacaaagcaggtttaatcctaaacttcgcaaagacctcttcttttataccaatgtcttcagctctgaggaaaagggagctaagtctacttgcaaccaaaaaatagagattgtcattctccactctcaaccaaattgctcccacccataaactggactcaccaaaaagaaaacgaaagacagctaagcttgcagggtccgttggtcgattcagcagggtcaccagcctccgccaactggacaaatctgtccactcaaaacccaagagtttccctattcggctgtcctgcctgggccctgagatcagttcagccttgtctttctgtactttatctgcaatcaataaatggagaaaatatgtgtgcgggggtgggctccacctcaaatcaaagaaatcactgcaccaacagctcagagcttccgcccacccgggtcggctcaatgaggttgcctcaatgatctgactataggaaacatccctgcagtgcagccccctctccacgatcccctaatgtcccagaacccctcagactacagtcccctaaccgcagtgttcccgaatgtcatcatcattcagaagccgcaggctgcaaatgtctcacagcacgcccccttccccacagaggaccccccccccgcctcaccgggagacactgggcgtcctcccgcccccgcccctctgagaccagcgctcctaggaactctccgccggagggcggggtcctaagcctacctgagctgggcgaggtccgcgcggacccggcagacaccgccattgctctgcggaggaggcaggtgggtcacagctgccgcgtctgaacggaggccgccaggagaatttgcttccctaggctccgcctcccgacgcgtcagcggctgtgcggccggccgcaaagcgccagcactgtcgtaaatactacccacgaccggcggcgccggattccttgcttggcggcagggggcggaacaaggagccttggagcggggcaaaggtaccccttagtgccgttgatctccaggggcattgttagactcgcctgttatgccttccgagggggcctctgctttttaaacactgaaaagagtctgagttccccaacttccttgggtcctccccgaccccattagtcctctccgtccctgcgtccctgcggtgctctctggtgtgagggatcgggcgcaaagggcaaactttttgtcagagtgacgccgagttgaggacgcgcctggaaatgttgcctgggttttgagccattgcacgaccccttcactttcttttccaggacctgcaaagaaccgaggtttcaaagcagtaggggccgggcactgctctcgcttgtaatcccaacagtttggaaggccaatgcgggaggatcgataaagaaaaaaaaaaaaggcaacaacaaaaaaagaaaaaacactaaaaaaaaagttagctgtgtgtcgtggcgcgctcctgtggtttcagctactcgggaggctgaggtgggaggttcgcttgagcccagtagttcgaggctgcagggagctgtgatcgcaccactgcactccagcctgggggacacagtgagaccccgtctcaaaaaaaaaaaaaaaaaaaaacaagccgggtgcggcagcaagcctgtaatcccagcactttgagaggccaaggcgggcggatcacttgaagtcaggagttaaagaccagcctggccaacatggtgaaaccccgtctgtactaaaaatacaaaaataatccgggcatggtggcgtgcgcctgtaatcccagctactcgggaggctgaggcaggagaatcgcttgaacctaggaggcggaggttgcagtgagccaagatcgcgctactgcactccagcctgggcgacagagtgagactccgtctcaaaaaacaaaaaacgaaaaagaaagagaaagaaaagaaaaggcgggaagaaaagaaagaaagaaaattaaaagcagccagggaaacaggaacaacataactgaagaggggatacagagcaagggcagtgagtagagtgtggcccatcagggaaggttctcagaggtgagtctggagcagaattaaatacctaaatctctccactgggattagccagcaggaaaagaagaaggcatcccagagaagcggttctcaaacagttgggtcttgggaaccatttacagtgttagaaattatagaagaccctaaaagctttgtttatgtggattatatctttcaatatttgccgtattagaaatttttttggccgggcgcggtggctcacgcctgtaatcccagcactttgggaggacgaggcgagtggatcacgaggtcaggagatcgagaccatcctggctaacacggtgaaaccccgtctctactaaaaatacaaaaaattatccgggcgtggtggcaggcgcctgcagtcccagctactcgagaggctgaggcaggagaatggcgtgaacccaggaggtagagcttgcagtgagccgagatcgcaccactgccctccagcctgggcgacagagcaagacgccgtcctgaaaaaaaaaatttttttttttgaggccaggcgcggtggctcacgcctgtaattccagcactttgggaggccgaggcggttggatcacttaaggtcagcaatttgaaatcagcctcgccaacatggtaaaaccccgtctctactaaaaatacaaaaaaaatgagccgggtgtggtggcaggcgtctataatcccagctactcagaaggctgagacaggagaatcacttgtacccgggaggtggaggttgcagtgatccaagatcgaaccactgcactccagcctgggtgacagagtaagactctgtctcaaaaaaaaaaaaaaaaaaaaaaggccgggcacggtggctcacacctgtaatcccagcactttgggaggctgaggcaggtggatcacaaagtcaggagttcgagaccagcttgaccaatacggtgaaaccccgtctttactaaaaatacaaaaattagccgggtgtggtggcacgtgcctgtaatcccacctactggggaggctgaggcaggagaatcggttgaacccgggaggcagaggttgcagtgatcccagattgcgccactgtactccagccagggtgaaagagcaagactccatctcaaaaaaaaaaaaaagctttctaacttctactacaaaggaaaaaaaatggcatgtttctgtagtctcagctattcccagcttttctggaggctgaagcaagacaatcactttagttcaggagtttaagactagccggggcaacataatgggatccatctcaaggaaaaaaaaaaaaagctatcaagccattagaaaacatggaggaaccttaaattcatattgctaagcgaaagaaatcaatgtggaaagactacaaactatgattccatccatatgacatatatatatgtatttttttgagtcaaggtcttgctatgttgcccaagatggtcttaaacttctggtctcaagcaatcctcctgctcagccttccaaagtgctgggattacaggcatgaggcagtgcgtttggccccaactgtatgatattctgaaaaggctaaactatggagataataaaaagatcagtgactgccagggaagtggagttggggggaggaagggatggtaggtggagcacaggggagttttacagaagtgaaactattttgtatgatgtaatagtgtcatggtggatacatgtcatacttgtgtgtggaaaagagtaaagcctaatgtaacttatggacttagttaattataatgtatcaatatggactatgtttttttgtttgtttgttttttgagacggagtttcccccttgttgcccaggctggagtgcaatgatgcgatctcggctcactgcaacctctgcctcccagtttcaagcgattctcctgcctcagcctcctgagtagctgggattacaggcacccgcttccacgcccagctaattttttgtatttttagtagagatgggttttcactatgttgaccaggctggtcttgaactcctgacctcaggcgatccacccgcctcggcctcccaaagtgctgagattacaggcatgagccaccgcgcccggctgggctatgttaataatataccaatactggctcatcagttgtaacaaatgtaccacactaatgcaaaaagttaataataggaaaaatggggagcctgaagggggatatgggaactctcggtactttcttcttcttctttttttttttttcttttcttttttttgagacagagtctccctctgtcgcctaggctggaggggcagtgtcacaatcttgactcactgcagccttgtccttctgggctcaagtgatccttcaacctcagcctcccaagtagctggactacaggcgtgcaccactgtgcctggctaattttttttattttttgtagagacggggtttcaccatcttgcccagcctggtctcaaactcctgagctcaagtgatcctccctccttggcctccgacagtgctgggattaaaggcttgagccattactcccagcctggaattctctgtactttctgctcagtttttctgtaaggctaaaattgtccccccagaatagtctgttaattaattaattaatttatttatttattttgagatggagtctcgctgtgtcgccaggctggagtgcagtggcacaatcgtggctcactgcaacctccgcttcccatgttcaagtaattctgcttcagcctcctgagtagctgggactacaggcgcgcaccaccatgcccagctaatttttgtatttttagtagagacggggtttcaccatgttggtcaggatggtcttgagctcttgacctcgtgatccgcctgcctcagcctcccaaagtgctgggattacaggcctgagccacctcgcccggcctagtctgttaatttaaaaacaaccatagactgggcacagtggctcatgcctgtaatcccagcactttgggaggctgaggagggaggattatttgagctcaggaattcgagaccagcctgtgcaacatggtgaaaccccatctctacaaaaaattacaaaaaatacaaaaattagccaggcgcagtggcacacgcctggagtcccagctacttaggaggctgaggtgggaggaccgcttgagcccaggaggttgaggctgcagtgagctgtcactgtgccactgcactccagcctgggcaacagagcaagaccctgtctcaaagaaagaaagagagagagagaaagagaaagaaagaaaagaaaaaaataggctgtaattgacttactgcttgtattcttcttcatcaaagaatgcaattggacactatttgcttttttgggtgtgtgcatcaaagggatacttgaaagtgaaaagaatgagagaaagtattttaaaaccatatctgatgagggtctagtatccagaatatgtaaagaactcctgcaactcaacaatgaaaaagacaacccaaataaaaataggcagaggggctgggcacagtggctcacgcccataatcccaaaactttgggaggccaaggtgggaggatcgcttgaggtcaggagtttgagaccagcctggatgacatggtgaaaccccatctctacaaaaaaatacaaaaaagtagccgggtgaggtgtccacccctagctaattttttgtacagatctggtttctccatgttgcccaggttggtctcgaactcctgatctcaagcaatcctcctgccctggcctcccaaaatgtttggattatgggcgtgagccactgcaccaggccaaaggttagtttaattgcacaagtgctttttcttgacaaaccatgagacaactattatatgcagaagtgctatatgcatatttcccatttcttcacacaaaatattaaaaagacatgtactgtagggtcaagatttaatacaattaataatttgtactgcttcatcagggatactcattttttttttttttttttgagaccgagtctcactatgtcgccccactagagtgcagtggcacgatcttggctcactgcaacctgactccctggttcaagcgattctcctgcctcagcctcctgagtagctgggattacaggcacgcacccaccatgcccagctaatttttgtgtttttagtagagaaggggtttctctatgttggtcaggctggtctcgaactcgtgacctcaggtgatccacccgtgttggcctcccaaagtgctgggattacaggtgtgagccaccacacccagcttcatcaaggacgttcttaatagaaagtggcatttttaaaaattgcaagtgcatggcattgaggaatgcaatggctactactacaatttggtgccatggtcttcattcctgcttagttgccagcacttttacccaccattgcttttgcatcatcagtacaaatgctagctgttaaaaaggtaaatatctcagtattactacagtaattttgtctttgaagaccccaggagtttctaggccatccaccgagaactattgtcctaaaggaaaagaatggcagaggtagacatataaaagggactattggtaccagatggatttctagcaggaggaatcaccaggcaaactgtgttcctgctattgaggatatagctcatttctaggttattctaacaggcaaggcaggtcaagtcacttttttttttttttgagaccaagtctcactctgtcacccaggctggagtgcagtggtgcaatctcagctcactgcaacctctgtctcccgggttcaagtgattctcctgcctcagcctcccaagtagctgggattacaggcgcctgccaccacgcctgtctaaattttgtatttttaatagagatggggtttcaccatattggccaggctggtctcaaactgctgacctcaagtgatccacccgccttggccacccaaagtgctgggattacaggtgtgagccaccatgcccagacccatctttctttctttttagagacagggtctcactatgttgcccaggctggagtacagtggctattcacaggtgtgatcccactactgatcagcgtgggagttttgacctgctctgtttcctacctgggccggttcaccactccttaggcaacctggtggttccttgctcccgggaggtcaccataataatgttgaacttagtgcagatacccgatgggcatagcacactatagcccagaactcctaggctctagtgatcctcctgcctcagcctcccaagtagctgagactacaggcacctgccaccacacctggcttttttttttttttttttttttgagacaggttctcactctgtcacccaggctgagtggcatgatcacagctcactgcagccttgacatcctgggttcaagcgatctcctcgcctcagcctcctgaggagctaggactaggcgtgcacccccatacccagctaatttcttatattttggagaggcagggtctcactatgttgcccaagctggtctcaaactcttgaacacaagtgatcctcccaccttggcctcccaaagtgctgggattataggcatgagtcattgctcccagtctgagatgtatttcttaatccactgtcaaatactggcccaaacaaattcagtttggcttaggaaatttgtatccactcgtctaggactgctcaatattaatgcttccagtaaattcagcatttatggtctgttatgtgctaaggactgaacaagttacagagagggggaaatgactcaattgtagcctctgtcttctaggagttaaatggtaaggaaacatgataataataaaataatttagaaataataggatagtaataacagtaatagaatgtagaaagtcataaatactattaaatgagtgcaatggaagcattgaggaagaaatgaattacactagagaaatcaggaaagctttttttgagacagggtctcccggtctcacttgggctttgaaggatgagtgcagttttaaaaggagagagggaaatcacgttcttttcaaacttttttttaatttaaaaaatattttggccagacccggtggctcacacctgtaatcccagcagttcaggaggccaaggcaggtggatcatctgaggtcaggagttcaagaccagcctggccaacatggtgaaacgccatctctactaaaaatacaaaaattagccaggtatggttgtgcatgcctgtaattccagttacttggaaggctgaggcaggagaactgcttaaacccaggaggtggaggttgcattgagctgagatcgtgccactgccctgcagcctgggtgatagagtgagactccatctctaaaataaaataagataaaataaaaaaaaaataaaatcggccaggcgcagtggctcacgcctgcaatctcagcactttgggaggttgaggctggcagatcatgaggtcaagagattgagaccatcctggccaacataatgaaacccagtctctactaaaaaaatacaaaaattagctgggcgtggtggcaggcacttgtagttccagctactcgggaggctgaggctgaagaatcacttaaaccctggaggcggaggttgcagtgagccaagatcgcgccactgcactccagcctggcgacagaacgagactctgtttcaaaaataaaataaaataaaataataaatattttgtacagatggggtctcattatgttggccagactcatctggaactcctggcctcaaggcatcctcctgccttggcctcccaaagtgatgtgattacaggcattagccgccttgcccagctggagatcaaaagttcttaatagtcttgggtgaacaagagtattctgtataggaaacatacagctaatagctgggcgcagtggctcacgcctgtaatcccagcatttagggaggccgaggtgggtggatcacgaggtcaggagtttaagaccagcctggccaagatggtgaaaccccgtctctaccaaaaatacaaaaatcagccaggcgtggtggcgggcgcctgtaatcccagctacttgggaggctgaggtagagaattgcttgaacctgggaggtggaggttgcagggagccgagattgtgccactgcactccagcctgggcaacagagtgagactccgtctcaaaaaacaaaacaaaaaaaaaaaagaaaagaaaagaaaagaaaaatacagctaataaatgagcttgctaactcagtatctccaggttttcctttcaggaccaatatacaaagatttgtgatatttagcattcatttatccataaaataggtcaaactttaggaaagaaatttctctataaatcttttccaacaaaaatcatctttctctgtactgtggagaaagcagctttctttcagacttctcagttcaatatctgaaacctttagtgagttgcctacatgtctaggacatatgtcatatactacaaagggtaccaaagtgaggactcagtccctgcctgcctttataggacttaagagtgttggaggggtcaaatatgtatgacaaagtatgtgaaagattctttaaaagaaataaaatgtgatggagatcagaacaggaacaagttagcttcagtggggaaatctctaaagcttcatggaggctatgtcttaaatgtgaatagaattgtcataagcagtgatgagtgaaggccttagggaaagatatagaaggtggatggtgtacgacgtttgagaaaggacatgtaatttggttgactggagggctgggaggtgaatctaatgggagagaagttcagaaaagcaggttgagaacagtcttggaatgccatgctaagaagtttgggctttatcctggaggcagggtggagcatacaatatgtgtttctggaagatagcaatcaaccacagaggggtagatgggaaaagaaaggtgaatttagaggggattggaattgtccagggaagagatcgtgctgctggcattaaccaggaggcaggagctggtggaccaaggaggtggtggatatgagaggcacgaccaagaatgaaccaattgcctgatttttgtgcccttgtaaaaaatttttttaaaaaagtatgaactaaggcttggtgacgaccttgcatgtgaaggatgctttgtggttcctagcttgagaagcgggtagaatgggagtcccacccaggaggaggaacatggagaaaagataaagggtttggtttgggtgttggaggtgtctgtgaactgtccagggcattggagaggcagcattggtagttgagggagaggcccgggctggagataataaatttggggatttttcataaatggctattgaagccgtagaggcactgcacttccctatagggagaccagggttttctcagcctcaaaacaattgccattttggtccagattctttcttgtgagagggtgtcctttgcattgtaggatattttagcaacatccttggcctcaacccaccagatactagtagcacccctacccccagctataacaaccaaaaatgtctccagacattgtgaaaagacccctgaaaggtaaaataacccctctgagaaacactgctctaaaacagagtggttctcttcagaagtcggaagaaagattgccaacgggccgggcatggtggctcatgcctgtaatcacagcactttgggaggccgaggcgggcgaattgcaaggtcaggagatcaagaccatcctggctaacacggtgaaaccctgtctctactaaaaatacaaaaaattagttgggcgtg

SEQ ID NO: 1257 - DNA, 21636 bp, Homo sapiens
gggtctcatctttgcggtccctaacacagtggttctcaaccttgtttacatgatagaatcacctgggaaagttttcaaactactcttgcctggaccacattccaggctaattatatcagaatctcagggagtgagggctcacgaatgcatcgtttagaaaacaccctaggcatctcaaatttgcagcggaaattgccgtccacaccaagttgatgagctgaaaggtagactaacagtaggtaaatcaaagagtttaaagcagatggtctttaaggtctttttatattctaaaatgtgcaaagtcaggtagtatctttctaattctcaaccagcagtggttgagtggattctcctatacccgaggggagctgggtggacagtctctggcgtgtggctccccctgcagttcagttatatgttatgaccaccccactttagaaccctcttagccacccaagtaggcgctggacattgtcattccactgtcacgtgcattcaacaaatacttattaagatggctcacatttccttttaaaacacgcaagccgagagataattataattgtgctcattccatcgacttctaaagactgagatttctaaataattttaaggccaaatgaaggacattgcaggaatattgattccagctttgtgcaagaaatagttttctgcaatgagagtggtttattagaatgaagagccttgtgaaagggattcccttggttctagtgctacacacttgtaattggaatactgactgtaatggacgctgtaggataagattcccaaagtagaagaaactagactgacttatgaggcccttctaactccaaaatgccgtaattttaaattccaatagtagaagaacaacgtaagatgcaggaatgtcttctgagctgagaaatgcagcagctctagagttctgattagttcagctttgaaccacttcccaaggactgagttattaactgcaaaatagccaaaaatgaacacaagtgggtctcgttatcaaaaaaattcattatggcacataagaatcagaacttctaaagaagattaattagggggttgattatttgcattgtaaaataattcctgacttcatgaaatcatttttggatactagagttcctgtgagcatcttagtatagatttaggtcaccagtcacttagccaaggtgcttgggagagtaaactcttaactaaccaccgctctttagtgcttatttggaaataataaacatctcagatgtttattattattataaaacatccaaaaattcaatgcagaaataactacaatttcttcagtactataatatgtcaaaaataccattgcatttaatcctcacataatccttgtaaagcaatatattattatctcagcttggtcaagtaatttattcagcgacactaaattgcatacagcccaaatctttctgattctttcccttacaccaaattaccccaatcaacatctcttagaacaaaattgctcacagacagcttggagaccatgtgtgtttgggttaatttttgcccttaaaagattttcagtatgtgttgccattatttaaatattagatttcccgtaacagtctggatgtcctggctgtctcaaagaatcagaaggtctggaagccgtgtccctgcagtcctgatggtgacaggcgggctgggtcccacctcagcaggggcttgagttctgcagattgtgctggttcccacccttctgtgttgcatcccctgaagggaagcgagtgtcatctgggatttatcccctgccatccagccctcattgcttacgttgttatctacctggcacctgttggcactgcatttacaacccgcaaataaaatctctcttccacttcccttgccctaattcagattccaaatgctctggttccatatgtctcaaactcatttttgcattgttctcatttcccgagagtagttgggcttaaggaatattcatcttaaaattcttccgaacacaagtaattctatgccattgtttcctcacctgttggggagtttttgcctctgcacttaatagcccatcttgttttcatttcttcccgctcctggggggctaggtttggtgttgctggtgatggtgggggaggaagaaatgccttcaagtcatctctgggatgaccaatgagctatgaccagcaagctgggaccactgagctggtggaatggccttagtgagtaatagacagcagtgatatgtcagcctttttctggcccaggaacagccaaacctcttatatttcagtggcctagttcccaatagaccctgaaggccctccaggtcgtcttcccacctaccccttgctccataccaccaccttccaccccataatattatagaaggacacctagtcagatgaaacaatacaacttaattttattaagacaaggctggtgggcactggagtggcaccttcagggccaggagaggcactggggaggggtcacaggatgccacgcgggcccctagaagccacagctgccctccacagagcggcactgcaccatgcgcaggaatgtctcgaccttgtccatgtccttcctgaagcagtggagcagcccgtagttcttgagcagtgcgtcatggttgtgcgagtttgtgtcaaacttgctgtaggtctgcttgagggtctgcccagtcaggtggctgccgtcttccagcctctgcaaagtgaagcaagagaaggagagaccaagcgcttgggcactgttccctccctctctcatttatccattttcctccttccccttcagggtgtagagaaaggcctggaggattcacgaggggaaatgaagaataaggtgagttctcttgggtcagcgcctgactgctgaaaagagggcagcagtgtttctctcccccagccctcgaagccagtgggcttccaggattggggacccctggtgccaccctcacccccatcagcatttggatgccttcctctaggtcctttaggaggtgatagtcatcgctgtccgaggtgtcatacaccaggttgttggtgaaggtactcctgaggaaccgcacgggctccagccgcgactcgatgagcagcagggagatgtggagcagctctaagttctgcaggggaaggaccggcagtggctgtgctgcccgggggctctgaccacaggtctcccccatccccgcctaggggagacagcatccactcacggatttctgctgcgtttcctccatgttggaggatgtcggaatagagtctgagaagcagaaggaggtctgggagtcatgcaggaatgaatacttctgttcctttgtgatataggcttcttcctaggggaaggaccccccaccaagaaggaccactgctttctatgctggagaccagctcccactgttactcttctgggaacctggctcagcctatgctcatctgcctgcattttcgcttcagaaaacaaccctgagctccttagtctcctcccattacttccccagtgggggaaagtcaccccttcttgccacccctgacccgcacccattccccaagagcttataaactcctggtaggtgtcaatggccagctggtgtgcgcgatgggcttggagcatagcctctttaaaaagcctggataagggaacggtttggacggcaccagcctcttgaagccagggcaggcagagcagggcaaaagccaggagcagggacgtccgggagcctggggagaaaccggagggcaagaagggagccgcagagcaagaggccagcactctccctgttccaggagctgttttctttttctctctctccatccctccagggaccaggaacattcagagattggccaaatatctggccttagatggcgatattcacattcagaagccccaaacctgaggttagtgcccccgtcccatctgcagggcgccgcctctcccctcaggacacgttgtgcccaaagggattttaggggcgcttacctgcagccattgccgctaggtgagctgtccacaggaccctgagtggtgcggggagtcgggccttgggatgctggagctggtctcttgtgggccctttttataccctggccccttctctctcgctgttgcccccacctgtttctgtgcacatttatgcatggggccactgacgggcttgtgctaatggataatttggaagctcctcccacacatgctggcatcatgtcccctggcttgtcatctttcccttcccaccgtcaccagcgttgtgagggttgtgcacagagtgtcaaccacagacaccacccaacttgtcctctctttaaggttcaggtgggtgccctctggcagcaggccatggtggccaacctgaatgcggagaaggatgtcaggatagccagtccttgagacccctatcgaccacatcccactctctatcctattcctttcctcctccccgcatgtttaacctccacccaccagacagaatgtgtgtgttgggaaaaggggccaagcacagccaatagattgtgggggttgtgagcatgattcagtcctgaattccacttctgctgacgactcctgggcccacctgagtcagctggatgcagtgctaacactgaccactagagggaaccaaccccacactttgatctcccctttccctgagccttggggcggggcggagggagggggttgggtggggggctcccccaggtcactggggacgaagaactcagactctcaaggtattgccccagctccctggacctgcagcagagacacaaaccaagaaaccgaaatcccgggaacagacacggaccacaagcgcttcctcccatagccctgaaaccatcagagaatctcaaagttggaagagctcttgaagatttgaatctcttccccagctttggaactcaaaacacatcacgccgaaagatgccctatccatccatggaagcccgtcctcttttttctcctcctcctttccacacctgtatagagcctatccagttgcgaagggcctgcctgtgcattctcacgtctgacctgccacttgtcttgtgtaggaggtatgattatcatcccatttcacatatcaggagactgaggctcagagagactgattgcatgagctacctcagccagggcagcagatctccacagccttgctcttcccactttgtgtcatttaaagtcctttctccaggccgggcacggtggctcatgcctgtaatcccagcactttgggaggctgaggtgggtggatcacttgaggtcaggagttcaaggccagactagccaacatggcaaaacaccaactctctagaaatacaaaagtagctgtgtgtggtggcgcaagcctgtaatcccagttactccggagggtgaggtggtagaatcacttgaatccaggaggcagaggttgctgtgagccaagatcgcgccactgcactccagcctgggcgacagagtgtgactccatttcaacaaccacaacaacaagaaaaaagtcctttctccagaacaggtagtgtggtgttactcagttatttagttattttagtttctttctttctttctttctttctttctttctttctttctttctttctttctttctttctttctttctttctttctctttctttctttttctttttctttccttcctcctttccttttctttctttctttctttctctttctttctttctttctttccttcctctttgtctctctctctctctttctttcttttttttcagttggagtctcattctgtcacccaggctggagtgcagtggcatgatgttgcctcacagcaacctccacctcctgggttcaagtgattctcctgcctcaccctgtttagtagctgggattacagtcgcccgccaccacgccaggctaaattttgtacttttttagtagagacggggtttcactatgttggccaggctggtctcgaactcttgactttaggggatccaccctccctggcctctctaagtacttagattactggcgtgagtcaccgcccccaacccagttatttcagcttctaaatccctctgagtgcagggatcctgcccccaacacaggggccctttgcctcattttgtctttccataaggggcagattgttctttctcaattcccaggtgagaatggcccagtggcatggggtgccttgtggaaacctcacagcaggacaaggctgaggcggagaaggccaggactgagcctcctgtctcctggtgcccagggttggggctatttccataccatctggaagtcacaagcatcagatgcccccagggataagagcaggaaagaccaccctctccagtggtgaaatcttcccccaccctgagtttaagagcatgtagcacttgacactgtagaaacacaagcaagcaaacaagcaaatgcttctagaagtgattggctgtggtgttggcaaccaacattgaacacccacacccctgtggcctaggatgtgaatgctggggccctgccatctccctactttcagaggggaagacagagctcctttttctgccgtcactcctgaagcattaccggaccagcaccccagactcatcacctgctgggagggcactgtgctgtgagctgttctccaggcaggcctgtgtgaggatccaagaggggtgtcatcgatgataccagctccgaaaaatatggggccaagggagggtggagtcaccactttcccctgctccttccagcaccagcaaagaggaggagccaggtgcgaatggaagagggtccctgagctccaagtagaagaaggtccctgcctcccccaccatccttcctccaatgtcagctgggacagggagcccccatgacagggccttttagccagtgctggggacttagatgtggattttcggccatggaagaagtctccagcctcctttaggaatgagggtggcaggggccctagttggggaccactgcataactccgcaggtgggcacaggggtggcgaggctccccagacaggttactgccaggaacacgtgggaccagccagggcaggggagtgtctcctctcacctctccacttctgttgaccccagaattatggtgactcagaggactctagggacccctggggaaacacctttataaggggttaccatggcagccatggaccagagggaagaactgaggccctcaggtgtgggtagaagtcgatgatcgttttctctagtctagatcttcccagagccttgagcaatggagaccatgtctatcattcattgctggtaaaaaatcaactttgcattagacttgggattctcctaacagtactgggaagttgcccactgttggggcatcacttgggtccagatccttggctcctgcaggctgagagactactcagggagagcctccacatggccagtggggagaggctgggcttcgcgcctctggcgtcagcttcaaaaggctcagaataggccgggcgcagtggctcatgcctgtaatcccaccactttgggaggccagggtgggtggatcatgaggtcaggagttcaagaccaacctggtcaagatggtgaaatcccgtctctactagaaatagaaaaattagctgcgcatggtggtaggtgcctgtaatcccagctactcaggtggctgtggcagggaattgcttgaacccgggaggtggaggttgtagcgagctgagatcatgccactgcactcctgcctgggcaacagagcgagactctgtatcaagaaaaacaaaaaaaaactctacgtaatctcacaatcatcttggttcttttaaagaacctgcctttataatttaggatccatgaatttctctgtgtgtttggaagcccttcctatgtccaacctcgactaactctagggttctgtgtgcctgctgtggaaagtcacagatctgctgttgatcctaaagtggtgtctttcaggcttcaagatctcctgttaggttcaagactgtggggttgaggacgatcacatttttcgaagccattctcaccggtcttagggatcgcctccaagggactggtgggtgctccttccactctcactttggtgatttgaggcgcacacttctcacctgcagctctgttctttcttccttgagatcagaggctggttattgtactgggacatactctacctccttttggcttctaatgtcctttccatgagtttgctaccgagtcaattacttggctcattggattgaggtcttcagagaatattatatggggattcccaagggctctcctaggggaggtgaggaagatgatcaatacttctgcgtgtccaccatgtgcttggcactctactgaccatagggatgtgagtgaggatactgaggctcaaagagatgaggtggcttgcctggagctctcccagtttctaagtgatggcttccaaggcccccgggctttccttccatgccaagctctttagaagtctcatctagtaaaggtggtggcactactaggcatggacagaacttgcctcagtgcaaagctagcaggacaggggtgaggtccctacacaggatgttcaatgaagatggggggaattgaacacaaggaacttcagccacagaatgaggtgtccataggcattaaggaaagtggtagaaaagaagcacccagcgtagctcgggttagtgaaccgaggcacttcatgctgcatatttgtattgcacgtttcagtgtacatcgtgtttcacttcctatatctcgttggacacttcagtttgccatatgatatgtccagggggttcaggcacggaggaagggcctcggaagacctcggggggagaggggcaggcactgctgtgtattgatggggggattgtttgcactggttgatgatctctgaacaaccaagaagtacacaaggatctacctaactggacgtgctaagtaatttcactttggggattattctccagggagacgatccattgatagagaagtgaaaagcatcgagatgtgtctagtagttgtaggaagtctggggtgctttcctgatggggtgccctcagctggaaatagcccctccttcctttgacctgtcctgtggctatttgcagacattttattcctcttaccagactgtaagctctttgaggctggatttctgccttttgtctattcattcattcactcattcttctattcatgcattcaccaattccacaagtagttgttgcctgtaacatgtgccagagattgtaccaggcagatgggcatatctagataagcaaaagacatgatcctttctcttctggagctaacaatctactgggggcagagataatagcaaacaagtaaatatataatggttaaatagaaatttcgaatttggaacattctcatgaggaaaacagctaagatatggagggagagaagaagccagaaggtgacgggacgaggcagctggcacagccctaggcccaggaattcaacaggcatctactgagtggacccaacgcatgagaggacagtgccaagcaagcaactcaaatgtcccaccggttgggcatggccaggtagcctatgctgtgtctggacgtcctcctgctggtatagttattttaaaatcagaaggacagggaagggagcagtggttcacgcctgtaatcccagcaatttgggaggccaaggtgggtagatcacctgagattaggagttggagaccagcctggccaatatggtgaaaccccgtctctaccaaaaaaacaaaaattagctgagcctggtcatgcatgcctggaatcccaacaactcgggaggctgaggcaggagaatcgcttgaacccaggaggcggagattgcagtgagccaagattgtgccactgcactccagcttggttcccaatagaccccgcaggccctacaggttgtcttcccaacttgccccttgctccataccacccccctccaccccataatattatagaaggacacctagtcagacaaaatgatgcaacttaattttattaggacaaggctggtgggcactggagtggcaacttccagggccaggagaggcactggggaggggtcacagggatgccacccgggcagctagaagccacagctgccctccacagagcggcactgcacgatgcgcaggaatgtctcgaccttgtccatgtccttcctgaagcagtagagcagcccgtagttcttgagtagtgcgtcatcgttgtgtgagtttgtgtcgaacttgctgtaggtctgcttgaagatctgcccagtccgggggctgccatcttccagcctctgcaaagtgaaggaagagaaggagaggccaagcgcttgggtactgttccctccctttctcattcattcattttcctccctccccttcagggtgtagagaaaggcctggaggattcacgaggggaaatgaagaataaggtgagttctcttgggtcagggcctgactgctaaaaagagggcagcagtgtttctctaacacagctctcaaagtcagtggggctccaggattggggacccctggcgccaccctcacccccatcagcgtttggatgccttcctctaggtcctttaggaggtcatagacgttgctgtcagaggcgccgtacaccaggctgttggcgaagacactcctgaggaactgcacgggctccagccacgactggatgagcagcagggagatgcggagcagctctaggttctgcaggggaaggacgggcattggctgtgctgcccgggggctctgactacaggtctcccccatccccgcctggggagaaggcatccactcacggatttctgttgtgtttcctccctgttggagggtgtcggaatagactctgagaaacagagggaggtctgggggttctgcaggaatgaatacttctgttcctttgggatataggcttcttcctaggagaaggaccgcccaccaaggtctacgctggagaccagctcccattgttacttttctgggaacctcactcagcgtgtgctcatctgcctgcattttcgcttcgggaaaaaccctgagctccttagtctcctcctcttatttcccagcgggggaaagtcaccccttcctgccacccctgatgcgcacccattccccaagagcttacaaactcctggtaggtgtcaaaggccagctggtgcagacgatgggcgcggagcatagcgttgtcaaaaagcctggataagggaatggttgggaaggcactgccctcttgaagccagggcaggcagagcaggccaaaagccaggagcagggacgtccgggagcctggggagaaaccagagggcaacagagggagccggagagcaagaggccagcactctccctgctccaggagctgtttgtttttctctctccatccctccagggaccaggagctttctgagattggccaaatactgggcttacatggcgatactcacattcagaagccccaaacctgagggttagtgcccccgtcccatctacaggtcgctgcctctcccctcaggacacattgtgcccaaagggattttaggggcgcttacctgtagccattgcagctaggtgagctgtccacaggaccctgagtggttcggggagttgggccttgggatccttgagctggtctcttgtgggccctttttataccctggccccttctctcccactgttgaccccacctgtttctgtgtacatttatgcatggggccactgacgggcttgtgctaatggataatttagaagctcctcccacacatgctgggatcatgccccctggcttgtcatctttcccttcccaccgtcaccagtgttgtgagggttgtgcacagagtgtcagccagagataccacccaacttgtcctctctttaagggtcacgtgggtgccctctggccgcaggccatggtggccaacctgcacgcggcgaaggatgtcaggatagccagtccttgagaccccctaccgaccacatcccattctctatcctatccctttcctcctccccgcatgtttaacctccacccaccagacagaatgtgtgtgttgggaaaaggggccaagcacagccaatagattgtgggggttgtgagcacgattcagtcctgaattccacttctgctgaggactcctgggtcagcctgagtcagctggatgcagttccaacactgaccactagagagaaccaaccccacactttgctctcccctttccctgagcattgctggggctcccccaggtccctggggacgaagaacccagactcaaggtattgccccagctccttggacttgcagcagagacacaaaccaagaaacagaaatcccgggagcagacacggaccacaagctcttcctcccatagccctgaaaccatcagagaatctcaaagttagaagagctcttgaagatttgagtctcttcctcagctttggaactcagaacacatcacgccgaaagatgctctatcaggctgggcgcggtggctcatgcctgtaatcccagcactttgggaggccgaggcgggcggatcacgaggtcagtagatcaagaccatcttggctaaccaggtgaaatccactctgtactaaaaatgcaaaaaagttagctgggcgtagtggcgggcgcctgtattcccagctactcgggaggctgaggcaggagaatggcgtgaatccgggaggcagagcttgcagtgagcggagatcgtgctgctgcactccaaccttggcaacagagcaagactccacctcaaaaaaaaaaaaaaaaaaaaaaagaaaaagaaaaagaaagatgccctgtccagccatggaagcccctcctcttttttctcctcctccttttcagatctgtatagagcttttccagttgccgagggcctgcctgtgcattctcacatctgacctgccacttgtcttgtgaaggaggtattattttcttccgatttcacagatcaagagactgtggctcagagagactgattgcatgagctacctcagccagggcagcagatctccacaaccttgctcttcctacattgcgtcatttaaagtcctttctccaggccggacacagtggctcacgcttgtaatccccaaactttgggtggctttgaggtgggtggatcacttgaggtcaggagttcaaggccagactagccaacatggcaaaactccatctctactaaaagtacaaaaattagctgggcgtggtggcatgagcctgtaatcccaactactcgggaggctgaggcgggagaatcacttgaacccaggaggcagaggttgccgtgagccaagattgcgccactgcactccagcctgtgcagcagagcagaactccatctcaaaaaacaaaaaataataatattaaatttttttttctccagagcaggtagtgtgatgctactgagttatttagttattttagcttcttccatgttcctccaatctcaactggggcagggagcccccatgacagggcctttttgctagtgccggggacttagatgtggattttcggccatggaagaagtctccagcctcccttaggaatgagggtggcaggggccctagttggggaccactgcataactctgcaggtggacacaggggtggcgaggctccccagacaggttactgccatgaacacgtgggaccagccagggcaggggagtgtctcctcttacctctccatttctgttgacccagaattatggtgactcagaggactctagggacccctggggaaacacctttacaaggggttactgtggtaaccatggaccagagggaagaactgaggcccacaggtgtgggtagaagtcggtgatcgttttctctagtctagatcttcccagagccttgagcaatggagaccatgtctatcattcattgctagtaaaaaatcaactttgaattagacttgggattctcctaacagtactgggaagtcgcccactgttggggcatcacttgaggccagatccctggttgctgcaggctggagcctctccccacatggccagtggggagaggctgggcttctcacctctggtgtcagcctcaaaaggctcaggaaaagttgggcacacgcctgtaatcccaccacttagggaggccaaggtgggtggatcatgagatcaggagttcaagaccagcctggccaagatggtgaaatcccgtctctgctaaaaatacaaaaattagccaggtgtggtggcaggcgcctgtaatcccagctattcaggaggccgaggcagggaattgcttgaacccgcgaggtggaggttgcagttagccaagatcacgccactgcactccagcctgggcgacagagcgagactctgcatccaaaaaaaaaaaaaaaaaaaagctcaggataaatctcagaatcatcttggttcttttaaagaacctccctttataatttaggatccatgaatttctctgtgtgtttggaagcccttcctatgtccaacctcgactaactctagggttctgtgtgcctgctgtggaaagtcacagatctgctgttgatcctaaagtggtgtctttcaggcttcaagatctcctgttaggttcaagactgtggggttgaggacgatcacatttttcgaagccattctcaccggtcttagggatcgcctccaagggactggtgggtgctccttccactctcactttggtgatttgaggcgcacacttctcacctgcagctctgttctttcttccttgagatcagaggctggttattgtactgggacatactctacctccttttggcttctaatgtcctttccatgagtttgctaccgagtcaattacttggctcattggattgaggtcttcagagaatattatatggggattcccaagggctctcctaggggaggtgaggaagatgatcaatacttctgcgtgtccactatgtgcttggcactctactgaccatggggatgtgagtgaggatactgaggcccaaagagataaggtggcttgcctggagctctcccagttcctaagtgatggcttctaaggccccccaggctttccttccatgccaagctctttagaaacctcatctagtaaagatggtggcactactaggcatggacaaaacttgcctcagtgcaaagctagcaggacaggggtcaagtccctgcacagaggatgttcaatgaagatggggggaattgaacacaaggaacttcagccacagaatgaggtgtccataggcattaaggaaagtggtagaaaagaagcacccagcatagctcgggttagtgaaccgaggcacttcatgctgcatatttgtattgcacgtttcagtgtacatcgtgtttcacttcctgtatctcgttggacccttcagtttgccacatgatatgtccagggggttcaggcacggaggaagggcctcggaaggcttggggaggagaggggcagacactgctgtgtattgatggggggattgtttgcactggttgatgatctctgaacaaccaagaagtacacaaggatctacctaacttgacgtgctaagtaatttcacattggggattattctccagggagacgatccattgatagagaagtgaaaagcatcgagatgtgtctagtagttgtaggaagtctggggtgctttcctgatggggtgccctcagctggaaatagcctctccttcctttgacctgtcctgtggctatttgcagacattttattcctcttaccagactgtaagctctttgaggctggatttcttttttttttttttttgagaccgagtcttgctctgtcgcccaggctggagtgcagtggcgcgatcttggctcactgcaagctccgcccccctgggttcatgccattctcctgcctcaggctccctagtagctcggactacaggagcctaccgccatgcccggctaatgttttgtatttttagtagagacggggtttcactgtgttagccaggttggtctccatctcttgatcttgtgatccacccgcctcggcctcccaaagtgctgggattacaggtgtgagccacccacgcccggcctgaggctggatttctgcctttcgtctattcattcattcactcattcttctattcatgcattcaccgattctacaagtagttgttgcctataacatgggccagagactgtaccaggccgatggacatatctagataaaccaaagacatgatcctttctcttctggagctaacaatctactgggggggcagagaaaacattttaccattacgtaatgtatatatataaaatggtaaaaaaaattacataatgtgtatatatatataaaattgtaatatatatatacatatattattttttttgatggagttttgctcttgttacccaggctggagtgcaatggcacaatctcagctcactgaaacctccacttcctgggtttaagcgattctcctgcctcagcctcccgagtagctgggattacaggcatgtgccaccatgcccgattaattttgtatttttagtagagatggggtttcaccatggtcatcaggctggcctcgaactcctgacctcaggtgatccacccgccttggcctaccaaaatgctgggattacaggcatgagccaccgcgcccggccaggtatatatatatatgttggtaatataatggtataatagaaatttctaattggggacattcccatgaagaaattgctaagatatggagggagagaataagccaggaggtgaagggacgaggcagctgccacagccccaggcccaggaattcaataagcatctactgagtggacccaacgcatgagaggacagtgccaagcaaagaactcaaatgtccaaccagctgggcatggccaggtagcccatgctgtgtctggacgtcctcctgctggtataattattttaaaatgacaaggacagggaagggcgcagtggcttacatctgtgatcccagcaatttgggaggccgaggcgggcggatcacctgaggtcaggagttggagaccagcctggccaatatggtgaaaccccgtctctactaaaaatacaaaaattagcggagcctggtagtgggcgcttgtaatcccagctacttgagaggctgaggcaggagaatcgcttgaacccaggaggtggagggtgcagtgagccaagatcgtgccattgcactctagcctgggcaacaagaacaaaactctgtctcaaaaaaaaaataataataaataaaataacaaggacaggaacttgattgtcaaatgcaaaaggtgacaaggcagagtgcccaagttcccaggaatgttctatacggactcattaacttacacgaagttctgccttcccctcctgccacatggggaaagtggtattaggtctggaggggggatgccttttttaaaaaattgaaaattatattaggatcagtctaagtgtgttttaacaaactacactctgatttaagtcaggagataatgctcattaatttttgtcctctgcagtcacctgtttccaagtaaagtcttttgggtgggagaggcaggtgtcccaagtggaagatttgtggttgtttgcagctgagtcaatggcaggaccagaagatgacatacaaggagcagcttgtagacctgagacacactcaggaatgtcacagatgtgggctctgaacccacttcttgaggtgatccaaagagagcagacagagatcccaaataccatgttccgagatggcttttgttgttgttattgttgagacagagtctcactctgtcgcctagtctggaatgcagtggcatgatctcggatctcagctcactgcaacctccccttcctaggttcaagtgattctcctgcttcagcctccccagtagctgggattacaggcatgtgccaccatgcctagctaatttcatttcatttgagacggagttttgctcttgttgcccaggctggagtgcaatggcgtgatctcagctcaccgcaacctccaccaggttcaaaagattctcttgcctcagcctcccaagtagctaggattacaggcatgcgccaccatgcttggctaattttgtacttttagtacagatggggtttctccatgttggtcaggctggtctggaactcccaacctcagatgatctgcccgcctcagcctcccaaagtgctgggattacaggtgtgagccaccgcactgggcctaaattttttatttttagtagagatggggtttcaccacgttggccaggctggtcttgaactcctgacatcatgtgatccacctgcctcagcctcccaaggtgctaggattacaggcatgaaccaccgcacccggccctgagatggctttagaggcccctcagagaaacctcagccagaccagacacctactaagggacccaaatagccaccgttttttgcgttttgttttgtttttctctcgtttccaattctgctggaaaaacacccaaaaccttgggtcagatcaccccaaccctagcagcacctgcagcaagaggggaggaagtcaagctagaatggaggaggaacaagcctgtgcttcaaccagggtccctggggagctggctggattcccccagtgggcagtgaggcatgtgcccaccaggggcctcagagctgtgttctggggagggggcaggcagagggggcagctgtagagctggggtcctggagggatggcacagtggcttcctctcgagggtgctcagaggcctcctactaggccttggcaagaaggggtggggcctttggggcctcaaacctcgtgaatcataggaaaagcaaatcccccttcaaaacacaaacgtttgaagatagccaaagttgtccctggattccctcctccttcggttcagggtcttattgctgcaatgcccttcaagaggggcggccgtgatgtagtggggagaaggctggacttggagccagaaggtctaggtgtgattttggccagttatggtaatttccctgggccttgatttccttgtttgtaaaaatcaggtagtgcaaccttcttccagggacatcaggcagagtgtaaatgaagatggaggtgttcaatccagttttcttgcatttaagaggtgctcaatacgtatttgttgggcccaataaaagcttttggttcatattctctgttctgattgtggtggtggtgatacaaatctatacatttgctaaaattctgtacacccaaaggacacaaactcaatttttttttttttttgagatggagttttgcccagtcacctgggctggagtgcagtgacacaatttctgctcactgcaacttctgcctcccaagttcgagcaattctcctgcctcagcctcccaaatagctgggattacaggcaccaaccaccatgcctggctaatatttttatatttttggtagggacggggtttcactatgttggccaggctcgtctcgaactcctgacctcaggtgatccacccgcctcggcctcccaagtgctgggattacaggcatgagccaatgcgcctggccctcaattttattgtgataattttttacaaaacaatgtccagtccaaattctttccctcggatggggtttaggattcccatttcgcagatgaagcaacctgagatgtttcttgtccccaccatcagtacccagctatattaccattgcctatggcagttctggggagacagacatgatgtcccccagagtgtaagcccttaaaacagaaaaacagaccggggagggctcctacattataacccatgaagtcaagccctttgggggtgtctggtggaggggccaaggtctatgctcaaatgattctctgttaacaagaacttcgggctgggcgcggtggctcatgcctgtaatcccagcactttgggaggccaaggcggatggatcacttgaggtcaggagtttgagaccagcctggccaacgtggtgaaaccccatctctactaaaaatacaaaaattagccaagcatggtggtgtacgcctgtaatcccagatactttggaggctgaggcaggagaattgcttgaactcaggagacggaggttgcagtgagcggagatggtgccactgcactccagcctgggcaacagagtgagactctgtctgcaaataaataaataagtaaataaatagataaataaaacaagaacttcaaagtctcagggaaactgagttgttcagaggtgttaaaaagtctttaggtaaagccaaggcctcccccaacccagggcagcctcaagcaggtggagaccctgcttgggggagaagtgaagcctcctcccaccatctacccggctgcctaggtccctggtggaggtaggaggacggaattagtgccactatgcaaagcagcaggaaaggaagggctccggctcagtagaggctgatgccaaaacaacctggttccctccagcagcccagagactggggaaaacacaggggccgcctggcttggcccagcctggcccagggtggtggagagatttacctgaaactgcaggcgtgggggccttacccacctgccccacctggaattccagagggaatctggtgaaaattggcactgttctcactagttcccctgtgctggtcttgattccccagttaaactggcagctcccacagcataggtgctcccttgctggaattcagagcaggaatagcagaggggcctcgaaggattccctccagggtcaacaggaagtggagcacagcctggcttgggagggaggctttgcacgtgcaggttgattgcacttggtctcccagctggcagctgttcccagtacctcccacagctggtgagctggagggccctagggaccattgtttgaggaccctggggccataggggacctccgatatgaggctgggaaagtctgaaggggtcccctggctaagaaccccaaagcttcaccatacaaagctccactcttcaggatctcactcttgatggctttgcatcaagctttcctaggcttcctgggaggtgggggtgggagtgttgtagaggcagggaaacccctaccctcagggagcttccagtttgcctggagaaccaaggccagtgtgagtagcacaaggcagtagctaagtcgccgctgcataggctggtctgagcagggcttgggcgaggacccaggtgctttgggagggcttcctgtaggtggaggcagagtgggactcaattgccgcttttcggctgaatgaagtgcaagatgagggtgtccctgctgaggggaaggacaggcccagtcactggccagctgctctgggtccagctagggcctggcatgcagccccgttccagggagaagaaacggggatgcgaccacaggctccaactgggtcttcggagaggaggggtggctgttacctttcccacaccctcgagggctcacagatgccacattcaaacaacagaagtgcccacatagatgttcctatccaccccaaacccataagatgccacgagcctgtgtgtggtttctcaggacacaccgtttattccacgggggaaggcactggaggccagggcctccctggggtgggagtggttgcgggagaggaatgatgttcctg

SEQ ID NO: 1258 - DNA, 25643 bp, Homo sapiens
actaagaacgagtaagatgtttgagttggtaatagaaagtctttcatcaaaaaaagcccaggaccagatggcttcacagctgaattctagcaaacatataaaaaactaatactgtattagtccattcatgttgctattaaggaatacctaagactgggtaatttatgaagaaaagtggtttatttggctcacagttctacagtctgtacagaaagcacaatgtcagcatctgtttctggtagggtctcaggaagcttacaatcatggtagaaggcaaaggggagtcagcacgtcacatggcgagagagggagcaagcaagatgccaggtccttttaaacaatctgctcttgtgtggactcacacagcaagaattcactcatcaccaaggagatagcactaagccaccctattcatgagacatctgccttcatgaaccaacatctcccactgggcaccacctccaacaccagggatcacattttaaggtgagattttggaggagacaaacatccaaaccatatcaaataacaattctttttaaactcttccaaaaaaaattgaagtaaagggaacacttccatacccattttacaagccagcattaccctcatactaaagccagacaaggacagtacaagaaaagaaaattgtaggccaatatccctgataaacataggtgtaaaaaccctcaacaaaaaactataaacttaattcaacagcacactaaaaagatcatttaccgtaagcaagtgtgatttatcccagggatgcaaggatggttcaacatatgcaaatcagtaaacataatacaccacattaacaaaatgaaggacaaaaaccatatgatcatctcaatagaagtagaaatcatttgacaaaattcaatattcttcacgataaaaactctcaacaggtatggaaggaatataccacaacacaataaaggccatatatgacaagctcacagctaacatcatactcaaggtgaaaagttgaaagcttttcctctgacatcaggaataagaccataatgcccactctcaccactttttttcaacatagtactggaagtcctagccagagcaattagccaagagacagaaataaaggggatcctaacatgaaagggagaagtaaaattgtctctgtggatgatataatcttatatatagaaaactctatagagattccaccaaaaaaattgttagaactgataagcaatatcaataaagttgcaggatacaaaattaatatacgaaaatcactagcattcttgtacaccaacagtgaaccatctgaaaaagaaattaagaaaacaatcccatttatagtagcaacaacaaaaacaaacaaaaaaaacttaggtgtaaatttttaaaaattggttaaatgaggtaaaacatctgtgtactgaaaactgtaaaacactaataaaagaaattgaaaatgacacaaataaatggaaagttgtcccatgaaagaattaatgtcgttaaaatgtccatactacctaaagcgatttacaaattcaatgcaatctctatcaaaattccagtgtcatttttcacagaaatagaaaaaaaaatccctaaatttgtatggaaccattaaaacatacccagatagtaaaacaatcttgagcaaaaagaacaaaactggaggtatcacacttcttgacatcaaaatatactagaaagctatagtaatcaaaagagcataatataaaaacagacacatggaccaacacagcaagattcagagctcagaaataaacacacacatttatagacaattgctttttaaaaaaatttaagaacagggtcttactacattgcctaggctggcctcgaactcctgggctcaagagatcctctcgccttgcctcccatgtagctgagactacagtcatgagccaccatgtgtggctaacttcctttttgcttaaggtgcctagaacaaacaagggagaaaagataagctcttcaaaagatggtgttggaacactggatattcacaagcagaaaaataaaattggattattatcttacaccatatacaaaaatcaatacaaaatatattaaagacttaaatatagggcctgaaactgtaaaactactagaagaaaacatagagaaaaaacctccacaacatcagtctgggcaatgattttttggatatgaccccaaaagcacaggcaacacaagcaaaaatagataaatgggattgcatcaaactaaatagctttcgaacagcaaagaaaacaattaacagagagaagagacaactcacagcgtgggaggaaatacttgcaaaccacacatctgataaggggttaatattcaggctatataaggaactcacacaactcaaaagcaggaaaacaaataacatgatttaaaactgggcaaagaacctgagtagatatttctcaaaagaagacacacaaatggccaacagatatgtataaaataaatatggtcgggtgtggtggctcacacctgtaatcccagcactttgggaggccgaggcgggcggatcacgggatcaagagatagaggccatcctggccaggatggtgaaaccccatctctactaaaaatatgaaaattagctgggcatggtggcatgtgcctgcagtcccagctactcaggaggctgaggcaggagaattgcttgaatccaggaggcggaggttgcagtgagctgagatcgcaccactgcactccagcctggcgaaagagcaagactctgtctcaaagaaataaaaataacaataaaaataaataaataaatgctcaacatcattgattattagagaaatgcaaattaaaaccacaatgagacagtacctcacattgttagaatagctattatcaaaaagatgaaaaacaagtgttggcgcggatgtggagaagaggggacccttgtacactattggtgggaatgtcaattagtacagctgttatagaaaacagcatggaggtgttttgagagccccagccaaactggggttccaataccagagtggctagcaacactgcccctaacaggaaataaaggggaactggatagggatgtttaccatgtcctttcacaggatactttttttaaccagggggtggactaatgcctagttttcagcctggattcaggggatccgtcacacagaacactcttttatactgacagacactcttgtgacccttgtctgacccatgcccagtttatgcctgcctggctatcactctggtgctgggtgcctgaccttgtgttctcctcagcatctcagggaaaacccagcttggggcatctcctagtccttcagaggggaggcacaaattcaatgcaccaccaaaataggagacaagttcagcaatttttgcttacagatattgggcaaggagatgtaatgaatgaagagggcaatcctccatccctgggtcatgacaggcaggaaggaagagttaggcagagagagagaagcccatggcaactagctgtatatatgaggactaggattgggggtactttaaattctctggaaaatacctgaatggcccatttaaaaggaagcagtgggaaaggagagagcccagtcttctaggccggagagatgtctctgaattcttatctctggccaccggcttgagccatttggatgtgacgtagaactagaaaccctgtcaagggtgactgagttctgcttctgttgtgagaaagttaaacttgtattcaaaatcgatgccaaggcaacataaaatagaactcactgcaggaggggaaatgagaagatactgtagaaagagtacaaggtttctattagaaaaaaaaaagggatatgtttttgatatctattgctcagcatggtgactatagttaataataatgtatatttcaaaattgctcagagtaattttcaaatgtctcatcacaaaaaataataagtgaggtggtggatatgttaattagcttgacttatacatttatacctacatcaaaacatcaccttgtaccccataaatttacataattataatttgtcaattaaaaataataattcataacttcacagtatatcatgtcgcaggtggcaaccatgtttatatctaaattcttaaaactgctggatcaaagggtacatctgtaaaacagaagacatcattaaactgccctctgcagacgctgtaccaatttacactcccaccggttaaataaaagaatggttttccatgactccgtaccaacactgagtcatcaaactttatgagttttgtcaactcgatagacaaaagcatatcacagggtagttttaactgacaattatcataagtatacaaagtgtcttcaaatgtttagtatttgcaagccatctatatgtccattttcatgtatgttctcttcatcttcccattttttccactgggcttctgttttttttaatgtattgatttttagctctttctacagtagaataattaaaattagctttttgactatgaaataagcacagatatttttcccagttatgtttttgactcattggattttgccaagcagatttttaaaaatttgatataattaaatgcatcgatcttttaaggtttctgcattggtattacagttagcaaggctatttctattctcagctgttttaaaagtttctccataagttcttgaggcactttattggcttcctctttataacatttagatatttgatccatttagaggtgttccatgtgtaagttgtgaggtatggatctaaatacatttttgggccaggcgcagtggctcacacctgtaatcccagcattttgggggtccaaggcaggcggagcaagaggtcaggagttcgagaccaacctgactaccatggtgaaaccctgtctttactaaaaaatacaaaaattagctgggcatggtggcacacgcctgtaatcccagctactcaggaggctaaggcaggagcatcgcttgaacccaggaggtggaggttgcagtgagccgagatcgtgccactgcactccagactgggtgacagagcgagactcctcacaaaaaaacaaaaacaaacaaacaaacaaaaacaaaaaaaaaaacctctcagttgtcccaatatcatttattgaatagtcaattttttatttatttgaaaaggcaacttaaagcatttccagtatcaattatttaattccaaatgacatgattaaagcgctatttactgagctttcaaatgtagataataccattggctcatctacgaaagatgagaatttggatcgcatacaccacctctcctctgcctcctccaatgtttgataattatatcatgttttgttcctctacttagtgcttttcccacttcaaataacttacttataccactatttcttgtttcaatagctctaatcagtatctagagtaaaattaagtaagcaggaggctattgacctgagacagtctccatgctttgaattcctatgaaacaaaatgcaacctaacttagtatgtaaacaaactgaaacttaacttaggagtttcatttttataacagataaccaggtctttgccaatcacaagcagccaagcttcagctaagtgcaagcagccaacggactggctcatgtctaaatcaagcaaaacacttagctgcaacaaatcaaactatttatgtactttaccttcctgttctgcttataaatactcattgcttacagttgcagagctctcggaacctcttctggttctgagtactgcctgattcaagaatcattctttactcaaataaactccattaaatttaaattgtctgaggtttttcttttaacactaaatacccctctcagcaataggaagatgatagcccatagaagtgaatatatttttctttttgttgtctctactccattttatccacaacagggcccaacctaaaaataataataataacaacagtaatagtatgtggagatagactgtaaggactcagatcaatgttttattattctgtgattcttaaagtaaatatacatgagtccatactgatataaataactgactgaataaataaataaatagaaagaagggacaactctcctgtcaaaagaattccaattaataaatgaaaaaaactaaggaaatagagaatcaccattagaacaccacagtaacaactgctgcaggcaagatccactgatgaataataaaactgatgggtgacagtttagggagcaactggatatttgcatagcctcaaagtatctcccccaaatatttattagttaccatggtagtgttaacgtatatccacaacttctttaatattcttccctccagtggatggacttaatctactcaaccctcactcccaggatgggctgcacttactgactcccttccaaaaactagggtttggatagggaaaaatggtgactttacagtgcagaaattttccagttgctccgccttaaccaggtgaccaaggtaaacaccaccagtgatgagtcatgttgatatccctgtacctcatgacatgattcaagaagggcaccttacctctgtggtaatcttcccaaaagtccacaaccttagtcttactctgaggaaatatcagacaaacccaaatgaagggacatgccacaaaatagctgatcaatactcttcacaagtgtcaaagtcatgaaacactagaaaaggccaagaaactctcatagatatgggaagaataaagagacatgacaacaaaattctgtatgtatgctggactggatcctggaacagaaaaagaacactaatgaaaaaactggtgaaatctgagcaaaacctgcagttcagttaatagtaacgtaccaggctgggcacagtggctcatgccagcactttgggaggctgaggcagggggatcacgagatcaggagttggaaaccagcctgtccaatatggtgaaaccccgtctctactaaaaaatacaaaaaattagctgagcgtggtggcacacgcctgtagtcccagctacttgggagactgaggcagaagaatcgcttgaacctgggagccggaggtcgcagtgagccaagattgcgccactgcactccggcctgggtaacagagtgagactccagctcaaaaaaaaaaaaaaaagtaatgtaccaatgttaatgtattggtttttatcattatcatacttatgtaagattttcacattaggtaaagctggatgaggggtattcagaaaccttgtactatctttacaagtcttctataaatctaaaacatttccaaatataaaaagctttttaaaataagtgattgatctacctttgaaatgaaaccttaaattaccacgctgaattagctcttggacactttaaaattatgattactggagaaaaacaaaaatgtagctgggcatggtggctcatgcctgtaatcccagcagtttgggaggccgaggtgggaggatcacttgagcccaggaattcaagaccagactgggaagcatggtgaaaccccacctcgacaaaaaacaaaaattagctgggtgtggtgacatacacctgtagtccctgctactcaggaggccaaggtgggagaattgcttgagcttggggggcagaggttgcagtgagccaaaattgaaccactgcacttcagtctgagcgagagtgagatcatgtctcaaaaaaaacaaggtgggctgtggtggctcacatttgtaatcccagcactttggaaggccaaaatgggtggatcacctgaggtcaggagttcaagaccaggctggccaacatagtgaaagcccatctctaccaaaaacacacaaaaaattagctgggcgtggtggtgggcacctgtaatcccagctacttgggaggctgaggcagagagaattgcttgaacccaggaggcagaggttgcagtgagctgcaattgtgctactgcactccagcctgggcaacagaacaagactccatctcaaaaaaaaaaaaagtttagtttcagtggttgttgaacaattagtttactctgcaagtaggtaatgataacatcatttttcattccattttgcatgctcttctccatgtaggggtttacctcgtatctctgtattctgatagcctggagttgttttccttattgatacaaatgaaaagtggaatctttatatgttttccaatttattaaattagtaatgttaaaaataattttaacaaagttaaatggaattattttaaaattctgtttctttgcagtaaatgtaatcccaatataagacaatatgactcacatatttgtgaaaacgaatagggccaatcgtttccattatcaccaaaattatctatagtgaggcctctccatcttctaccagtccctcttttttttcactcactcaaaatatatgtatcgatggtcaaatgtgtcccagacattgtgcaaatctctgacaaaggtaacacaagaaaatgtgtactctgagaacttcttattctgccccagtttaggagattcatgcaactgccaagcaacaataataagagctagcagttattggagtacctcattcctcacaactcgtcataaggcaggtgttatcattagatattccccatgtgtatgcaggatgaggaaataggttcagagaggtcaagtggctcacccaaggggcacagctaagtgaaaggcactgcaggcatctcaaactacccccttcccacaagactccactgcagagcaggacagtcaccctgacaccagcccaatgggttcatcttgcccattacccagatggggctaatttatcaagacaagggaattgcaatagagaaagagtttaatacacatagagccagctaaacaggagaccagagttttattattactcaaattagcctcccaaaattcggaggcagaggctaggggactttgtgggtttttttgtttttgtttttgtttttcttttgagagggagtcttgctatgtcacccaggctggagtgcagtggcatgatctcggctcactgcaacctctgcctcccggattcaagcaattctcctgactcagccccccgagtaactgggattacaggcacatgccaccatgcccggctaatttttgcatttttagtagagacagggtttcaccatgtgggccagagtggtcttgaactcctgacctcaagtgatccacccacctcagcctcccaaagtgctgggattacaggcgtgagccaccatgcccgccggctagagttttttaatgatagtttgatgggcaaggggctagagaatgggtgctgctaattggttggggatgcaatcacaggggtgtggaaaaccgtcctcagtgcaccgagttgcatttggatgcgggccacagaggagtcactggtccaggtggagtcatcctgtcattagaaatggaaaagtctgagaaggtatcttcaaaggccagtcttaggttctacaaaagtggttatttacaggaataattggggaagttgcagagcttgtgacctctggaacaatgtctggtaattgttaatgcctacatcttagcagaattcaggcccctctcataatcctaaacttgtggacttttattagttttataaaactggtttagtttggggaagggctattatcatttaaactataaactaaatttctccctatattagctcgtcccatgctcaggaatgaccaagggcagtttggaggttaaaggcacgatggagttggtgagttcagatctgtttcaccttcgtaattttctcactgttaaaatttttgcaaaggcgattgcagcgccccttgtccacacctgcgcgctccccaaggggtccctacccaccccgcccctggctgggggccgtaggctggccctgccccgctgcgccggaggtggacctctaccagggcagtttctctctgaggctgcgcgctaaggcggtgggcggtcccaggcaggcccagaagctgggcagcctctgccgggttccgggaaaaggagctcctgctgccactgctcttccggagcctgcagcatggggcccctgccgcgcaccgtggagctcttctatgacgtgctgtccccctactcctggctgggcttcgaggtgacgctgggaggggtcgcctcggcagtgtctggggagtgagggcggagggaagagtgagcgcagggctccgggacagaggtctcgtgtaactcctggcgccgcccaaggggttaaggcaagcagggagagctccggggctgaaggtcactttgtgcttttaaacggaatagagtcgctggctccaacccgagcctttatatcccgactgcagtttcccacggtggtggaaagaggggcggctccaaacattcagggagaaatgcagaacacggccacctcttagcccaacgatggcagttttggggaaaactggccacaggagcgaagatcctggaatagatttctagtagtgaggagagttttgccaatttcaaaccaaacaatgtagggtgtccgcataacccctgctctgcacttagcgcctcccttccctttccctcggctctttcacttttccatcttgcacactggcaatcgttcttgacctctgcccgcagatcctgtgccggtatcagaatatctggaacatcaacctgcagttgcggcccagcctcataacagggatcatgaaagacagtggtaggaagggagggtcggggcaggggtgatctcagtggcccaagagagccgaccccagcgggtccttatattggcactggcagccagaaagctgccctctgccccgtctctactaaaaatacaaaattagccgggcgtggtagtgcatgcctgtataccacagctactcgggaggctgaggcgggagaatcgcttgaacccaggaggcggaggttgcggtgagctgagatcgcaccattgcactccagcctgggcaacaagagcgaaacaacaagagaaaaaaaaggaagctgccctctgcccaaaacccacgtcgaggtccccaaacctgggacccttaggtcttttctcacttagcgtgcccaaccttctcctggcaggaaacaagcctccaggtctgcttccccgcaaaggactatacatggcaaatgacttaaagctcctgagacaccatctccagattcccatccacttccccaaggatttcttgtctgtgatgcttgaaaaaggtgaagagagtgggatgtagacagggtatccagtgaaaaacacagaagtcggagattgagggattgataggatggaggggctgcgggagactaaagcaagtgaagcctgccttgggaaacctcaggatcagccttgagcgagctgaaggttgccgggcatgaaagggaagaagagcaggcaaataggtcatgggaaccttgggtgagaggctgagggcggaggagctctgggggatgtcagaagcaaggaagagctagtcctccaccaggaaagcagcaagaggagccctgcctctgggtgcctctgccccacaggaagtttgtctgccatgcgtttcctcaccgccgtgaacttggagcatccagagatgctggagaaagcgtcccgggagctgtggatgcgcgtctggtcaagggtgagtgtggggctctgggaatcctctgggaggaccttggatgactttctgaccttccccaggcacgttttcagggtcatgatcctgcccccgcccgggggatctactgtcctcccagtcacacccctctccccgcaccgccttcctgctgtcttctcttcttcccagaatgaagacatcaccgagccgcagagcatcctggcggtgagtgtcctggctccaccccaactgcactcatagagaatctgagaacagttggcgtttgggggtaaagaagacaataggtctcttattgcatggaaaaggttataattactggggaagaaaggatgtctgtgattcagggcacaaactactgaaaagttggaactaaggatcctcaaaaggatatctcaaggttgaaaggggaagtgcaaaagggacaatatatgggaagaatttatttgctgaaagatgtcagtgagagaaagatgctcagtgttggaacccctggatggggagggatatagtattcacaagtctccacaaactccaacacaaacctcaccaacacatccagagtggaaggcaggagacttgttccaagaggctttaaaaagacgaaaagagataactaatgccagggttatataggagcctgagtgagaacaaatggaaatagctcaaaacattgaccagtgagccatggatgggggtataaaagtaagtttgtcttcaggattaaattaggaaattcaaaacagtattattcctctggtttacaaaaaaaaatagttgagacctattcaaatttaatatataaagtggcaaatcacacaaaagttaaacgtataaggaatggcaaatatatcttctacagtctatactcctgcaaagtacatgtgtaatttttagcttgcttttttacttcatatttaatcattttccatgctttttttttttttttttttttttttgagacacggtctggctctgtcgcccaggctggagtgcagtggtgtgacctcgacccactgtaccctttgcctcctggactcaagcaatcttcccacctcagtctcctgagtagctgggactacaggcacacactaccatgtctggctaacttttttattttttgtagagaaggggtttcactgtgttgcccaggctggtctcaaactcctgtgctcaagagatctgtctgcctccacctcccaaagtgctgtgtttacaggaatgagccactgtgcccagcctccatggaattcttaactctgaaagtatagttctttgtttctatagaggttccactgagtggacttatttttgttttgcttaaccatttttctgtggttaaacattttgtgtaggacataattctctaatttaaccaagtcaaagatagtgtctcattaggacaggctacatgaattcctgggtcccacttctgatctaggaagtcaagttgcagtggttgtcaatcttggctgtgaattaaaatcacctggagcaccttggcgctaaccctttcccctggaattgtgatgtaattgttcttgttcttttttttctttctttcttttttttttttttttttttttttttgagacagtgtcttgctttgtcacccaggctggggtgcagtggcatgatcatggctcactgcagactcaacctcttgggctcaagtgatctcgcatctcagccttacgagtagctgggacttcaagcatgtgccaccatgcctaattttttaaaaattttttgtagagatgggggtttcactttgctgcccaggctggtctcgaactcctgggctgaagcaatctcctgcctcagtctcccaaagtgctagaattacaggcatgagccacagtgcttggatctagttctaagggatgacctcacgtggagattttttaaagctcctcaggagtttcagatgggcagccaaagttaagaaccatctatcccaaactataccaacaaaccacaaactgaagcctttatctttgtcttgaagccaggtaggtggctgcagccatgtgccttgttacaaagttctcaggaagttccactggaattacagcctagctcttgattcaaaaaaagcatgagatacttaggaactgtgagaggtaggaaggaaagagccctggacttgaattctagagacctggattctagtgttggctctgctaccaacatgctctgtaactctgagcaagtaatgtatcacctctggattcaggctcttcatttgtgaaataaagaggtctatctagctgctctctaagatgtccgctggtgttaatttctgtgattgactctgtgccatctaccttttctccttttccacccatctcaagatttgggataaaggaaatagttcctcttggcaaggacagatctccacttgtgggtgggtaagggcattgccagcaaaacttgggggcagaaaataaaaagaccagagttttcctctgagatccccatccaatatcatgcagacacagttgtattccctactatattcccttaggctgcagagaaggctggtatgtctgcagaacaagcccagggacttctggaaaagatcgcaacgccaaaggtgaagaaccagctcaaggagaccactgaggcagcctgcagatacggagtgagcagctctttatgtgtgttcccagcacccatcctgaagatggagacttgagaatctctaagtttgagtccttatgctcctgtacaaaagccccctttccaagtgttctcctcagtgctcttaaacaaccctcatcttcttccttcttttccttgggctcagggaaaggaagggaaggagatgcacagtgagagaaaagagagcatcttagaaacaggaaggcacctggggccacagagcctcttagacctctttgcttctgtgaactcagaaaagtactgactcaaaggtttcaacccctgcctaatacctgctcctttgccttcctccttgcattgtaactgctttctccaggcctttgggctgcccatcaccgtggcccatgtggatggccaaacccacatgttatttggctctgaccggatggagctgctggcgcacctgctgggtaagtaagttaaagaatcaaccctgagccaggtgcagtggctcacgcctgtaatcccagcactttggtaggctgaggcgagcagagcacgagttcaggagattaagaccatcctggccaacatggtgaaaccccgtctctactaaaaatataaaaattagctgggactacagctgcctcagtgggaggctgaggcaggagaatcacttgaacctgggaggcggaggttgcagtgagccgagatcgcgccactgcactccagcctgggtgacaaagcaagactccgtctcaaaaaataaaaagattcaaccctgagctgcctttgaccccagctccacacccactatatcagttgaccagaaggaggggctcagagcaaaaaaatattcttggcacttccagtaacaaagcgttatgcagtcagtgctgttcaaggttgagtgggcaggggctgtcttcaaccccataaaagaaaaggaagccttctataccttgaagccaagcaaaagtctttctagaaaacccctgggaccttgtgggaccaactcctgctgccagaacacctgagaacagtgtgcagagtctgttgttttcttcatccaggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcagagagccccaattctgctttcccacaaaataaacctaatgccatcaggcaaaacatttctgtgtctgtatctgccctggtatattctcattcctggggtcacatcctgcctactctaggggtaggtgaaggagagctgtttcagtatttccagccagaccagccatgcagcccaccttgagcagcttgtgcggtggaagaagtgagaatagtcccccgttctctcacacagaaactcccctggtctctctatcagcaacagaaaaccaagccagatggactttgcaactaatcaagtttgggatttactgtcttctgaccaaccacagtgactgagatggggctgggaccagaagcccagtgggagtgaacagccgagggaaccagagtctggctgagcttgtggccagatatttaaactgggtccagccacacctgcaaaaccagggcaaggcagtaccgggaaactggctggagttgctgcggtttggggaagttgcacaccctttcatagatacctcccttaaccctcagtgcagattctgagaaaactccaaggcttctctgcctaacctagtataacccctgttccctactacatacatataacttttccattcccccagtaattgacccaaagtccctgcctctagctgtgcccattgtgcaatgatcagaatcccttgtttcaatagtattttgacttctttaagaatactctgtatttggaagctgaaacctcacttggatccattgttgggaaccaagtacggagccttacatagcccggaggagtttcaggagcaatgccactttcccttccatccctccctctgggtctggctcttcccatagtccattttccccttttatctcccattaatttctgtcttcctctctcaccttttccatgtctctagcatcctccaggatttaaaatcatctttacccaacttatctgtgaagtaatggcaaaagaacatctccaaattaagtactccttttcttcaaaggagtttcatgggatgtacagctagtataaaataaaaatatgggaagatgtccaatcttaaaaaccataagggcaaattaagacaaaactaagctgcccagagcagggtgagtggaaccagttttatgaataaagatgcttgtctcagcactatatgtggatatcaaaaattgtgaacaacttgaacacctatcaggaggagaatactttaatcaattatggcacattcaggagataatgttttacagtcatcaaaaattgtatatgagggccagcacggtggctcacacctgtaatcccagcactttgggaggccaaggcaggcggatcacctgaggtcaggagttcgagaccagactggctaacatggtaaaaccctgtttctactaaaaatacaaaaaagtaaccgggtgtggtggcacgtgcctgtaatcccagctactcgggaggctgaggcaggagaatcgcttgaacccgggaggcagaggttgtggtgagctgagattgcactattgcactccagcttgggcaacaagagcgaaactctgtctcaaaaaaaaattgtatttctgaagaattgttaagaacattggaaattcttgagatataatattgattggaaaaagatgaaactatatggtatgatctcaatatgtcctgatgaataaaaacataatacagaggacattattctgagataaaatacatcaaaatctttccattttatttgtatacttttacaatttttgattttttaaaatgtattctgatacacaaaataataaaaatgaaaaataaaaaatttggccgggcgcagtggctcatgcctgtaatcccagcactttgggagactgaggcaggtggatcacttgaggtcagcagtttgagaccagcctgaccatcatggtgaaaccccatctctactaaaaatacaaaaattaagctgtgtgtgatggtgcacacctgcaatcccaggtactcaggaggcttatgcgggagaatcgcttgaacctgggaggcggaggttgcagtgagccgagatcgggtcactgcactccagcctgggcgacagagtgagattccatctcaaaaaaaaaaaattgtagattcacattgcagtacaactgtgcatcttgcccattgatttctaaatgtattaactacttaaattaatcctgaatcttttcccaggcttaagtgggataatgttttattgtagatgcatatttcctggctctacccagtctttctttgaagactttatcatcctattttctgaatccagtggctgactttaatcttctctggaggaactagataatttctagactaatgcttacactcatgatccagattgtaatttctgaactccttcttccaaatagaatcaaaacaagaaaggggaaagcctctcaaagcaactgtgcgttaataatgaaacactctttttttctaatccaaggagggtttcatactttttcttagtttcttgccctcttcccttctgatcaataattgtaataggaaatttgcaattgtgccaatactcagattcaatactgaactactttcttgcattgtaattcaaattccaaggttaacaactagctgtatgtttccaaaacaatcttattgtatatgtattttcttaggtgaagtttccagaaatgattttttttttttgcagagccaaacacacatggtaatttaaaaaaataatgcacgtatgtggtaaaaacagtaaaagcaaggtatcaagtaaaaagtgaagagtcctccctttctcattcccattcctactctctaattttttatatatccattttgtaagctataatacagagattccatatactcttcacatactttccccagtggtaacctcttgcataactataggacaataacacactataggacaaaaatcaagaaattgacattgatacaatccatcaaccttattcagagttcaccagtttaacacatgcttattgtgtgtctgtatttagttctatataattttatcacatgtatgctgatgaccaccaccacagccaagatacaaaacattttcagtgtaaagatttctcatgctacccttttatagccacagctacctccctccctccctgtacttccctaacccttggcagtcactaatctgatctttatgtcttgtcatttcaaaaatgctacataaatggaatcagatttgattgttttcattcagcacaatccctttgagatctatccaaggttttgacatgtatcgagagtttattcctttttattgctgaatagtattaatattctatagtatggatgtaacatagtgtgtttaaacattcgcctgttgaaggacacttgggttgtttccagtttcaggttcttacaaataaagctactctgtgtgttcatgtacaggtttttattttcatttctctgggtaaatgcttaggaacacaaccactgggtcccatggtaagtccatgcttagttttagaagaaactgtcaaggctgggtgcatgatggctcccatctgtaatcccagcactttgggagaacaaggcagaaggatgacttgagcccaggaattcaagaccagccagggcaacatggcgaaaccccatctccaaaaaaagaaaaaagaaaaagccagacatggtgatgtgtgcctgcagtcccagctaattgggaggctacagtgggaggatcccttgagcctgtgaggcggaggttgaagtcagctatgatcacgccactgcactccagcttgggcaacagagccagaccctgtctcaaaaaaacaaaaacaaacaaaaaaaaggaaagaagaaggaaggaagggaaaggaaagagagagggagggaaggaaggaagggagggagggagggaggaagggaaaagaaaagaaaaaaagagaagaaaagaaactgccatactgttttccagagtagctggtttcacttttccaccagcaacgcatgagtgatccagtttgtccacagcctcaccagcatttagtgttactactgtttcttactttaatcattctgataggtgggtagtgatagctcactgtgatttttaatttgcatctccccaatgactaatgaacatcttttcatgtgctacttgccatctgtacatggtcgtcagtaaaatgtctgttcatgtcttttgcctactttctaactagactcctttgaaaatttctcatattgtttttaacaatagattttaaaagaatttacagagtaagaatacatttttgagacaatggggaaaatgatacggagtgaaaggtgatattaaagaattaatgttaatttcattatgtgataatagctgagtggctgtgcacaaaaaaaaaaaaaacttttcattggttgtaattcattttgaaatatttaggatagggccaggcacgctagctcacacctgtaatcccagcactctgggaggccgacgtagacagatcacgaggtcaagagattgagaccatcctggccaacatggtgaaacctcatttctactaaaaatacaaaagttagctgggcatggtggcacgcacctgtagtcccagctacttgggaggctgaggcaggagaatcgcttgaacccgggaggcggaggttgcagtgagccaagatcgcagcattgcatgcactccagcctggcaacagagcaagactccgtctcaaaaaaaaaaaaaaaaaaaaaaattaggatagaaatcacatgatgctttttaaaatgtggcaggtcagaaggaatagatgaaacaagagtgacaagatgttaattatcgttaaagccgagtgatggatacatggggagttatttatactatattatgtgtattgagatatttccataataaaaatgtttttaacaaagaatgtaaacccacggattgggagaaaatatttttaaaccatacatctgataagaggttaatatccaaaatataaaagaaactcaatagcaagaaaacaaatcacccaactgaaaaatgattacaggacgtgaacagacatttctcaaatgaagacatacaagtggccaacaggtttatgagaaatgttcaacaactaatcatcagggaaatgcaaatcaaaattacaatgagatagcacctcacatcttgttataatgactattattaaaaagctgaacgataactgttagtgacgacgtggagaaaagggttggcaggaataggaattagtacagccattgtgggcaatagtatggaggttcctctaaaagctaaaaagggatctaccatatgatccagcaatcccacttctgagtatatatccaaaagaaatgaaatcagcgtatcaaagagatatcttgctcttattcacgatagccaaaatatgaagtcaacctaagtgtccatcaacaaatgaatggttaggctgggcatggtggctcaggcctgtaaccccaacactttgggaagcctaggtgggtggattgcttgagcccaggagttcgagaccaacctgggcaacatgtcaaaaccccatctctattttattttaattaaattttaaataaataacccaaaatgaatggttaaaaaatgtgatatgtataatacacagtcatgcattgcttaatgatggggatatgttctgagagatgcattattagttaattttgtaattgtgtgaacatcatggagtatacagaacatacacaaacctagaaggtatagcctaccacacaaataggctatgtggtattgcctattgctcctgggctataaacctgtacagcctgttactgcactgagtactgcaggcaattgtaacacaaatcactaggcaatgcgaatttttcagctccattataatcttaagggaccaccatcctatatgtagtctggtggaaatattgttatgtggcgcatgactgtatacacagaaacacacacacacacacacacacacacacacacacacaatggaatattatttagtctttaaaaaggaagaaattctgtcatttgctactacatagaggaatctgaaataaaataagccaggcatggaaagacaaataccgcatgatctcacttacatgtgaaatctaaaaaagttgaacttaacagaagtagagagtagaacagtgattaccagaggctgggggtgcggggtgggcaatggggagatgttgaccaaagagtacaaagtttctattaggaggaatcaattcttaatatatattgtacagtatggtgaccatgattaataatcatgtatcgtatatttcaaaattgctacaagaatagatgttaaatgttctcactatataaaaatgaccagtaaatgaggagatatgttaattagcttgatgtaatattccacaatgtgtgtatatatatatataaaacatcacaccatatcctatacacatatacaattattgtcaatttaaaataaaattttaaatttaaaaaagtattacatcaatgctgtaaaacaagagagacagagaatgtattgagataataattctgtgatattccatgtttcatcctatccccacagttctaaggacacaaagctggtttcatggtcttgaaacctatgcattcacacagggcctcaaaatggtttaatgttctgctgtcattgtcttgaaattcttaataatttctgaatacacagccctgcatattggtttttcataaattatgtggctatagctgaccctgtaagcatacaatatatgctgattaaatgcctctaaaataaaggagcaactcagagatattgtgggtttggttccagaccattacaataaggtgaatatcgctataaagtgagtcacacaactttttggtgcatataaaagttatatttacacaatactaatgtttattaagtgtgcaacagtatgtctaaaaaaagtacatttcttagtttaaaaatatttagttgctaaaaaatgctgatgatcatctgagccttcagtgaatcataatctctttgctagtggagggtcttgcctcagtgtggatggctgctgactgatcagtgtggtggatgctgaaggatgaaatagctgtggcaatttgttcacagggtctcactctgtcacccaggtgggagtgcagtggcctgaacacagctcactgtggcctcgacctcttgggctcaagcaattttcccacttcagcctcccaagtagctgggactacaggtgcttaccaccatgcccagctgatttttgtatttcttgtagagacagagctttacgatgttgcccatgctggtctccaactcttgggctcaagtgatcctcccaccttggcctccgaaagtgctgggactacaggcatgagccaccatgcctggcacaaatgtcttaatggcatctagaaaagtgaatccttttgggaaggttttcaatttactgtgcccagatccatcagaggaatcaccatctatggcagctatagctttacaatatactttaggccaggtgcagtggctcacgcatgtaatcccagcagtttgggaggttgaggcaggtagatcacttgaggtcaggagtttgagaccagcctggccatcatgatgaaaccccgtctctactaaaactacaaaaattagccaggtgttgtggcacgtgcctgtaatcccagctacttaggaggctgaggcagaagaatcacttgaacccaggaggcagaggttgcatgagccgagatcgcaccactgcactccagcctgggcgatagagtgagactctgtctcaaaatatatatatatatatatttatattatatatatatatatatatatatatatagatcatacatattatagatacataaatatatatatactttaaaaaatataggccagttgcagcggctcacacctgtaatcctagcactttgggaggttaaggcaggcagatagatgaagtcaggagtttgagaccagcctggccaacgcggcaaaagctcatctctactaaaaatacaaaaattagaaaattagctgggtgtggtggcaagcacctgtaatcccagctacttgggaggccgaggcatgagaatcgcttgaacccaggaggtggaggttgcagtgggccaaggttgcaccactgcactccagcctgggagacacagtgagactccatctcaaaaaatatatataatagatgggaaaaaaatattcttgcctataggattgactgggaagatatatgagggaactttctgggtgatagtaatgttttgtatcctgataggagtttgaattacacaaatgtatgtatataccaaaactcacggaatgacctacctaaaaatctgtgtttttcactgtaggcaaattttacttcaagggaaaaaaattaactataagcaaatattgaactcattacttctaaaataagttgcaaaataaaatcagaagagtattgacgtctgcaacttactttaaaatgaatcaaaaaataagatgcattgatggatggataaagggatgagtagatagaaaactagtataatgttaatgctaaaatctaggtggtgagtacacaggtgttcactgtaaaattcttatatatatgtgtatatatgtgcgtatagttatatgtatatacatatatacacatatatatacacacatatatacatatatatatatatatttttttttttttttgagacagggtcttactctgtcactcaggctggtgtgcagtggcccagtcttggctcactgcaacctctgctacctgagctcaagcgattctccagccttggcctcccatgtagctgggactataggcgtgagccaccaacacctggctaatttttgtattttttctagagacggggttccaccatgttgcccaggctggtctcgaactcctgagctcaaagcgatctgcccaccttagtctcccaaagtgctgggattacaggcatgagccaccatgcctggccccttttctgtatgcttttagtaattcataacaaaacggtctacacatattgatctacatatgttgataaggcacaatctccaacatatattgttaggtggaaaaagcaaaatataaagcattatctatggtatgctcccaaatgtataaagaaagagagcctgtatatattatgtttgcatatttatggtctctctctggggagggggtacccagaaatagttgggaaagagattgcctcatgggaacgggactgagagactgaggtttggggatataaaaaagacttactctttattataattttttccctgttgaattttatactaaaagtgtagatcattttttaattaactaaaataactatattttagtaatccatatatttaatttttatgtttgtttgtttgttttttgacgaagtctcgctctgttgcccaggctggagtacagtggcacgatctcagctcaatgcaacctctgcctcccgggttcaagtgattctcctgcctcagcctcccaagtagctgggactacaggtgcgtgccaccatgcccagctaatttttgtatttttagtagagacagggtttcactatgttggccaggctggtctcgaactcctgacctcatgatccacctgccttggcctcccaaaatgctgggattacaggcgtgagccaccatgcccggcacatacattaatactttttcagatactgtcttcttcttcttttttttaaagacaggatcttgccttgtcacccaggctggggtgtagtggcacagtcgtagttttctgcaacctcgaactcttgggctcagacaatcctcccccatcagcctcccaaagagctaggattacaggcaggcaacactgcacctggctaattttttaatgtttttttgtgtgtagagacagggtctcactatgttgcccaggctgtcagatactgtctttaattgttatttaattatttcatatgcatctcttatctctctacccatatcagaaaatcctggagaccacagtcaaatatgttacctctcctggatagatgc

SEQ ID NO: 1259 - DNA, 128350 bp, Homo sapiens
tgggcatatacccaaaggattataaatcattctatgataaacacacatgcacatgtatgtttattgtggcactattaacaatagcaaagacttggaaccaacccagatgtccatcaatgatagactagattaagaaaatgtggcacatatacaccatgaaatactatgcagccataaaaaaggatgagttcatgtcctttgcagtgacatgaatgaagctggaaaccatcattctcagcaaactatcacaagatcagaaaaccaaacaccacatattctcactcataagtgggagttgaacaatgagaacacatggacacagggaggggaacatcacacaccagggcctgtcaggcagtggggggctaggggagggataacattaggagaaatacataatgtaggtgacaggttgatgggtgcagcaaaccaccgtggcacatgtatacctatgtaacaaacctgcacgttctgcacatgtatcccagaacttaaagtattaaaaaaaaaagaccatttatgaaaacatgaccttaccaaagaactatataagtcactggagaccaatcctggagtgacagaaatatgtgacctctcagatggagaattcaaaatagctgttgtgaggaaattcaacaaaattcaagatgacatggcaaaggaattcagacttctatcagataaattcaaaaaagaagatgaaataatttttttaaaaattcatgcagaaattttggagctgaaaaattcaattgatatacaaaagaatgcatcttaccagcagaattgatcctgcagaagaaagaattagtaaatttgaaaacactctatttgaaaatatacagtcagaggagacaaaagaagaaaattaaaaacaatgaagcatacctacaggatctagaaaatagcctcaaaagcataaatctaagagttactggccttaaaaaggaaggagagagagagagagagtgggataggggtagaaagtttattcaaagggataacaatagagtatcagtattcaaatacaaggttatggaacaccattcagatttaacccaaagaagactacctcaagacatttaataactgaactctcattcaatgggaaaagtaaagtcctttcaataaaggtgttgggataattgggtatgcaaaaaatgaatttggatacctttcttgtgtcatatacataaaaccccaaaatagattaaagacctaagtataagagctaaaactatgaaactcttagaaagaaacacagtaaatttttgtgacctttgattaggcaatgatttcttaaatatgataaaatatggtaaaagcaacaaaagaaaacatgaataaattggatcttatcaaaatttaaaacttttttgcatcgtagaatactatcaagagtatgaaaagaaaacctacaaaataggagaacatgtttggaaatcatgtatttgttaagggattagtatacagaatatatatatatatatatatatatatatatatatatatatatatactcttacacctcaactataaagagacgaataacccaatctaaaaaaataggcaataaatagctattagttctccaaagtacatacacaaatgaccaacaagttcatcaaaagatgctcatcatctttactcaggaggcaaatacagattaatattacaatgatattagacatggatttgtcatatacagactttattaagttagattccctctatgcctaatttgttgagagtttttatcatgaagagatgttgcattttgtcaaatgccttttctgtgtcttttgagatgatcatatggttttcgtcctttattttgctgatatgatgtaccacatttattgatttgcatttattgaatcatccttccacccctgggataaatcccacttgatcatggtgtattatctttttgatgttttttggattcactttgctgatattttgttgaggatttctgcatctataatcattaaggatattggcctgtagttttctgtttttatgttgtattctagtctgattttggtatcagggtaatgctgttcttgttgagcgtgtcaggaagtccaaaagacttcttctttagtgttttggaatagtttgagaattgttagttttttttttttataagtttggtagaattcagcagtaaagccatccagttctgggcttttctttgttaagagacttaaaacacacacaacgcacacacaaaatgaaatatcactttccacccattataatttacaaagtggaaaataactcgtgttgataagaatgtggaaaccttgaaaccttcatgcattgccagtggtaatgtgaaagaatcttgccattgtggaaaacaatttgtcagttcctcaaacagttcaacatagagttactgtatgaaataattcaactcccaggcatgcacccaagagcattgaaaacataagtacacacaaaaacttgtacaagaacagtcagatcagtattatatataattggcaaaaaatggaaacaatccaaatattcatcaactgctgaatagataaaatgtggcatatccatataattaaatactattcagccacaaaaataataaagtacggatagacactaaaacatggaagaaccttgaaaatattaagctaagtgaaagacataagacacaaaacccaacatttaaaggaaatttccagaattgtcagatccactgaagaagaaacttgagtgtttgccagcatgtgggaggagaggaaaatcagtagttatgaggtttctggaattagtagtgctgatggtgacacaacattgtgaatatactataaaccactaaatgatacctctcaaaatggttaaaacattactgttgtgttatgtgaattttacctcaattagaaaagaaaaaaatcttatcaataacaaagagaaatttccacacaaggtgggatcgcttccacagtgctactcaatgcagtttagcgattgcatttgtattggagtaaaagcatgtcacattgcttttaacattggagtccaatacataaacctctttcaccataactatatggagttcattgtatgtatatttattaaaatggaattaagatgaatttcacaacacaatggatcattttttttttcatgtggaaaatcagaacacatgccttaatggttacatgccccacctgctgctcacctaaaagtaaatttcctctaactcagacaaatatgttattttcaaggaaaagaagcccagagaactgagatccagaagaaataacatgtattgaaagcacacagaagtatttcaatgaactcaaacccaagattgtagaaaactctcatgtgcccctgggactgatgtttgaaaatacacatattttgctcctactctttccttccccagatcccacccttcagagcacccgacgataatggatagtttctagcagggtgtctggaatgggcaagtacccccaaagttatagtttgtactgcaagacttgaacccactctttttctgccctctattattatttttgcattttaaccatttattattttgaaaagaaaagagaatttttagaatatggaaagaggaagtgaattaataaaatagcacaccctacatagagactgctaatccatctccagtctaaagatttagtaataggcaagaatatacatatccaggaatttccttggtgttacataaacaaaggcggcacatatgtatatttttcacaaaatattcactgtttgaagaaggaattactcccttcaattgagttcaggcctgatcaacaagtagtgattggccaacagctaaatgcaaagtgcatgctaagtctggggatacaaagatgaatgagaaaacatttatgcccttaggagaaaaacaaatatctttatctcagagaatagagaaggagattgattctctttgggggagatgtcatcctgaagagtataacaagttcccctataattctacttttcagtactgtttaaaatacaactggatttttttaaatatgtaaaatttatataattttacaaatgtctttgttaagaattaaaactatcattagtaaaggacacagctggaaaattgaaaacattttggttctctactgtggaaacagaatagagtaacagcaaaaagcgtatttctggaattggaccctgacaactctgcttaaacactccaccactttctagctatatgaccttgggtaagttacttaacttctttgtgtgtcagtttcttcatttgtaaaattggaataatagatgctttttttgagacagtgtctcattctgttgcccaggctggagtgcagtggcgtgaccacagctcactgcagcctcaacctcctgagttcaagtgattctccaacttgagcctcccagatagctaggaccacagacacatgccaccatgcctgggtaattttttttttaagtttttcatagaaatagtgtctcactaagttgcccaacctggaaaattggaataataattcataaaatcttcctcctagatttgtgaagatcaattgagttaatgtatgtaacgtacttggcacagagcttggcccatgtaatctctcaatgagtgctaacattacttgtctcacaaaaagttacttacttccgtctggcaccaactccctctctcacttcccacaatctggttaccattcattcttcagttctcagcttaaacaatgtcttttccatatggtttcattgacgccactttgggaaaatagatgtctcttctgcttgcattttcagacctttttaggtgtataccttagggcatttgctttactgaccaaaattatttgccggctactctgtgcttttcatgacacactgaataagacaggaagagtgtttatctatgctcaacataagataggcatataatggaagcttcgtatatatttgttgaataaaaaacataaggggaaaatatcagatctaataatgcaggacaggaggcaagatggaacggagagaaccttgtctgagaagagacataattaaaacagggcatgggaggtaatagaaagattggaggaaaaagagacagagagacagaaatgtttgtggtaatttgtgacaagtagctttgattgttcatggcctaatcttttagggcatgaggttatttcattctctgtagcccaccgagagtgcgtacagtgacacatgttatgtaagtccccttttccctttttataaatgtctagaccccctgtgatttgagacttttctagaagaatttagctgaagaccatattgttttttaaatgtagtatttggagcctagaggtgccagataacttcctgcaaagctaatgcatttattttgggaatatataagctcagtatcatcattaccaacagtgctcagacttgattttattttcattccaacagcaaaggaaagaaagcaacttctttcatgcttccatgccactctgcatctctctaccttcacagagtttctcaataatggcaacatttccagttcaccaatggactgagagatcattgaggctagactagtcttattaatccttataccccagctcctagccgaactcctggacacacaatagatactcagatacatttactgaaatgcatatagaaagttacacctgcaaaaaagatgatctctcaccaggaataagaaaatataatctgggacagcccatatatgagatctctaaacaacctacctataaccaccaagaaaaaaaaatacctgagtttgagatttatttttccgtctcatttttaatatattccagttagtgaaagagctaaaataaatgacaagaaaaatttaatctaggtatttaaacagaattattctgaatgttgtgagctacatttcttttttaccttttatttatacatagtatttgtatatacttatacaatatatttattttgtatatataaatatattgtatttatttatacatgtaaatgtataatatatttatttatacatagtatttatatatacatagtatttgtatatatttatagggtacatgtaatattttgttacacgcatagaatgtgtaatggtcaagccagaatatttagagtatccattaccttaagtatttattatttctctgtgctaggagcatgttaagtcctctcttttagctattttgaaatgtacattgatgttaactatcattaacacagagtaattgatatgtatagcaaataatatttgcagtaggatatcacatgtttacttatttatttatttatttatttttattatactttaagttctagggtacatgtgcacaacgtgcaggtttgttacatatgtatgcatgcgccatgttggtgtgctgcacccattaactcctcatttacattaggtatatctcctaatgctatccctcccccctcccccaccccacgacaggttccagtgtgtgatgttccccttcctgtgtccaggtgttctcattgtttaattcccacctatgagtgagaacatacggtgtttggttttttgtccttgcgatagtttgctgagaatcatggtttccagcttcatccatgtctctgcaaaggacatgaactcatcctttttttggctgcatagtattccatggtgtatatgtgccatattttcttaatccagtctatcattgttggacatttgggttggttccaagtctttgctattgtgaatagtgccgcaataaacatatgtgtgcatgtgtctttatagcagcatgatttataatcctttgtgtatatacccagtaatgggatggctgggtcaaatggtatttctagttctagatccttgaggaattgccacactctcttccacaatgattgaactagtttacactcccaccaacagtgcaaaagtgttcctatttctccacatcctctccagcacctgttgtttcctgactttttaatgatcgccattctaactggagtgaggcactggtctgaaaatatcaattcatttaattcttttaacaaccttaaggggatatcatggtacaaatttagagctttcttttgtgtttgtaaaatggattgattccttttccctacatccagcagaaatatttgaattgaagagaagagtaatacctaagaactagaaattcctttcttatgtttcaaaagatatcaaaagatctaaggaagatattcacatcaaaaatgagtattataatatttattatctatggtgcacttgcaaaaaagaaaacaagtaataatctgaagatttaagtgaatattttatgacattggagtaccacatatttagaagaaagcaccagagaaatcatagatagaaggaaatggaatatttgtaggatcaagataaatacagcttgtcataaaataaagcaggtatcaggataaaatcttgaaaatattttcatttctcgttatttataacttcaatttactgtgatgattaattgtaggtggaagatttacgaagagaagactgaagtatagacaagttgaagtgccacaaaatgaaagctaatgacactgactacttaggaaatagcagactgggtccatatttatagattgtcaatgacaaggaatttgcagatgttaatgaatatagatccgaacttaagttgcaacaacctttcccactttgagatgaatagtgcatggaagagtaaaatgcagatgttaataaatcagaggaagacatcgtgccagagtataaagttgacagatttatgccgatgaacttgaacaaagccacagaaggcctacttgtcaaatttactggtgacaacaggtctggagaaatggctaatgttttggataatagcattagaatttaaggtctgtttaaacttcaaattaacagaatgaaattaatatatgcacatatcaattgggtcttttgcttatatatcatctcttaatagagcctttttgaacaatcatttctaatgtgacctttgggattttctactcatcatcacctcatcctgtttggtttgcattatagcatctatcccttcctaacgttttccctatgtatttgttagtttgtttttttttaatctaactttactagaaagtaaaatgcatggaaacagcaacctgtttaactttgtatcactaagagtggaaaaataaccctcaggaaatatttggtaaaataataaaatgcccattgatgcccttctcttaaaaagaaatttaattagtgcagattggggaaatacaacaatatttctcataaaatgtgatatctatacaataacagaagtactatgtcccaaaaagtattctataaatagaagaaagaacagatggttttgctgctgattaatccatttatctttcgtaaatcatctaatttccccaggaacagcttcctcatctattaaagggggttagtaatagctaagccctcaggggtttaaaaatgcatatgaaataattttataaaccataaagcacaaaacaaatatgaaaaattatgattggaggagggggtggggtagttaactaaatctcagtgtaaaccaccaatgtcttgtgtgtgttgaaaaaataattacatataaaaactggttgcatccaaagaataatgtactttttgcactggcaagactcaaaccatattattgttacttcctcccagttacatattttgcaagatattgacaattgtctaaaggaagaccaaacagatgtaggtgggagctactgtcatttgaacaacattgaaaagaaaaatactaaaaaagaaacatgagggcatataaaggagcgctggggctgtgatgtttattttgaatctgtgaagcattgtcatgtggaagatttattctgtgtagcaccaagatgcaaactaggaattagaggtaaaagtctcaaaaagacaaatcgtggcttgagaccttggtttaatgtaagaaacagttttctcacccttagagcactcccataaggatggaagtagtgaattgtggtggtcacattcaagctagatggggacatgtcagcaatgttatcaggaggcttctactctgaagctgaagttcagacaagatttccaggctcttcccaagtgcaagattgtaattacttaaatgcaatatttttaccatgtttattaagaataaaaggatcatgaattcacattctgacaaatgctagaatacttattattagagacaaaaccagtgcatgagagaatggcaggtgacatcagccctgaatcaatgggaagaaagacccaatgggatgtggtatttaccagagagagcacttctgcttagattgctacatcctacagtgaatgtttaatatcattgagtatattggtggtctgtcatgcttgacaacattaactatgatcatatttatgacacttggcgtccttcaagaatttgtagctctatttcacatgacacttaactatcgcaaatacaaattccagctaaatagacccttcagtttaaaaacagtctcattctcaaattttaaggagaaagtgaagacggagatgtcttaaagactcggcaagtactaagttggcaaatgtcaaatgttaaaataagtttatattaaatgttaaagtgtttgcctggaatgacttttccattgtcctgcttgagaaacacagaggcacctccttattgcttttatatttgctttacaaagacaaatgtatcaacatgctctgtattaattgtatgttgacatttttgtcatatccacagactgatgcatgtctgtgcatggtttataataagtgcacgtaaaaatagagaaaataagtagaaaaagagagagatttaactctcaccccccaccccccaaaaaaacagattaaattagttttcattacttttttttttttcttcagcttcagctctccctcagcgagggaggaggctgtgggctgcggactgagtgctggaatgaggagtaattgagcttcagctgagccggacgtagctttctcctcctggtgtcattgctgcagcctccagtgccgggtccctagttcctcagctgcctatcttcccggtgcaacatcgcctgtaaagacagcaaagccaccgcagaagttgcccggcagaagactccggaggcattggctcagtaacttttcacgtcattttctgctcgggagccccttctagcctctccgcgcagcctttcccaccgcaaatcaccagtgctcatggggcaggcggagaggagcttgcagcattgagcggaaccggacttgagcccgtgatgtccggcaccaaattggaggactcccccccttgtcgcaactggtcatctgcttcggagctgaatgaaactcaagagccctttttaaaccccaccgactatgacgacgaggaattcctgcggtacctgtggagggaatacctgcacccgaaagaatatgagtgggtcctgatcgccgggtacatcatcgtgttcgtcgtggctctcattgggaacgtcctgggtgagtctcctcccgggcagccctcctaggggctatcaccccctctccgccccgggctgagaaggctctaaagagacccctccctcccccgggaagcaaacaaagaggtcgctgctctcggatggggttttctaataaaataataataataatagaaagttttctgattttccgaaccgggaccgagccctggaaaggttattccctgttttgcaggaataacggggaaaccgcgtttctttttcgagcacctagattacaagcgcagggagaggggccgcggcagggatctccaggtggattttgttgagtgtgtgtgtgtgtgggtgggtaggtgggggagtcagtcatccctttgtgtaacgtggctgggtgtttcaggggggttgggacgagacagagcttgcagaatacaaagctacatccctaaggagcaagctctctgtggctgtggaagtcacaaagcatttgtgagctaggtggcattgccctttggcgaggaggtttagtctccagtcaagaggtggtaatgaaccagcagggagtggagacggaggcaaagcagggaagtgcactcactcatagaagctgaattaaacaggatccatgcctggagcaagaaggaggggcatcggagaaaagtaccacagagatctcaatcatccatccatccattcattcttacatccattcagccaaatatttttttttttcagtctgcttgttgccaggctcaggaattattcatgtcaactgtttgttgttgttttgttttgttttgttttctccaaagatgagactaagcttaatgctaggctatttgtcccggtctaggtctgtatgcaaacacgggtttcctcgacccctcatccccctccccctaaacaatttctgagggttggggagggggtgagatggcaacatggtgagtgcgatgatggaatgtattagggcagttggggaatatacctccagaaaaggggctttggaagggagggataacttgaaataaattgtgaatggaaggagagtgtaccttgatgaatgaagagtagaaggctgggagacttttcacatgcagagggcagtgtggaggaagtctctgctgaaaatgacaggagatggaggaggctaggagttgctcttgattttcatttataaaagaagaagaaggtgagtgaggtgagataggctgggaggctttgcagtcaaaagcaaagaacttgtagctgcaatggggactgacaaggaaattatcaggctttcagactaacctgatttttgccttctctcccaagtgtgttggtctgggtagaaatcatcccgagtagtctctcaccaactcagcaggcagaatagatgatagtatgtgaatgacaggagttctccagagtgttggtagaatgttatttgaggagacaagaaacctctgagaactttagtacatttttaaatattatttttagactgttttcctttggttgatttaaaagtaaaaataaaggaaatctttttgggatactaacaaaatgaaacaaaagtggaaatacacaagattaggattcttgttataagcataattctgttgataataatcctaatcttgctttccttcttcttgttacccatccttaggattacatctcttaagacacatggctaccagcatagcaacattttactgcattatgccaacacttattgataagtgaataatcaaaattgaacatatattgagtacctactgtgtgccagagcccttcatgtacattctctcccttaaatatcaaaataacccacattagccagaagaagaaacaagacttagagaaataaaatgacgtattaagggacataatttaaattcagttccattttttctgacctcagatccagaattctccattgttattccactctagagctaaaaagcatatagagaatagattctctgctcctgattgtctgcaagtttattagatgtgttcctgttctcctctgcatcaacgcccactgccaataaagtacaatgagggattaatggcactgtcattctcttcaccaaaaacctttccagagaagcagtaatttttttatgaatagctatcaatagtaactatttgccttccttattttaattttcggctgaatctttgtggtaaaatgtgctcttctttgttgttattgcatttttaccttgcatagaccttgtagtgaatagtctccatatcctaattgcatagtttagggatacatgtttgctagcctggggagttttagtttcaagaaggaaacacctctacagtaaggctacttgtttcataatgtcaaggaagatagcactgtccacagccccaagtgctgaaatggccaattccattcagcctaaaaagaaagatttactcaaagcactctgccttaaagaaactgacagctattttcctcaggactgaataacactgaaatcctctctggttgaactgaaatgcattcttttctgacatactgcctgaaagttgatgaggtttaggtttgacatttaaacaaacgagtagtgtcgttactcacagacaacttcctgctctttgatgtcactgtcaaatttgcaaaatgaattagattgagaattgcttctttgcccctctggtataagtaattttgcacatagagtggtaggacaggatgtcacatgatttatgcaaaataaagatgcaatattaagtatgaaggtaaaataccacagtgtaggcagcagatgtaatcactgagccttcaggtccagtcaccatttgtactttcatataactgcttggaaaatctcaacctttttgggcttacaaatataatgccatcagttagaagtcatcttctccacaatgtcctttcatgaagtgatgtaataggatatgctgtgggtagcataacaaagtcttgattgtcctcatctctttttcttctccccatagtccctctttatcactatgccacctctccactctcatatactcctcccaaagatggaaagcagtttcctgggggagtaaagttttaaatagaatgttatgagtatttacattcaatgaaaagctgtaagcatgtttaatgtgaaattttaagttctaaggaaggagcatagggtaaggttctttttggaaggagtatcttttcagtatcttcagaataatgccacctataacctattcctaactatgtcttctactacagctaagtagatgtatcaacttattcaattggtatattgtgagcattatcatttttttaaattagtgtgtatatcaggggagcctctggggaaatgtaaagaaatgtgactgatgttaatttttactcctgattccttgaatgacaattgtagggagaaatgtgttctagtcagtttaaacattaagtacctagggaaaatgatcaattttctgcttctcatatctgcattcaaagatatcatatgtttcatctggtatgcttctgtcatatctgttgttgtctccatatggaaaataggaaaacatcagtctagctatgcttcttgcttcttgtgtgccattagcaagttattgaactatccaagtcaatttttttataattacaaattaaagatcgataatgactgcattatagaaatagtatcaggatataatgtacgtataccctctataaagacatataaagggacacaggcatatacatatttttcttgacacatagacactaattaatgtcaatttttatcccttaattttcatgactgaactttttgtgatgtggtgtatagccagcttctgccttcatgggccagtctgtatctctgtagctctttatggcctctgccccagccttttccttaattgcatattttcctaaaaggtgtgaataaaatggtgttggcacacattactctccttttccacactagctccacccacccatctccttcatactgattgcttaacattgccttcttgcctttaaatgaaagccattcctaactattggaatagtttgctttctctctcaacttaaatttgcctgtgctgggtcccattcatttagagtttttgagttgttaataggttgttgataggcaggtctatcactactagtgttttaaataacacacacattggtaatatgttgatttaactcatacattgttaaaatacattgtgaagtattcatagttaaaataaattatccattaagtaatttacctaataacagtttacccaagttaggtgtgtggaatggggaaatatttgtaataagtttgcttcctacagagttagtcttgtgtcagatatgtaagtggtagaattgcaagttcatgttactcctaagcctagagacatttattttctgcttctccgaatgcccattttagtttcatgggtgtttgtaaacccatccttacctacacaggaagcaaaaaggggttatttctaaaccctttttagatatagaaataatacatcactcatctcggccaagactcaatagaatcatgaatagtgactgtaaaaggtaatattaactattaggctttaaacctattgtgcattttagttttaaaatgcaaacatgctaatctgaataagaattaatctgatgcctctacatttttgctaaaatcataactgtttagtcttacttagtaaaataaattatatctttgacttaaaatcccaatgataacttttaagatggctatttcatagataacagcaacatttatcatggacagacaataatgagaataacatgtgcaactgataatttaaatgcaatgagttatttctgtatttgaaaaaatatatttgggaaatgggataattaaaaaataccagttttcaagagaccaaatctaaaactcaaacataaacacaatgctccagtttttagaaaactgtcttgattgtagtagtgcctacatactaaattgtatcatatgatttatattaattttccttattttgtattttagattatatttgaaaattttcatgtactgcagctatgttagcatctcaaagtctccatattctcactccgctccgaaacatccactgctgatgttatttaactagtgaaagaagatccttccatgtttcttcttatagcattctgacatcttctccaccctaaggaatgctggctttattaagtatgtttcagtcaatgacatgtgattggtgaagctgacggtatttgtcttcagttccttttttccctgcaaaggaaatttgttgaatatttattgggtactatatgccaggtactatatgtcaggctccacttacatatactctattgatgccttacaacaaacttataatgagaagattaataggttttacaaataagaaaaatgaattcaaagagcaatgctaacttactcaaaagtttagtcaggcagtaaatagcagcactaggtttcaaatatggatttaacaaattccatggtccatgcttattccattacttcatcctgcctctttccttagcttctaaccctgactggagatgcataggcaaaaagaggaaggaagagatacttagatgtgccctctagacaatttacagagttgtttgggcatgttgccatgctgtttttctgatagactacagttcttcagctctgaggatgagctcatttgataagccaatcaaggtcgggctagggttactttacaagagaaaatttcaaggtaaaataggtgctgccaaaaatgcttttacctgttcagggggttgactcactggaaaaaaaatgttagataattgtggccaaggattattttgttattgaaagtgctatttttagacacaatttgagcctgagagcctaaacacttaacacttcacataatctacagatatttgtttatttttctttttgtcatgcattgccaaataaatagtatttatttaaacaaatcatgttgctattgattttattaaatagatgaactttttttaattttttttttttgagatggagtcttgctctgtcacccagactggggtgcagtggcacaatctcgtctcactgctgcctccacctcctggcttcaagctattttcctgcctcagcctccccagtagctgggattacaggcacatgccaccatgcccagctatttttttttttttttgtatttttagtagagatgggtttcaccatcttggctaggctggtcttgaactcttgcccttgttatctacccacctcagcctcccaaaatgctgggattgcaggcatgagccactgtgcctgacgtgaacaggtcaatttctatatcaccggacagtgttcctggatcagaataatatattatatgtatgaagaatcattacctattacatcagacatgaaatgacctttagatactgactttgaaagagtttgagatgctattggatgaaacacatgacccatatgaccagtcttttgaattgctgactctgagtataaaatgttttcatttcacctttgttcacaatgagaagtgatctcttaaccaagtaaatgaattaaatcgatatttaaaataacattaaatttcttgccagaaaaactgttctttcataaacaaaaaacaaattgctcaaaataaatgactatatctttatttctaaaaaatgtttagagattattattattgggtctttacaagtaatttgccttcaatactaaacacatgagaacaatgtttaatatttatatagtattttactcttcagaagatatttgtccatattctctctcagttattcttcacaacaacattatgaggtaggtcttttttaatgaaaaaaaactcaagtgcttgaagtgatttaaaatcactgtggaagaaaagcatgggcatacagaaaagccaagtggttgtgtgtcagcttgggaaaagcttgcaaatttcctgtatttcaagaggccaggatgaggtgtgtaattatcttttactggtcttcagctatcctgtctttgatatgtgattgtgtcaaaactatgaggaaaaactcacattaacaaacttcataaacttgttaaacataaaataataatttcgatgttttaatttacagtaagagtttattcttacaagtccttaaatacccaaagttctttcagttatcatagtctttttcagtagacagaaatccatgtggactgttattgttctgaatagctaggctatgccatagtagcaaacaaaccctgaattttcattggcttagtatcacgaaagtttatttcttgctcatttaacatctgaggtgggttggagagtctccttcatccaatgactcacagttcaggcagcctccacattttgtgcactatccctaaaaggtggactctgtggtaatcagtttccaatatggcttccaatgaccgcccccgggccccggccccacttcctgatagtcacatcatcgtgtagtccctttgcatattatgccagaattggtctgggtgaccaacagctcatagcagcagtgaaacgatgtcactttcaagattacataacaggagcttacagcttctggctcaagtacccactttctctctagctcttggatctcttcttctggaggaagtaagctgccttgtggtgagcagctgttggctggagttaaaatctccagccagcagccagagaggaaatacggtctgttaacaacctcatgtgtgagcttggaagcaaatccttcagaccaggttgagtcttgaggtgactacaacagccactaccccaacccacccccagcttcagtgcaacttagtaacagacactgagtcagaactattcagctaagcttcttgcagattcctgaccattcagaagctatgtcataataaatttttgttgtttgacttcagtttcgggataagttgttgcacagcctctaaagttgtgaactagaagaagtatactggctcttaaccacctttgccaaaaattaacacttgtcagtcatggtcatattcatttggtccaaatcaatcatatcgtatcaacctaactacaaaggggattgggagatggtgatgtctctgtcacagaatctatataatagttaaaagtatttttaacttgcatagactcagaacaagataatttggaggaattcaatgcttaatggcataccactaagataagctgatagatatatcgttgcgatttgggtctctgacaatagaggcaattgataatattaagagactatgtgccaattattgtgcttggattgagggtacaaaggtaatagaatccaaggaacctgcactctttttgaaagatagacacataaacacatacttttaaaataacgtggtaagtgctactatgacagatggttgcacagaatgtagtggaagtatttgagaaggacacttagctctgctgggggattagagagagatacaggaggagatgacacctaaactgagttttaatagatgaattcaagttacccaggtgaagaaaattgggtaaggatgttctaagcagaggaaacaacataagcaaaatcaaagaggcgtgaaatagaatgagctatgaagaaagtgttaggcaattgggtaagtccaatgtaagtgcagatgaggagagtctggaaatgaggctgaagcagtaaataaggattggccataaaagaccttgtgtacaattcttaagatctaggctttgacactgttgtttagggggagctgttaaaggattttaaattagagtaccatcattggtttgcattttccatgagagcattttgaggaaaatgcagagaataaatacatgaggggaaagactagtgaaggttttcacactggggtttgcatcctgttttggcaataagcttgttttaatgaaaacaaacaaacaaactgacaataaagaacataatccaaattctccagataattacttccaggaggctttctacgtgctgcatacaaaacaaagaaagaaaaacataaagtgagaaaacgaaggaaaaacaaggaaagaagagaaagaaagaatacatattggaaaaactgttgctgtttttgttttgctgaatatttaaatttgagaagcaatttctctttttctttttacttttttttttgagataaagtctcactctgttgcccaggctggagtgcagtggcgccatttcagctcactgcaacctccgccttccaggtcccagtgattctcctgcctcagcctccccagtagctgggacttcagacatgcaccatcacgagcagctaattttttgaattcttagtagagatgggatttcaccgtgttgctcagactgatctttaactcctgagcacaggcaatccgcccaccttggcctcccaaagtgctaggattacaggcgagagccactgcacccaggcgcaggttttctttatgatgttttaattatatctttcttggaacatatatgtatgaatcttgcatgccataggtctattaatattttccaatattctacatggttttttactaaaatcatttttatgattagttactgactgaggtttcaatgcatcactgtactcctagctatctctcattttagcttttacatcacattttggcctcacactgaaacacaaaatattaaaaatttgagatctaataaacaattttcacattttccaactaaatccccacttctttctaaattttctacaactttctaaacattctcacttgaaaatttattttaaatgacatgtattttattcaaacaatcaatgaagatgctacattgaccccaagtgagcccttagggaatttccgtgaatatttccctacaggttggcatggtaacacacttcacaatttctaaatctgtggatagtttagaagcttttatttgctgttcctagttcacaatggaaatacaacaatgattaaaaattataatatccttttgtagattcttagcttttattcctactcagtgactctaaaatgaatttataaggcccatggtttataaccatgtgaggccttgattttgtcactacattgctagaaatggggtcagaaggccaccagctttaataatttaattcatcaattcggaatgaatttgatgagtcaaccactttggtagagaaccatattgctcataaatactgttttgaaggcaattcgtctttcataaaatgtgaagattgtgctgatctttctgggcagggttatggaggtgtgattaaatgcttaagaaaccattttgttattatattaaaccgaatcaactttttattattaaaaatagataaaaacttagcatcctcaattataatactttatacaaaagtttcccaattttatatagactgaagataaaaatacattaacaaatcttaccagctggttcaggaaaataacttcataattattgagacatttatgtgtttgggcttgatttatactttggacacaggaaaacctagagagatctggttctttgaaatcatcagagatggtgatggtgactcagagattcctgaaaatcagtaagattaccctagtttatagacgtatgtgttattttttcccccaggcataatgaactttataacttgtcattgacaagaagccaaatcatcttagagaaaagggggagaataaaaatttaagaacttaaaaacacataaataaaaacatgtacatacctcacacatgtgtacacacacagtttggggattggatgatatgaataatataattaatacaccctaatttttcatgcaggattaagaaagtatcttccaaacattaaaaatgctgaaaactggacataaggccttgagtttcccaaattcaggacatattttcaactatcccctgagtaaatgaactataacatttacagaagtaaaaatgataaatacactaaagatgaataagtccttgaattaacagccaaacaagaaggcgcatcctttggatgattgatcactgtagcatgatttcttttccttgaatagacaatattccttgacaatctttctgtaaacagaatacaatgtttccctaagcaatatatgcgtgctctagagttttcacaatttctgatcctcctatgactggctcctgctcagctcacactgcactttcatggaagttctcttagaatgccagctttgaatcactgctccctcatgtgctgtgtgtgatagcatcccattttagttttgtcatagaattgattaccatttcaaattgaattgttaatttattgttcatttttctgttgtctcccttaagtaaaaggtaagctgcatgagaatagtttcattttttttcctgtttgccaatgtatcctcagtgccgagaacaggttcaggaatacagaatttttagttagcaaatgaattaaagtgtaagacttccagcaggaggaattttttacatataagtacattttttaaattaagcattgcaggctttaaatttcttctatataaatatttaaaataaagcttcaataatttgaattgcttttgtgattattttgttttataccttgagtaacttatacatcaactattttgtagttattctagtaatgattatgaaagaccatttgaaaatctttccccagcactgagatctccttgacatgactaagtgatttatactatgcaattatattgctcttctcaagaaaagcaaaatgaaatttacaaatttggtagctttttgttcttttgttttctcaagtaagatacaccaagatttctttaaatgatacgctatatttctgcaataactgagaagaacatgtaatgtgcaaaactcttaaactctttttgtttcaaaataattcttggttgtttttataaaagtctaagcaaatacttaatgaactgtgtcccaaatgaggtgaaacagctgtgacagaatgttactatgactctgtactttctataataaaaagggacagacatatcctcacctgagccttgggatgtttcaggcatgcccatagagcctaagctttaggaatcctctgtcattcttttccattgccagtgacttgtgccaattctagggttctggactgtgcaaacaatggaaaaaataataacactttcaggtggcgcacaaaaccaatgttcatagtagatggatagttctagacactttatttaatagagaataggagaaacactaatcccatctaattctgccttcaaactcctaaaatattcatcattatgaattaaaaaaaaaaatcaaagtgtaacctcacccagagaaagaagacattggggccaggtctggtggctcatgcctgtaatcccagcactttgggatgctgaggcgggtggatcatgagttcaagagatcgagaccatcctggccaacatggtaaaaccccatctctactaaaaaacaaacaacaaaaaaattagctgggcttggtggcatgcgcctgtagtcccagctacttgggaagctgaggcaggagaatcacttcaacccgggagacggaggttgcagtgagccaagatgaagccactgcactctggcctggtgacagagtgagactccgtctcaaaaaaaaaaaaaaaaaaaaaaaaaaaaaaaaaaaaaagaaaacgaaaagaaaagaaagcagatattggtaattctagcagatcctggaacaactgaaccaaatttattaatatgtattattactgaaaatcagtaatgaacaaaatttacagaatgggcttcttggagttgttacatttcccttattacataactcttcaataaaagtgtttgtcatacctattttagttaattctacaacaactagtgtgatagggctattatttgatcttttttttttttttttttttttacaggtagtgacattcagtattagacagctgctattgtgttagttgtctgaatacctttacatattatcaactggccttttcattcctgagttgtgagtaaatgctctgtctcccagactggagtgcagtggcgcaatctcgcctcagtgcaagctccgcctcccgggttcacaccattctccagcctcagcctcccgagtagctgggactacaggcgcacgccaccatgcccggctaatttttttttcttgtatttttagtagagacaggttttcaccatgttagccaggatggtcttgatctcctgacctcgtgatccacccgcctcagcctcccaaagtgctgggattacaggcatgagccaccacacccggccataaatgcagtcttgtgttccccacttccattcctcctttgacagtacagctatgctagtctgcgtagcaaattgaaaaaatatgacctgtgggatttaaacaaaacacagtgtcatacacattttctggtaaacttaaccaaaagggacttgggttccataactaatcaccaatgcctcagtgatctgtaactccttgtaggtacctgatcacagttactaaagggaaagaggagcgaggaatacaagagcaaagtcaagccagacatagattttatctctttgtaaacaggagttcagaagaccgctctgaatgctgagttagcatcagcaataatagaaatatatgcagattgttgatttgaagtcatgcaaagatatctttttcatccaaatggaggcaaaagcatcatagagcaccagagggctaaatccaactgtagcagcaaaaggtacacagaaaaataaagcatcctgaaccaacgcactgactttctagggcttatctaatttggagctatttccttttcttatttcattcagcaaatatttattgaacacccacaatgtgtaatctgttctattacattctgtggaggaaatacagaagtgaatgaggcatggttcttacctacaaggaatttctaatcttgtgggggagactaacatgtaaacaataaactatagtatgaggattactgaagaggcatatgctaagtctcagaacattgaaatataagagttgggtttgacatggggaaagaaataccttcttcactgaggaggtagcattttgagttattgttgacatgtgaatacgattttgaaaagttccaaagaatgaaaaattccacctacattggtgaagtactaagattaaatgcatgatagcttgaagacacaaaaataattatttataaaccattccaaaaatcattcagggaattccaataatacacaagtttttaaacacatttctgggtaattttgagtaataaggtcttaatctcctctactgctttcaattgtttttgtggccttctttattttgtgggtatctggcccagtcttgtctgtagtgtattatggtggattggattaaacatgttttgcaatctctggagtgattttaaaatgacttgtgttatatcagagtttcctaaagggagattaatttggcttaatggtaagaacggattaaagttatgagataccagacactgggaaaacagttagaagcctgttgagactcttcagggcagttgttgtgagaatgaagttaagacaatgggatagaatatgaaaaaaaatgaaacaaacatgagaggcagtctgaagatggaagttggcaactcatcaaatgtgagaaatttataggaacagaaaagaacctgctgattaatataaattttctgccaaagaaagtacagtggctctcctcagcaaactaacatgggaacataaaactaaacactgcatgttctcacttataagcagagctgaacaatgggaacacatggacacagggagtgggacatcacacactggggcctgttgtcgggactatgggagggagaccatcaggataaatagctaaagcatgtgggacttaatacctaggtgatgggttgataggtgtagcaaactatgatgacacacgtttacctatgtaacaaacctgcacgtcctgcacatgtatcccagaacttaaaataaaattaaattattaaaaaaagaaaaagacagtgcttgtcttattcgtttttttcttaaaatgggaaatatgtaatatatatcaactgtagtgtatagaagggtcatgatgaattggacaaagatacgtggagtttgaattgctagaggagtacccacgtgcagttgtccagcagaaatcagggcttgttccccaacatgctattcacaatcagtctactactctcaggtatttgtttttctgtgtggctatgcaagcaatagatacagtttatgtgaaaatgttttagaaaatgtcttctggagtaattaaaagcatacaagggaatgtaaatctcttaatgtgacaagacctttttgccacaataaacaaattcattagttcaaaaaatatttattgtgtgcctattgcagcaaacaaaacagacgaagctccttcttgtagggaacttatactctagtgatatttagtatatattttgacaactgaaccaataggatttgatgacggattgccttatgggtataagagaaagagaggagtccacactttcatgccaggtaggttgatggaggtgccatttactgagatacagggccgtagaggaggagtgtgtttgcagcagggaaggagaagactcaaaatttggttttgatcatactaaatttgatatagtacaggtaagtgtatggtggccattagaacatgaaggtaagagtttagataaggagacaggtatggtgaaatacatccaatatttataaccaatattatcttttgtgtctgtacctttttatacattccccatatatatcaaagactatagaagggactggatagtgaataagtgattatacataaattcttttttacagattattttgctcttgatttctcctatgtaaatcatcacagctacattttttaaaatcttaaaaaggattactttgaacaatgcatttaaacatccagaaaacaaaaacaggagtgcatggtaaaaattctgatttcagaacgtatgcctgacttatcaagtcagaatttcagggagtgaagaccctggaatctacactttaaatagagcctcagttcaccaagtatgagaagtcctgtaacagggaaaagtaacctcctgttatatttgatggaggccaattgacaagccaagtagttttccatttgacaaaaattctattgtaccaatgaagagctatcagaggggagtagattaaaacacctcccttgaaatggaatttggcaagaaagcaagaaattacagcaaaaagaccaataagaggaattaggggcaatgaaggaaggagcaaagatgtgggaacccaaaaagttttcctagtaacaactttgaaattatatttttagtatattaaatttaaagtagagttattagtgcgtacattggtgtaatttattattatattaagccaacaatatacttttaaacttatacaactttgcaaaaaagtacaaatcagaagtctgggctaagtagaacgcataatagaatcagtagtgcaaaatattgttctatattttctagcttatgattttctatataaagtcagtctttcaggattaaaatgaatgtcacttctttttaccatgtgtcctttaaattattaaaatctatacacatattgctatacatagtaaatatagttagtcaattatgtcatggaaagaattgaagggttgttataaatttaaaggtgtttcactatacaaaaacattgtgaaatactggtgctgatttagtcctagtatctctgatatattaaatcataaatgtcaggagttattggtcacaaaataaacaccagaattatatgacagtctaaaaacaaaaacaaaaaacttcagcaacaatattgaagatatggaagtgccagaagaataaggattaagacaatgaataaaaatctcttccaaggactggtctacactaagagtttagaaatgcatttttttttcacagaaatatccttaatcctctatatagaaatgagaagaaaacataagactttagcaagctccatctaatccatttgcagacatatggttacctatcttttcttcaatatattggagtttgcaaatattctaccttcaaagaataggtgttaccaaaacattgtctgcaagatttctaagatttgaaatatatttgctatagtaggttagagatgagacatttttactttaaattgcaataattcagacttaaaatataaaatgtgtaagtctaaattttttttctattcattgcaaatatatcttatatatacataaaatcctgtgtatactcatatgaactttaaggaaatatcagaggcatcagtaacagataacttgcatctcttttacattcagttcaagctactcaaattttaatcttttgttttcattccaacaaaaaaaattaggatctgccttggcttttgctaagaaagtaattattggctggacatggtggctcacatctgtaatcccagtactttgggaagctgaggtggacagattgcttgagctcaggagttcaagactatcctgggtaacatggtgagaacctttctctaaacacacacacacgcgcgcgcgcgcacacacacacacacacacacacacaaattagctgggaatgattacacgcctgtggtcccagatacttgggaggctgaggtgggaaaatcacctgagcccaggaagtcgaggctacagtgagccgtgattccaccactgcactgcagcctgggtgacaaaaagaaagtcattatcttcaacactgtgcatacacacttttctgcatctagatcccaaatttttgttttgtatttacatagaacattgataagtaaggtaagtattgattgataaaacatttcaaactcatttttcactaaatccaatggccttcctcttttgcatgaagtctctaagaatcatgttaatctacatactcaatctacgtaacaactggatatatcctgtagttgttgcccatttttctgctaaatgttatctttagcactaagcatgagtatgaggaaacagtatctgtgctcagatttcagaaatgaagaaaatgtactggaggtcttttggataatggctacaaggtcacagggactgactcctttggaagctcagcgataaccattttcagagagaatatgtcaacatctttcagtctagaacttgatgttctgctgagatctaatctgggggtgtcctactattgaataggtataaactaaataaaaatagtgagagaacattcatgtgttcactcattcattccttcatcaaacaaatattgaaagtctattaattggcaagcactcttctgacattagaaggagcaaagataaaaaagatattatcattaacctcaaggacatgacagcatcatgggaaggccagaaatgcaatatgttaaagtaaaacacagtgtagtgtttactactaaagagatataaacagagtactgtggtctaaaatcatatatataacatttgcttaatggatgagaaggaaactttaacttcaggaggcagagcattaagaaagtgaatgacaggagggtcaaaagaaaaagccgacagtgttgcagaggcagggcataaaggagctaaacctttgctaccttcagtttttattatccacagaacgacaaagaaacaacaacaacaacaaaactttggatttgagggttttttgtttttcttttttttttttttcctctcattccaagcatcaaaccttgggatttatttaccttctagcaaaccaaaatttatgggggcattcctatggtcctcacctcaccccatttttctgttttacctatgaaacttgatcaaaatactgtctccacatttctcataaaatacattagtttaattttctactattactttcttttagttgatttaaaaaaaggtcatttatgacctatttaggttagcatcattaattttatcaatgtaagaatatggtagtacagtgtgaattccattaatggatatgttgataccatgggtttctctgacctttcctcttccgctcctccctgatgattggttctgagcttattatcatgtcagcaatgaaacagaaaagggagaaaaatctcaagtaggttgtctgtctctttaacactgaataaagatttttttttctctaacagacttaaaaatagtgccctaaaaatgttttgtttcatttgtctgaattcccattctttcccgtgatcatagatagttgagctaaaaaaagaaaaaacaaaaaacaaaaataaacattgtgtcctacatttgtattaactttcttaggaatgagaagtagaatcttaaaaaccttagaatgggagtttccaagctagcttgccggcttgagttttattgataatacctttaggatgcatgtattattagaaacatcagttatttacaagttcacctatttaaaagtctaataggaaaaaatatttcatgttgctaagtatgtgacttccctttaaaagataataatgctttccctttaaacaacaatagtaaaagaagtagagttccttttaaacacatacttttatattataacccattctgtttaaaaaatagcaggcatataatctagaaatgcaaataatttagtgaaatttttaaaattattctacatataattaaatatggatatttgttttcaaatatcaaataataaaatatgtctgagatgctgactaatccttaattataggtgtgatttctacttcaccatcaatactatggtactccaaatcttaacatgagtctgattttctaataaacatgatgaaaaaagttatggaaaaattttgagatttactttgggaggttctattgtgttctgttcagcttcataatattcagtttctatgagtttggtatttaattatgtgtgtttgtcattcagtaggctggaagtatgaccattgggagatcaaaacgataagacattaatgacagtgctttatcactgaatctagtactttttttaatgaaagagatgttggcctcttgtattgttataaaacaacacaattttatggctttaaattaaagtacaatcataacagaagacaaaattagattaaaaaacaaacatggagtgactcatataaaatatttagaaaccaataatacagatagagacacattagttcctctagacattgtgttttccagtaaaatgatcaccaaacttaccaggaaaatgataattatcagattatttactttcagaattaaaggcaggaagagaaaaaaatgaatgaagaggaaacacagtaaccatataggacaataagagtgaatgaagataaaatgaaaaatcaataagatatcgactttcttaaaagacaaatatcacaataggaaacacctcagaaagggaaatctcaagaaaataataaactgaaagaagaaaacatatcaaaacaacttgaggactgacaaagttttaaaatgtatttagataaagataccatgaggaaagtgatcaaggtgttctaggtaatcactgaagataaaactaaaaatagcttaaattaaaatcagatagagagaaggtaactgaaacaggcatagaaagaaagtaagaaggaatacaatcctgaacatcttaacaatgtctcaaatgtcaggaattgatccagtttttggctgcacaacagagtggctatagttaacaataattcactgtatatttcaaaataactcaaagagtagaatcggaatgttgctaacacaaagaaatgataaattcttgaggaaatggatatcccaattaccctgatttgatctttacacattgtatgcttatataaaaacagtattcatggccgggcgtggtggctcacacctgtaatccctgcactttgggaggtcgaggtgggcggatcacaagatcaggagaatgagaccatcctgtgaatggtgaaaccccgtctctactaaaaatacaaaaaattagccgggtgtggtggtgggtgcctgtagtcccagctactggggaggctgaggtgggagaatggcatgaacccaggaggcagagcttgcttgcagtgagctgtgattgcaccactgcactccagcctgggcgacagagcgagacttcgtctcaataaaacaacaacaacaacaacaacaaaaacaaaaacagtattcataataattaaaataaattatttttaaaataaaataaaatatcagtaatttaaatttttcctatagcatagagatctgtaattaatacttgtcgatcattgttgtttctgtcttcccaacaactacactcctgtttcttcacattcccccttcttctaacagcactacatctttctttaggaaactatccttttgccatttcatgtatatggtggggtgggggagttatcaatcacagtaccccagcagatgggaccagaggcaaaaatgcctgaccttctcccatcccccaaccacagcagcaaatgaattataatttgatgcacaaggaagtatcggagcttttgtgttgggttttacatatcacctgtgggagataaatgaacttttccccacctaacctttagccacttgggatgattagacatagaggtgcctaagatctttccctttgccacattaaaaacaaatcatctatggcacgagcatacaagaccagctttcagagacacaaaatgatggagagaaccatgatactagttttagacctagtcactgagactttctctgctccttcccagttacctgagctttattttgtttacattcatcagatttgaatggctgtacttcaaagtactgattaaaataggaaccaacctatatgattcaggtggtgagaaggaagaaaaagagagaaaatgaggttaacaaaagagaataaagaaaaagaaagaaggaaaacaagaaactctgactacctctcctctttgacatagtttacacttctgacagattgttcttctctaaatttatgtagagattagagtgaggatgatgtatgcactgtagcatgggtggtcttccaggaagccttgactgaatgaggcaaggagtatgttgctccctcagtaacctcaaatttacctgcaagcctgataaaaatctaacactaacactaaacccaatcttatctacagccctaactgcaccctaatattaacaaccctacctctgtacttcaaaactaaaactaattctgattttactcccatctgccccttttaccctaaaaccaactgtaaaactaaatttaactctaaacgtaatcctaaaactaagaattaactaacaattttatctctatacccaactgttaaccccaagcctaactctaatcctatctctaacctaacattaaccacaaacctacttctaactctaatcctaaccataacctcaaatctaactctgattccaattgtaatctaaacaccaacccacccttacccttttatcccaaatccatctgaaaccctcatcagaacacaaattccaattctacttcccaccctgactctgactctaaacataggcccaaatataactctaactcgaagtcaaaaacttaacaaaccttatcttgaaactcaacctttacactaaccccaattctatctgtaatcctaaccctaatattatcatcaaacctatgtctaacacgacctctaacccaaaaccaaaactaacctcagacctaactctacatctaattataacccaaaccccaggctgctacttaccataaccctgaaactaagcttgatcctttctcttttttttgagatggagtctcgctctgtctcccaggttgaagtgcagtggcgtgatctcggctcactgcaagctctgcctctcaggttcatgccattctcctgcctcagcctcccgagtagctgggactacaggtgcccgccaccatgcctggctaatttgttgtatttttggcagagatggggtttcaccctgttagcaaggatggtctcaatcccctgaccttgtgatctgcctgcctcggcctcccaaagtgctgggattacaggcatgagccaccacgcccagccgaccctttctcttaacctacactaacactaactgtaaacctagctgtaactctaattgtaaacctaacctgattactcactacaaaggtccctctaattctaacaagaaactcaatcctatctcaattccacccaaccccaaaagtaaatctaaacttaaacataactcaaaatgtatctcaaaccttaaccttcacgaaactacatgtagcactaatgtaaccctaagcccaatcctatcagtaacactaatgctaaaacaaaccccaatctgtatctctaccccatcactgacactacccaaatcccaatatttaatgctaatcattaagtctcaaactaactccaaacttatctttaactatatctccaaccctaaccctaacattaaccccaaacttatcattaatcatacatctagctctaaacctaaccccaactttaactcttaccctagctctaaaattaaccccaacactatctcaaactgtaatcctaatgctaacgttcaggctacttttaaccctcaccctacacaaaatcctgcacctaaactcaaccctaactttaaacctacctctaatccaaacactaaatttaaatctggatcacgacttgggcatactagcacccactagtgttctgggtgtcatttctttgcttcactctcatccagctttctttactaattttggataatgaatcagaaaatagtggtgtggaatcagggtctttgaattattgtattatccagagtttgtcctgctgcaaatgataaaacactgaaaattagcttaacaaggaaaaaaataaaaatgtgtgtgcaggggagaagtaggagagttattggctcaaggaacagaagaattcagtactgagtttcacaaatacctggattccctagtccccatactgccatcaggatccaatctgtcactcactccaatctcttcctcctccctgttggattcattgttaggtttcctgtggcaagatgaaatggcctcaggcctgtaacacaataggatcaattacaacagaagatagtatttctgttttcctggttgctcaagcctaaattccaagattagtttatatcaaacctagttagttttgctcatgtaagggattactgcaactgggtacactaatatgaagagtgggagagttggttaagggggttctctgaaaggagaattaggttactgttaatgggagaatgagaaatgggtattgtaatgacaaaaacacacacgactaccacaaatgttgaggaagaattttcctttatgatcatctagcccaactttttaatttctaattttgtggttttgaccagttttttgtttttttttttaatgcagcatgtcataaagttgggaatacttcacattttgtctttgaaaatttggagagtacttaaaaagatttacaaaggggaggattgaattattttaggaatgtaaatggtggtcttctgtctcaggcaatgtagatgcttgctagaaaacagctgactcatgactgttttctttctaattcattaatatgaattatttcaaactgcaaagttatctcctttcttctcctaatctatccacttagagtatacatgttcaaattaatgtattgaactaatttttctagtaatacattctatgcattacaaaaatagcagtgggaaggtgaaaacaaaatgcagttatgcatttatctctaaatgtgttcaacatctcttatgcgtacttcaaaataattacatttgtttaatttcgaaaaaaatattaacaagaagttgtaatttggggaaaatttaaagctggcgaaaaaggcttcatcataattgacaatatgggaaaatactgtattaaaatcctaggtttctcccttgtttgcatgaaggaaatgaaaaatatataagggaaggatttaatcagtcaggcaaaaatctaaattcatcacaggtttattcactgcatactatcaatgtgcccagtacctgaatgaatatattaaagaaatccacctcttgtacaatgaatgtaaatgagcagagtgtggtgattaaaggttggtatttggtgctgggtagacccagctttgccacttactgcccaagtaaatattgccatccatcagatatctccacctatcagacccaccctgttgtaataacaagattaaaatctgtatcactaaaactttaaaagaatttatagccgaatctagaaatctttcactataatttatctttccttaaaatgtcgtttttttttcaattttactatatatgtttttgtacttgtttgctgtcttgtgtgtgtgtgtgtgtgtgtgtgtgtgtgtgtgtgtgtgtgtttttgaaacggagtcttgctctgtcgcctaggctggagtgcaatggtgggatcttggctcactgcaactcccgcctcctgggttcacgtgattctcctgcctcagcctcctgagcaactgggagtacaggcgcacaccaccacacccagctaattttttgtatttttagtagagatggggtttcactatgttggccagactggtgttttttgaaaagactttttcctgattcagaaggtgggactcacaattgtaattctgctaatggttgtctttcagtctatcaattgcttcataaatgcatccactgttccttcttcttctgccctgcttataattttccatgagtccatatatctttttacactgtctttagtcttattcactaaattaaaaactaatttttgatatttggtattcatgacaagacaattagtagaattttgatgcttcttgtctgcaattacagaatcaatatattttctatattattgtatattctctaaatcttattttgtataatagctttcagcatgttctttaattctgtttagatatttagaaagtatttgttgttattctgtaatttatttcaatattcaattatagtttaatattttgttatctagtgttgtcttgattttgatatacgtactgattttgtagatccaaattcctctttcctatcagagaatgcaattttttacttggataaataagaatcatatcgcctctgcttgctaccatattgcatacattcatgggtagagaaagagttaagctgatgagagtaggaattaaggtagacctgtttggtaggttctcccagatttcagaggacagacatctttttttccctgccttggtcatttaaactttttggattttggattaagtgtaggcagggaaaatatatcagatatttttatttttctttggtgccatttgtccttctctgctttaggcagagaagcatatgtagtccaagaatgtgcttttctatccagctacatcaataataacaattagtaaaattctacttaaacttagacctttgctgttctcttttctctgcttgtgttaagtcatgctcatgattctggcagttttccacagtaccatgtacagaaagcttgaataaggtacatctagaatactcatatatgttcacttcaaaaacacatttttgtggaattctaaatgcaaatctcaatagtgcaattctaatttacaatgagaaaaaactaagggattttttctggtgattctttttgctcatttataaatatgtttttaaatgataagcaaatatataaattaagcttttccttacgtagctacattgatttactagtggtggaaaaggttaagcaaaactaattttcatgagtgtaaatgaattagtaagtgacatatgcaatgcttaaggggaatttgcataaatctatgactgatactcaacctcttgcttagcgagaagataattaaaatattttatacttcaagaagacctagttttccaaattatttacatccacaaactcagattttatagcaagtaagaaaagttaagtcagaagcatatactattaacagctacttacattgctcaaatttaatatacgattgctgcttttgttggttttgaaatgtttcttgaccatggatctgaataatgaagttattcaagaagcaactttaagaatgttatattcttagaaagaagctatagatacaataatattaaaaaattaaatgtaagttcctgcactcacagtagaggtaagttcaaggttataagagagcttatagattctgagatttggaaagaagagaatagaaaaaacttttcagattaaataatgtgttaattgtgcttctaaaacagctttggtgatcttaataaaataaatattgtttttatttccatttttgcttttcagacaagaaatgctacttgatggctgcatatatttgttttgtctcttttcaccacctactcttgctaaatactctcaacccactcatgaaattaaagcacattggaaaacatttatcaactacctgtaaatacaacctatgctctcttttgtggaggtgatagacattcatcaatggaatagttgatctaaatcctagtcttcattatcttgttttatacattcttgtcttaatcagtttgggctgctctaacacaataccatagactaggtggctgatgaacaacagaaatttgtttccaactgttttggagactgggaagtccaagatcgaattttatgtctggtgagggcctgtttcctaattaataaacatctgttgtctcatatgtcctcacatgatagaaggggcaaaggagctctctgatgtctcttttttagaatattaatctcgttcatgaaggctctgctctcatgacctattccttcccaaagggcccacttccaaagaccatcatattagggattaggtttcaacaaatgaagccgggggaggttggtaaacattcaatctatagcaatgcctatctccaggagctgcctgtggaaacacttttatctgatatggtagtttaaagcatggcagggataagtggtatgaggaaaactctccctgccacccaacgcacacatcccacttaagcttcagcagctccaattttatctgtgtaatatttggttccacatcaaagttgttttgaatatacttccattaccttaaaaaatgtaaaaacactgctttaaaaagccaagcctattcccttttcattattcagagttcttccagttttaccgttacatcaaattagaactacataattaggaacccctctctaaatttgcctctatacagagaaaaactgtgcctgaaactttattaaaactcaataaaggaaatatgtatgaatgtatatatataatttctctgaaggatagaatttgtacttcgttccatacataaaaactcatttgacaaataacaagcatagctccaagctcaaagaatagcttaatttttcctgattagtttatatctctcttattaatcaatgacatttaatattacaaccatagcttggggttttagtttatttgctttctatcttttttatactgtcggcctacctgtgcccaactatgttatagtcaggggttggtaaaataaagacaaaacaaatcctgtcttcctggagatcaccttcactgggggttgagaaacaataagaacaagtagtaagtaaaatatgtacattaaaattttagatgaagttaagtgctatggaaaaaagtaaaatggaagaggtgttatggagtacctgttcgggtatgggttcaatttacaagtggatggtcaccttctcactgataaggtgacatttgagcaaaagtcttcagcaggaagggagaatgccatgcagttatcctaggaaagaacatttccaatataagtaacagccagtgcaaaagccctgatgtagatgcataccttaggtatacgagtaacagtaagaaattagtggcacgaaagacagatgtacttggaaaccaaaaagaatctctggtaagaaattgtaagtcattgtaaggacttaaggtttttttttttcctctccaaatgagatggagatccattagaagggtttgcgtagagaaataatatgatctgacttatatttaacaggactactcttttgctgaattgaaaattgtctctaagggtgtatatcagatcttatattgatcttacccttctctgttcaatatttaacacacaagcctgttaaatagtccattcccaacttctgtgacttcttgcttgagagcctttctatcccctctcataagggctgtgagggcctaatctgcttacctatccagcaggctgggaatgacacagagcactcaccaggagcactctcaacctatgactcatggaagttggtagatgaataccccagctctcatattccttgggtggaagagctctgagatgtgtgttctacaccattacccagagggcaccctctggattaggctcaagttgctgacagtagtatcttgctgactaacataatttttattaattttctccccatttgaccttatttctccatttttctaatagtgttcattggtatcacttccaaaataaattacctttacttgaatatttttcttagaatcttctatacaaacctgagctaatactggggcaaagagtggaagcagggaaatattttgtaggtgttgtggtgatgtaggacagagcctgatagcttggatcaaggtggtagcaaaggagattgtagaagctatcacactctttatatattttgaagacacagccaagaggtttggtggaaaaatggattgtgagaagtaataaaaagagtgggagagaaagtcaaggatgtcaccaaagttgtcctaagcaagtggaaacttagatttgggagaatcaaaaatcctaaaatatccaaatcctctcccctgccttcccctcccctcccctccccttccctttggagatagggtcttgctctgtttcacaggctgtagtctagtttcgcgatctcgactcactgcagcttcgacctcctgggctgaagtaattcttctactttagcctcccaggcagctgggactacaggattgcactaatgtgcccagctgattttttttagttttttttatttttagtggagatgaggtctcgctatgttgcctgagctcaagcaatccaccctcctcagactcccaaagttctgggattacaggtgtgaaacactgtgcctggcccaacattttattttcaaatatttaagttttgaatgtctattcgataaccaagtaaagaagtcaactagaatatatgagaatggagttttctagagaagtctgggttgaggatgtacttttgggaaatggagcacatacttggtatctaaagctgtgagccgagatgagatcactaggtaggtaaatatagataaattagagaaaatatctaataattgagacatggagtactatcataaattttgaaaagacaagaaaatgtgagagatcgagaagaatggctggggaagaaggaatctaaggtagtgaagagattgaaatgtgtcaaggagagaagagagtaattagctcaaatgctactgataagtaaagtgaaatgtagaatgaaagtcaaccataaaatttggcattatggggatcattaatgaccttaaagaaagtgcttttagtgtagtaatagaaagatgcagaaagtaagtagagtgaattcaaattcaacagagaatagacagagaggaattgaagacatttatactgacaattccttccaagacttctgctattaaaaaaaataaaaaaagaaggagaaatggcaagtgtttggaggccaatttatactcaagaataatttcttgagttggttttttgtgtttgtttgtttttgattggttagtgtgtttattttttagacgggattggagaaatactttcatttgtgtttttacccatgttttcagccttgccctggctgcctggtataacgcaactctatttgttattctgctattatagtttccctagcttgaatttttttacacccttattataattgtagcgttgcatgcctatttcaaaacatctcatgtaccccataaatatatacatctactatgtacccacaaaaattagaaataaaaaaatttaaaaattatgattttttaaaatttgttaaataatgtttactgactcttttatttgttgaaatcattcattttttggaatatcaggtccaattaaatatttaatcagactttgagaaggatttaataagaccaataaataaccaagtattagttgaaggaaatttcagatattttggtagcagaaggaactgagttatggctcaagagctttttaataagtgtgagtggagttatacaaactactcattaaaatctttatttgaatttgtaatatctgaaaccattttcatattgaagaatcacttaaaatagtcataaaatgtaaaattgcaagacaattaaaaacaaaaatatgatttcacgactgtgatagtacctgagaaatttcttcgtctccttagtaagagaagtattacacctatttatagttattttatgaaactagctaagatgaattatgtagaaaagatacagattttcaaacagaaactagaattaatggaagctatgtgagactataaagagtttaatagttattttgatttttttttatgagtgcaaggagtatagcgaaaaatagcatctacctataaggatttgcaaagccagtaatctttctaaaaatatcagcaaacccagaattaaggcttatgttcttagctcattgtaactagatcaaaaataaagaaggccaaataaaggtatgtgacatttgttgaaaacctgaagtgtcctatatgcagaaatatttttatcatttaattaatttcagaaacttcttaacatgacatgatcctcttgaaaagatcacatcaaaaaaggcaaaataattgcataattattgtagaataatttttgtgtgagtatttttgacttagtgtaagtttccaagttcaggatttatcatgcagtgaaaaaaaatacacttgtctagaagacaggagacttcattatattcctctctttacaattaattaacgtaagaccatttaaaatatgcctaattttccaggcattggtttgctttgctataaaatgggaggatagaaaataactttcaaaatatcttataaatctaagaatctttgcatcttataaatctaagaatctttggaaattcatagattattgagatggagtctcgttgctatgcattgtagcaaagttggaaataaattctaaattttatttcatttatattgatcaataaattgttacatttcactaatacaataaggaaaatttattttacctgagtgtatgtctagcttgtgaaataaaaatgctcaattatgaaagcatttattgccattttgaatgaaaaatgtaatatgtagaacagaattttttttgccttgaactcagttaaatgtagaaattgataaggacttgcattttcatgaacttaataattatctgtcttttcaatggtctccatatcaagtctgagaaatatggatgtgatttattttaagcctcaccatttgaagtaaatctaaagattccattaggttatgagcatataggatacaaggaccatattgacagttttgtgggattgtattaggataaaagggtaggaacaatggggagaaaattatagcttacaatagggaagaaccaaaaattgttgcaaaatgatggaacaggctgaaagaatgatataacctcctaaacacttcaaatgtttaagcagttcattgtaccagggccattgtagcaaatattttctgtcttgggtggaaggtcagtcaaggtgactgataaagtttcttctaacgataaaatagcacaactcactttttttctaacctctaagagtatattaatatcaaaagaaggcaagcaacaaactacttctgaatgttaatatatatctgcattcattttaaaagtctgctacaactacagatagaggaacagtttgtagtatccgtgatcctagaacaaatttagcttttaatatcttgtcaacttttttgttttagtatctcttccttggaactagctgagctttaatggcatcatcatgtgatatgacttgagatttatatttggaagagctttgaaaaatcacggattgttaccctaatgaggtgttattcagtcttttaaacaagagcaatttctttacaaaaaggagcagaattcttaattgtatctgtaaacctccatttaagaatgaattacttggctgggcatggtggctcacacctgtaatcccagcacttcgggaggcagaggctggtggatcacttgaggtcaggagtttcagaccagcctggcccaacacggtgaaaaacagtctctacgaaaaataaaaaaataaaaaaaaaaaaaaaatagccaggtgtggtggtgtgtgcctgtaatgccagctactcgggaggctgaggtgagagaatcacttgaacctgggaggtggaggttgcagtgagccaagattacaccattgcactccagtctgggtgacagagcgagactccacctcaaaaaataaaaataaaaaaaaaaagaatgaattgctcataaatgtgcctcactgatgattaaatttaatcctgcaagattatgtcttttgatggaaatgagagggtttatacaaagttttattcgtgatgttatctatgtcatctattgatttctgctctgattcatgtggatgaagttacacctcacactttaagctggtgtcagtcttcccattttctgctgtgatgtgtactcaagatctccagattacatctgtaatgtaatgcagccatgattgtttataggtacatttagatgaattcaatgatgagttatgttgtaataagtgtcagatttagatgaaccatacaaataaaagaaccatgcattaaaatgacaaatgtgtaaaagcattatttgggccttaagtcaaggcccaaatgtggatactggtactgagacatctttcagaaaggaggtatgaagtactgaaaaatatttacaaaatgaagactacttttatcttacttatcatgattcttttattacatatgcattttctaagataactatagtgcattagtttgtactatgttaatataataatagggtaaatcaaacaatgttttctaaatccattaaaatagagttccctaagggagttaaaacaattacgttctactgtatattattggcatgcttcaggagacatgatttaatctctagactatcagaattcaagaactagtgagtcatataacaaaggaggcttaatcatgccatttaagtgtcatggaaaaaggtttattggtcaggaaaaattaattagaaaaaagttataaaatacttcactaagaaaataaaatgtcaggaagcccacttagacaatgagtgaaaatgaaacaaattcaagtttttacaatatttggtttctataggattgcttcattgttttggtttttgtttttccccataagctgatctcagaaacttttcctctacatgaagaggctgtcattttttcatggtgtgtgtttgttcacatgccacacagacaatcaattatgaagaaaggagagactcgtgggaggcagggccaggctgttcacacttttaaactaggtagccacaaatgaggcttagttacaaaaacttgaaaactggattcttcccaatgtattatacatccccaaagaaatgatgaagttccttactctcttctctttgtttttgtaaatcttaccacttcaagtgttggcaatacttactttaaagtaggttttcatattggcttagatttttttttcattaacttgcaatttgtggttgggaaatgatctgctttttgtttcaggttgtttaatgttttccaatgtaatattcttcttgcactccagtgagtttatttacaaaacatttaatgtcatttgcgtcttcgaagaacaatgtattcggttagaacaaaagtgagctcctgcatagagcttatgatggtttataattggtaaattattaccttggtcaagtttgtaaactaataaagggagtagaaaacttttagataaaaaaaactacctcattcaaagggaccgttcacccacaaaatgcctttttgtttatcttttggaatgacaccattggaaactcagtatggccacttttatggtaataataaaagtcatatataaaaaggattattagaaatgtgttatttcttaggcaggtatgcttatttaaagtatgtatgcatacatactttaaactactaaatacaaataaattagtagtacagtcattaggattgctcttagtttgttagtgttggaatagacttttggattttcttcctagcttagattgatacaatgtgatggggacttgctctccaaacacaggaataggtggcctgcagacacactctgtgatgctgtaattctaatcctcactgaatatatcaggggtggacatctggcctggggcaattcagatactttttcttaaaatttatactacaaattcaaaagtggtaactcatctctgccatcacttatagtagaataagacccactgttgcagtggggaattgagaaacccagtccacagggagaacaaacatggagaataaaataagtaaattagaacaggaaaaatgccaaaacacacagacatgaccctgatagttttccatttcctgatcactgtcccttcctgtggctggataaggaactgtctctaggctctgtaagacatatttgcatccttacgacaaatttctactccttttcataaactagacttgggttctttaacttgcaacagcaacaacaataaacgattttgttgggtacaatctgattttattaacttctggatttaaaagcccttctaaatgttgattggcattgtttttacttcctaagagtacgctcatgcaccacatagtgatgttttggtcaacgacagactgcatttacgactgtggtcccataagattataataccatgcttttctgtacttttctatgtttagatatgttcagatacacaaatgcttatcattgtgttataattgcctacagtgttcagtacagttacatgctgtacaggtttatagcctaggagcaattggctataccctatagcctaggtgtgtagtaggctataccattagatttgtgtaagcataccctatgatgtttgcacaatgatgaaatcacctaaggatgcatttctcagcatatatcccagtcattaagcaaagactgactctattattaggtctattttattctatagcatttgatcatgagatatgtgaaaataaatataatttttagaagtacaataactttcaaatcctgaatgttctgtactttccatctcacaagcattttgcaaagcatcaaatggtataagccagattactgttaaggcaacttggaattaatatgctgctcagttctggaaaaggcatattctgtaaatatagatgagagaatatagactttttccctctcttcttacaatccacattctattcagtatttcatttacttgaggggttatatgctacttatctttatctgttgtggagtgaggacacattccaaatgccttggtattattaaaagcccttcatgatgtggccccatcttttatgacttttccttttcaactgtgccctctagccttatttgatttctctcaaattcttaaacacagcatgcttcactgacctttaagcctttgcacatacagtgttgatgtggagcttcctgaccaactcctaattctccttcaggcctcaatttaaacatcacttcctctgggaagctttctattattcccaaggtactgggatatgttcttgcacagcatgctgtgctaatgtcacaatggctaccttgttttattgttagtatttgatcagcgacaccttgccagggagcccctgagtattgtctgagcagaaactatggctatcttgtcccctgtttagcacagggcttctctaaaagtgggcttctctaaaagtaagtgctcaagaacaacaacaaaaagtgttacattaataaacacacacacatacatacaaagaaatacctgtctttctccatatctcaagatcatgctgaaaagccagcattcatgaacaaattcctgtgcgaagattgagaatgaaagatgaataagaggtatctttagaacccaattatggctgccgttgttccctgagtgtgaggcttgctgttagagtgacagaaggaattttgactactcaagaccatacaaatttggaaatgactccaaagtaaacatggttagataactacacattccattcccccttttttatttctatagaatcccaactttgttcaagtagtaacatgcccagcttcagaaatgagtcatgatttttctaaagcaacaatatcaatcttctttcccttccccagtgattggtatggaagtggacatttcagcaagttttagccaataacgtgaattctgttttgaagcatctaagaaagattttgctttctgctgtaaatcaaaagcagaaacaggagaagattcttttgggcctctttccctcttcctggcgtggaagtagttgtgagagcatatgatacccaaagtttcggtagacattttataattatgtgatgaataacctaaggataattaaacatataaaagaatggagaaagactgagtctgttttactccacaagatgctgaaccaaccctgagacataatttatctggattcttaaataactagtgtctttgtggtttaagctgttctttgtaaacaaacatatcataagtgattaagtgatgttatcttcctttaaggcaatcaaaatgcatctgacaaatggccatctaatttaaaattccaactatgtagacatctcaaacaaagtcagtatctcaaaaaatatactacaaaaattctcatgtgtccattggggataacttccaatgctctttcattggtattgtagctatggcatttgatttccaattgtatgtggatcaggtagttgcagggtgactctcaagggcgagaagaaagtaagagtacatgaaaaaaaagaggaagagagagagcagacaagaaggaagaacaagacaaagtcaaaccctaggtagaaataagaaggagctagtacagaaagcaaatgcctaaggtgttggagaacatagaaaggtagagtggaatgaaaaagaaaaaaacactaaatagcagcacatagaatcttggggtttcagggatattgtttatgaaaggttagaataggcaacaatctaccttgtggcatcttcttaaaattatcaacatataaaacaaacaataattatttaaattacctgtcatatgggtcttgtcatttatttataatttaaggagaattaaaactgaactagttgctggggagtgacatcagcaagatggagatatagaaatcttcaggacctccttccgtccatggaaccactgactcaaaaatgacaaatggaaaaaatttactttctgagaaatcaagaagccagttaagaggctcctgtatctcagatgagtgcaaagccagctgcaacagagccagcagaaaatttgttgtactcactcttcatggtcacttctggcatagcacagtgcaatctagaagaaattcttggctcctgactactttcttggaaaagaaagagaaaaatgtaccatatgtctaatattctgatggggatggggtgtgggctgctcaaaggactagcttccgtcatgcctaaatacaagtgctaattgggaagtccacaatgttgggggctgcagaaaacaagggcaacagtttggactagcatgcactcatttgccgcagttcctcctctcacttcatagaatgagtagaagaacccttaactctcaaggtttttttcctggggagagaaagagtcaaagcaattatacaatattatggctttgtgggagtgatgtatccaaaaaaaaaaaaaatgagtttttaccacaccaatctcagagtgcagatggaacctagcatattctagatgcctgggggccattgagaacaaaagagagctaggcaactttcagcagctccagaagaactgtggtaccacagatagacaccaaagggaggaagagattacaagctcctgaaaaaagaaatgagcaattcattctaattgagaatttacacacactggtacagataagatgaatttgcaaaaaaagaatagaggccccagaatttctagctgggttttttggtgaaggcctttctctgtatcaagctagtccctaaagactgggtgaggtggtttttgtttgttttacatttttattttaaaagatggggatctcactttgtcacccagacttgagtgcagtgatgcaatcataactcactgcagcctcaaactccaagggtcaagtgatctttccacctcagcctcctgagtagctgagactagagacacatgccactgtgcttgattaatttttatttttttattttttttcgtagagatgtggtctcactttgttgttcaggctggacttgaactattgacttcaagggatcctcctgactcagcctcccaaatcattgggattacaggcatgagccaccatgcctgacctgttttgttttgttttaaaaaactcagaaaaatttcaaaatagcaattataaagacaatgagcttagaaaaccaattaatggacaaaatgtaactataagtaaagagatacatgtaaaaagaatcaaacaaaatttgcagtggaagaatatgataaccaaattgaatattacattaaaggagtttaatactagatttgaacaagcagaagaaagaatcagggaacttgaagatgggtcatttgtaattattcagtcagagaaacaaaaagaagactaaaaaagagtgaagaaaccctaaggacatcatcaagtagaccaatatgtgttatcagagttttagaagaaaaggacagaaaaataggcataaagcatcattgacaaaataatgacccaaaacctcccaattatgaaagacaatagatattctgaatccagagcacaatggcctgcaactaagatgaacccagaaaagtctatacttcagcacattataatctaattatcaaaagccaaggacaaagaaggaattttgaaagcagaaagaaaatagtgactcatcagatacacaagggctgtcatgagaatatcagcagatttctcagcagaaaacttgcaaaacagaaataagtgggattacatattcaaagagctgaaaaaaagtctgccaacaaaaaatcctttatccagaagaattttcttcaaaatgaaggagaataaaggatattccagataaacaaaagccaagggaatccatcacaattaaacctgccttacaagaaatgctaaatgaagttgttcaagttgaaataaaagaacgctgaacagcaacacaaaagcatataaaagtataaagctcattggtcaaagatagatataaaggaaaaacaacgggatattataatggtggtgggtaacttactcttcatcctggtatagaagttaaaaaaaaccacaagtattaaaataactgtaactataaaattattaatgaatacacaatgtaaaaatatgtaatttgtgatactgataacataccatgtgtggaggggagaagtcaaagtgtagagttttaaataagactgaggttaggtttttatcaccttaaaatagattgttataatatgtttgatttaagccccatggcaactacaaagaaaatacctacaggtaataaacaaaagaaaatgagaaagaaatgaaagtgtgtctcagtccatttttattttgctataactaaacatctgagactaggtcatttatagagaaaataaatttatttcctgcagttctggaggctgtgaagttcaagactgagttgctgcctctgttgaggggccttcttattgcatcataacatggcagaaggcatcacatgacaaaaaagcaacagcaagagccaaactggcttttatcataggcctagtttgtgacaccttacatagtcctatgaaaacacattaagccattagcccattaatccattaattcatgaatagattaatacatccatgtggggaaagccctcatgactcaaacctttctcaaaaaacccatctcttaatactgttacattagtattaagttttaacatgagtttcagagtctagaaatattcacaccatagcctttcacccatgacctcccataatttatgtccttatcatatgcaaataccttcattccattcccgtagccccaaagtcttaacctgttctagcaccaactctaaaatacgaagtcaagagtctcatctgagactcaaggcatgatccatccttgggcaggttccctttcagttgtgaaatcaaaacaagtcatataattctaaaatacagtgctggtacaggaataagacagacattcccttgtcgaaagggaaaataaactagaagaaggggttaatggtccccaagcaactctttaacacagcagggcacatattaaattgtaaagctaaagaatactcttttttgggtccatgttaagcattctctgcacaatgtggggaacacattgagccactctgcccctatggctttgctgtgctcagaacacacttcagctttctcagattggaattgctcattggtgcctgcagctttcccaggtgggcactgcacactgctggtgtttctataattctaggatctcaaaggcagctctggctctcaccccgtatttttactcaacattgctgtagtggggctctcagccatggctctgtccctgtgacaagtctctgcctgggtccccatgcttttagatacatcctctgaagtctaggtgaaggccatagtggccctacaactcttgcattctgtatccctgcagaattagcaccaggtggacactgccaaggcttatggcttttgctttctggagcagtgaggtaagctacacttggagcctcttgagccagttggagtggctgaggaatgatgcgctcacatgaagggagcagaggagtcctgagcagccctgggcagcaagctgtggagagtaccctgggcctgtcccctgaaactattctaccctccttggcccctgggcttttcatgagagggggcagtcttaaaaatatgcaaaatacttttcaaacattctcctcattgtcttaatgaataacatctgactcccttctatcagtgctaatctctttagcaagcagttttgctgtttacatggctaagcaagctgcaaacttttcaaatcattttgctgtgattccctttaattatacatctgtctttaagtcatgtttttgctcctgaattggccaaaagtaaccacacagccaaaagtagccaaacagcatcatgaatgctttgctccttaaaaatttcttctataagatattttactttattattgtcaagtctggccttctacacagccctagagtatggacacagttccagtaagctttttgctactttataccaagtatgacctttattccaggttctgataccttgttccccctttctgtctgaaacctcataacggccttcattgtctataagtttactagtattttggccataatcacttaaataatttataaaatgattcagactttccctagtcttctcatcctctgatccttcaccagaagcacccttaacactctatttacagcaatataagattttttttgcctgctcctccaaacccttccagcctttgtccattacccatttccaaagccacttgcacatttttaggttgagcatcagcctcacttcttgttaccaaagcctgtattagggttctccagagagacaaaaccaatgggatatacagaaggggatttgttagggaaattggctcacacagttatggagactgaaaagaccaaggtcaagggtacgtatctggtgagaatcttctcattgtatcataacatggcagatggcatcacatgctaaaagagcaagaacaatagccaaactggattttataacagacccactcttgacgactatcctattcctgtgataagccattaatctgtgaatccatgagtaaattaatctattcatgagggctctgcctctattgtcccttaaaggccccacttcttaatactgttacattggggatgaagtttcaatatgggtttcagaggagacaaacattcaaaccatagtgatgtcactacaaaaaaattaatgaaacacaaaggagtacagtaagagagcaaaatacagataaaagtgctatatgatatatagaaaacaataaaatggcaatagtaggagtttatctgtcagtagttactttagccataaatgaactaaactcaaacaaaagacaaagattagctgactggatttaaaaaatactatatgctgtctacaagaagtacaaggagcccactccaaatttgtagacacacataggataaaattaaaaggatggaagaaagtattccatgtgaatggtaaccagatgagagcagggctcattatacttatatcggacaaataaattgtaagtcaataattgtcacaaggaacaaagaaggacaatatgtaatattaaaagagtcaattcaccagaaagatataacaattttaaacatatatgtattcaatcttagggctttaaaatatataaacaaatattaatggaactgaagggagaaagacagcaatacaacaatagtaggagattttaattctcagctttctttttctagagacagagtctcactctgtcactcaggctggagggcaatggtacaatctcagctcactgcaatctccacttcccagactcaagtgattctcccacttcagcctgctgagtagctgggactgcagacatgcaacaccatacccagctaattttttaaccttttgtacagatgaagtctcgtatattgcccagctggtcttaaactcttgggctcaagtgatccttcacctgggcctcccaaagtgctgggattataggcatgagccaccgtgctcaggacccaactttcaaaaattgatagaacatccagacagaagatcaatgagaagcggattgaacaacgtagaccaaataagcctaacaaacatatgcagaaaattccatctaacagcaccagaatatgcattcttctaatgcacacacatatattatccagaatagatcatatgctgtgtcacaaaacatgttttaacaaatttaaaaatacagaaatcatatcaaatatcttttctgaacacagtggaatgaaactataaatcaattacaaaaggaaactggcaatttcaccaatatgtgtacattaaacaataaattcttgaacagtccatgggtcaaagaagaaattataagggatatttgaaatgtttcaagataaatgaaaatgtctcaagatgaaataaaaagacaacatatccaaatttatggaatgcaacaaaagtggcaagagttaagtttatagtggtaagtgactacattataaaagaaaaaagattttaagtaaacaacctaactttacacctcagaagtggaagaaggagaaaatactaagcctaatgttagcaaagaaaggaaataataaaaattagaaaaaataaattaaatagaaagtagaaaattactataataattaatgaaactaacagctgctttttaaagatcaataaaatttacaaacctttggctagaataactaagaaaaaagagagaagactcataaataatattgtaaataaaaaaggagctattgcaatcaaagaggcaggaacaataaagatttgcaggctattctgtataattatacactaacaaattggataacctagaagaaatgtataaattctcagaaatacacaacctaccaagactgaatcaagaagaaatacagaatctgaacagatctgtaactagtaaggagattaaatcaatgatcagaaacttcccaaaaaagaaaatcccaggatcagaaaacttcactggagaattctgccaacatttaatagaaaaaaaaatgccaattcttctcaaacttttgcaaaaaattgaagaggacgaagcatttcaaactcattttatgagtccagcattttcctgataccaaaatgagataaagatattacaacgaacacacacactttcaaacaagctacaggccactatctctgatgaatgtaaatgcaaaagttgtcaataaaaaatagcaaactgaattcaacagtgcattaaaaggatcacacactgtgaccaagttgaatttatctctggaatgatgaatggtttaacatatgaatatcaatcaatgtgatacactatattaacagaacaagggataagatcacatgataatctctataaatgctgaacaatcatttgacaaagtttaataccctttcgtaataaaaatactcaacaaactatgaatagaaggcatgtacctcaacacaataataaaggtcacatatcaaaagctaacagataacatcatactcaatggtaaaaactgaaagcttttcctccaagatcaggaactaggtaagaatgtccattcttgccatttctcatcaacgtattactagaagtctttgctagaacaattatgcaagaataagaaataaaaagcactgaaatcagcaaggaagagggaaaattatctctattcccagatataataatcttatatgtagaaaattctaaaaatcacacaaggaaactgttgcaactagtaagttcatcaaaattgcagaacataaaatcgaaatgcaaaaatcagttatgtttctatacaatagcagcaaactctctgaaaaagacattacaatcccacttacaatattatcaaaaatgactaaaatgtttagtaataagcttaaccaaggaggctaacgacttatacactgaaaaccataaaagcattaccaaaaaataattttaaaagacacaaataaatagaaagataattctgttttcatgggttagaaaactcgatattgttaaaatgtgcacactgctgaaagcaatttatagatcctatacaatcttaccaaaattatgatgtcatttttttcagaaatagaaaaaaaatctgagaaccatggatacttagaaaatctggagaaagaagagcaaagtagagggtctcatgcttcctgacttcaaaacatattccaaagccattgtaatagaaacagtttagcactggcataaagacagatatatgaacttacaaaccagcatagcgagcccagaaataagcccacacatacattgtaaaataatatacaaagcacaaagactatggacaggatagtctcttcaacaattgtgttgggaaaactagatagccatattcaaaggactgaaattagaccctactcaaaaaatcaagtcaaaatgaattaaaaattaaagatctgggccgggcgtggtggctcacgcctgtaatcccagcactttgggaggccaagggggtcagatcacgaggtcagaagatcgagaccatcctggctaacacagtgaaaccccgtctctactaaaaatacaaaaaattagccgggcgtggtggtgggcgcctgtagtcccaactactcaggaggctgaggcaggagaatggcgtgaacctcagaggcagagcttgcagtgaggtgagatcacgccactgcactccagcctgggggacagagcaagactccatctcaaaaaaaaaaaaaatacaagatctgaaactatgaaactcatagagaaaaacaggagaaaagttttataccattggttttggcaataatttcttgtatacgacaccaaagaacaggcagtaaaagcaacaaaaaatagataagtggaactacataaaattaaaaactgatgcacagaaaataaataaaaagaaaaaacagagtgtaaaagcaaaccatgaaatgggagagaatatttgcaaaccatatatctgataatgggttagtattcaaaatatataaggaacacctacaactcaatagcaaaaaactaacccaattaaaaatggacaatggacctgatggatatctctccaaagaagatgtaaaaacagccaacagatacatgaagagtgcttaacatcattagtaattagggaaatgcaaaccaaaccacatgagctatcatcttacacctggtaggatgaccattatgaaacaaaagaaagagaattaaaaaaaaaaaaagtgttgaaagggatgtggagaaactagaacctttgtacagccactgtgaaaaaatgtttggaagttcctcaaaaaaattaaaaataaaactatacgatccagtaatcccacttttagatacttttccaaaatatttgaaaacaggaactcaaagagatatttgcactctcatgtttattgtagccttatttacaatagtcaagaggtggaaacaaatgaaatatataatgacagatgattcaataaaatgtggcatgtacatatcatggaatattattcagcattacaaaagaagaaaatcttataatatgctgcaacatagacaaaccttgaggaccttatactaaataaaataaaccagtcacagaatgacaaatactgcatgaatatacttctatgaagtatctaaagtagtcagtcatagaagcaggaagcagaacggcagctgccaggtcctgggagtaagagtaagaggaaagttgcatttcagtgggtatagagtttaaagcatgcaagatgaaaaagctctaaagatctgatgtacaataatatgcatataatgaacaatattgtactgttcacttaaatatgtgttaggtccatgttatgtgatttttaccacatttttttgaaagcaagttgctaaagaatttgccaaatggaattatagtgacacgagttcaaataaaattaaaaaacgagaaacagtagagtttacttaatttgttaatatatccatattatcattttagggaatttttactaaagcagagtatataaactatctttttttgttctaatgatccatttgttttagtttgtttcccatttttatgtagctagactgccagttaatctcctaaaattattggcaccatatttcccattttttctggcttttttattagtaactgggatccttgcagctgtatctatgtgatgccaaacaattaggttgatcaattctgtgacaacaagccatctggttactttagtgaataggcccttacttacctttcataagttgattctattctcctttgtgccttctctttaaattaccattatcctgtaaccataaattaaaaatacagcatcgcttttaaaacatcctgaagtaatttttaacactacaaaagagaagaaatttcctttgtttggtgttctttgaccctaattagcatttaggaacaaactacacttgcaaaattattttcgattggtagagggaagaaaagggtctttttattactatgtatttgtaattacttttgtcacttatgttattcttgtgtctaaattcaactctagatttattctctgttgatattttttatcacttgagaatattttagtttttcaacctctatatggcgggctatcactccaaatttaggttaaactgtaggttgatttaaaaatctggctatgatgcagaaaaattcgggcaacttacctagaaaaaaaaaagtagttatatttcagtacttcttttacctaatcagccattttaaaataattttgttcattatcaatatggaggaaattatttatatgcagggaagttatttatatgcagagctgttaatggcagcaatctgcatgacaaatttctacttaataagcaatgaaatagttggataaatgtgtatttctacatgggtgaatttcccaaaattcacacttcaaagacagttgctgacattttttcaatgagagattttattagataatgagtcatcttagagttatcttgtaagtattctttagtcttaatttaaatttaaatgaaagtcaattcaaagtgttgtattttcttaaataaattttgttttataaacattagaaattaaataggactaccatatggtctagcaatcacacttctgggtatatatccaaagaaaatcagttcagtatgtcaaagagatgtttcgtattcattgcagctttattcacaatagccaagatatagaatcaatctaagtgcccatcaatggataaacgtagaaaacatgggctgggtgcggtggctcacgcctgtaatcgcagcactttgggaggccgaggcgggcagatcacgagatcaggagatccagaccatcctggctaacacggtgaaaccccatctccactaaaaaaaaatacaaaaaaaattagccgggcatggtggtgggcgcctgtagtcccagctacccgggaggctgaggcaggagaatggcgtgaacccgggaggcggagcttgcagtgagccgaggttgtgccactgaactccagcctgggctacagaacgagactccgtctcagttaaaaaaaaaaaaaggaaagaaaacgtggtatatatacacaatggaatactatttagccttttaaaagaaggaaaccctgtcatttgcaacaacatggatgaacctgaaaaacatgttaagaggaacaagtcaggcacaaatacttaatgatctcgcttatatgtgaaatctaaaaaagttgacttcatggaaatatagagtagaatggtgattatcgggtgctgggagttggggtaagatgtggttggggaaacggtcaaagaataaaaaatttcagttaaagaggaagaatacattcaagagatctattgtacatgttgaatatagttagtaacaatattttgtatcctcaaattgctaagagagtagattttaagtgtttttgacacaaaaactgataattatgtgaggtaatacattttttaattagctccctttagccattccacaatgtatacatcttttaaaacatcatgttgtacatgacaaatatatacaatttttatttgtcaacttaaaaaatattaaagatttaatgtagataaatgaaagaaaattaggaattaaggtacaaaaattatttatagtgtttattattggtctatgtttacatagtatttctttgtctccattagtgtgtcatacaaatacccaactagaaacatgactttacaaatggtgtatctgatcttttatgtccctagttattattttagccctgtctttttttttaataaaacatattctgctttttcttgtcctcatccttctatgagttgaattagtgactctactccaaagtaatggtgttgctttctcagaccatatggtgatacaaaggcatatgagttatcataagcatggtctgtgtaggcaaagcatgtaactccacaaatgcttcttgagagattctaatataatctgtgccagacctgcacaaggcatagagaataaaaatttgcaccccacacagtcactcctcattcattcattcaacaataatcaagtacctggtaatgctaatgcagtgtactataattccatatacataaactaatatttttaagatacatgaaggttatgttataactaatagtcaatgtatttttaaaattactgtaatcaaattgtaattgtaattaagtattttcttaatcaacagaaactaaaagtataatttccatcaactccttttaagtataaatgtaattaaatgcctggcacattcttcacattatataaggatctttatacttaagacatttgggaaaccctacttaggcttatcattgacaaaacattttcaaaatcttttcatttggtcctcaccacaatactgttaaaaagacagcctaagctgttttgtgcttcctccctagttgggcatccctgtgcaatgagagggacaaacaaggtggttttaaggtcagaaacatccaattgcagcatcattgggaaatttgtaagagcagcttttataaaatgtcaccaactcatgtatctttaaaagatgtgctgaatcttatgccttgagatttttcttagtttccttattttctattcccctcccactttctctttgtcccttggtggcttcattaatcccatattacaatacaaagtaaataatagtgctctgaagtgcttcctatttgttcaggatgaagtctgaaaaatgaaactgcaattttttttcttttgagacaaagtctcactctgttgcccaggctggagtgcaatggtaccatttcagctcactgcaacctccgactcccaagttcaagtgattctcctgcctcatcctccccagtacctgggattacaggcatgcaccaccacgcctggctaatttttgtatttttagtagagatggggtttcaccatgttggccagggtggtctcgagctcctaacctcagatgatctgcacaccttggcctcccaaagtgctgggattacaggtgtgagccactgagccctgccaaaaactgcaattttatcttaggggacaggtaagcataaaaacatccaaaatcatgtatttatgtttaggctctgcttgtagagtgataccaaattccaggtgttttttttttttttttttttttttgagacagagtctcgctctgtcgcccaggcctggagtgcagtggtgagatctcggctcactgaaagctccgcctcccgggttcacaccattctcctgcctcagcctcccgagtagctgggactacaggtgcccgccaccacgcccggctaattgtgattctttacattatcaaagaattcatgaaaacaggatatgaagattagtgaaggattcttttcattagcaaagtaacttttcttatttcaaatttaacacatctatttataaaagttatagaatttaaattttaaaatatgaatgaagaaaaacaaaatcagcataacatagtaatacatataattgatatgtactattctgttacttggattcattacttaacccttgcagtattctatgatttttttttaatccatgtgttacagttagggcttagaaagatttaagcacctagccaaaattatgcattatgttaagtggttgatatccacttattgacaaatatgtattgattgagaattagtcatggagatatcaatgggttattttgattactttttccattactcccaagtggtcaggattagttttagattatttaagtaggttggctgagttcacaaaagctattactatggggaccttaattgaaatctaactctatccaattctatttcttttccctatccctcgaatgggtgtatgtgtgtgtgtgtgtgtttgcacacataaaaacctgttctaattttatgcaacatggaaagcattaatgtttaacatgtatgtttgaacagggaattttgtactgcattaaagattattcctgtgtattacatacaatcaaatatttgactattgactgtcttagtatgttcatctaattgtttcctattcccatgaaaactgtatcagtctgagaacagctactatatgatatgcatcactagtctccccatggtgcataatacttgatataaattagatgctgttggttatacttggcggggggaaaggggacactaaaaaggaagagtcaatttctactgtgaacaaagcaaaaagcaaaaggagagataaatggaattaaattaaaaatgaaattgagagtgtagataaatctatgtaatgaagatgctagtaacataggaagagaaataagatagggtataacagtgattatttttcctaataagtagtgtcatggcagttggaagacaagagattatccaagcactggttatagtctgaaagatgaggtggtagcttacttgtttgggcctcaggcattgcagtacaaacagacagtgagggaggagtcaattaagacttatacaaatgcagaagtcatggttgaggtagtgagaggatttccaggacagtgatgaataacagaacctcagcagaaggagcatgtggacccaaagcatcatacgaataatgataggaccaagggaaaagaagtcaagcggaatggggatagacaaaagttttgaaatttatgtgtaagagttgaatgaagaaagttattaataagacttacacaacaaagaatttctacatagaagttgaaaagacagcaacagagtttagagtttaggaaaaaaaattaaatattaaattttaatatgtaatattgtaggatttgaataccttaaagctgaaattcagtttttgatgctgcttcttagcatctttgtcttgacatgtatatcaaaatgtaagaatgtctgtatcttacaatctgtgattcttgagaagtcaatgccatattattcactacattcattctttcttattggaaccataatactttcttcaataataatgtcagtagacattctaaataaataaaaaatatccaataacatgccccaatgtttcacaggtatcacaccaatagcccctgagatattgtcacattccatttatctgcagaagtcttattcaactttctgtattaagtaccaagaaatttcttaggcaattagtaagttcacttgtattcttaaaacttcacagaatgaaaaattaaaaattttaatctctttttctagaacaattgttttacaaagacttttcaaggttttttaatcctattttttgacaaaataacatattttaatgaaagtaaacatgtagaaatgacttaaccaaaactagctattgacaacttttcagcacttttttttgggtgaattcaggaacaaactttgtattcattttattaatccactaagtagggttgcttcacttccttggttactgtgcatgtggacgaggctgattttcatggtgggatgttaaaaggagggatttttgcaaatcaaaccacagaaccatcacctcacacttgttaggataacaaacattagcaaaaccaaagatgacaaatgctagcaaggatgtggagaaattggaactcctgtatatgctgacagaaatataaaatgatgcagccactataaaaattttttgtttttgagaatgtgtcttgctatgttgtccaagctggcatcaaactccaagactcaagtgatcctttcacctcagcctcctgaagagctggaactataggcatgaaccactgtgctggcttggaatatttttattttcctcaaaaaatcaaaaatagaatcaccatatgagccagcaattccatttttgggtatatatccaaaataatttaaatcaaaatgttgaagagatatctgcactctcacattcattgcagtagtcttcacaaaacaacctaaatgtccatccatggattaatgggtaaagaaaatatggtctacacatacaatggaatattattcagccttaaaaaagaagggtatctttctgaatgcaacatcatagatgaacctgcaggacgttatgctaggtggaataagccaggtatagaaggacaattattgcatgattctacttacattaggtatttgaaatagtcaaactcatggaaacagagactagaatggtagttgccaggggctgggaggaggcagaaatgaggaactgctgtccaatgagtatgtagtttgaattatgaaaaaatgaataggttctagagatctgctgtacaacattgtgcctacagttaatgatgcagtattatgcacttaaacatttatcaagagaggagatgccatgttgagtgctcttttcacaatgaaagtacagtaaaatgaaatgaaatatacagcaggctttacacacaccgcttcacaggcaaaaactacttgggaaacaaaatggaaggtccccagagtcgtgagggaagtaaggtatggtacagggtcaaaatggctgtacctggagctctctgactggtcaggcaccaaccagcaatactctcatgccttaattatagtttactgctgagataattgagaatgagagctcatatttactaaccaggatatgaatagactgagaactttaaataactttcctttaattccataaaaatctccattctgttttaaagtctttagtacagattttagatgtaataaactgctaagatttgagcaacaactataagcataataaatggtttgctttatgggcagttttacactaatgcctctaataataataacagtagcaataacaaaaatgacaggattcttaggacttcattactcagagcataatccctagaaagcagcagtcattatctaacccagaaactcccaagagtttgcttaacactttaaaatgtataatctaaattaaagaaaatatgagtaaatggtattgtttcccctgaattgaagtaatatgggatgtgttgaaagaatacatcaagacatttttcactgtcacctagcctgatgactgacatagattaattactacataaatttcctcttccatttaatactgataaacagatttatgggacttaaaccacagtacacagttttgtattttgtacgaaatggataatcacattttaaaacatgtgtaaggcatatttgcaaacttgaaacgtcgtcttccataaatatatgctgaacgaatgaattaatgaataaaaattgaggcaaaaactcaggtgtggctcagtcatctgaatgttattatccaatgaaacaggtcaaagatttttttttttttttacggttcatttctagccaataagaccaaggttcattcacttcacctctgtatagaatcctttgttgggggctgcgaggaggcagtaagaagtatcacatctaatcttttccataattagccaagttagttggtacttcccataactctgatacccataggcccttgctatttctagacttgagtgtcattcagaaatatggtttaggcgagcactaggaaagatacacagtttttctaaaacacattatccaatcaatattctacttataaaagtcaactacacacacttcagtcatgaggtaaaaaaatgaaatttatacataacactcacttatgtttatcactcacttatatttataataatagacatacaggtattctattaaaggaactttttaatgtttgaccagaaaaaatttcaatatccctttttattaagtttaagttactgtaatgaaattaaacatgtgaagggagactaatactctcttttaagagaagtaagaatgaaatatccatataaaatacactgcattattctctttgtttcaatggcaaatagaatcaaaaggaataacccactttatttaacggaatatctgaaagtgttccacttatttatttctaattttaactatggaaagtacttgcatttttttttaggaaagaaagccaagattttataaagtaaaaatctgctttgtgtgcctttccaaattagaagagaaatgtatcatcttaatacagcagattcagttattataaagacctactccatccaaaaaattgagtgaaataaaaagaaattgacttacttgttaaagagaaaagattgccaaggcttgcagacttgtgaggtggttaaataacaaactaaagactagcgaatatgagctattttgtttgacgtgccttccatttaataaatgctgtatcaatctagctgtttctctatttttaatcatacattttgttgttgctctaaatttaatcttaccttatacattgtataatagatgtcccttaaatacatcaaatttaacgtgttccaaagaaaactcataatctcctcatctccatccacctcactcctcctgctgtgatcagtctctccgtttttgttcattgtccatcatcttctacagaacagatgtgtcctaacccactttcctaaacacatttttgtatacaaaataatttcctttttttaatttcagaactctattctgacaaacatttggcttcaacctgtaattaaaaacttaacaatacttaatagttgcctcaaagagcatcccctctttgtcaatgtgagactatttacattaatttacatgtaattcagtttcatactcattcactggggtgtgaatattagtcaaacgggcaattaattaatacaatctttatatattcacttattaaaatgcaccacacaattcctaatttattgagagttctcactaaatctatgggatgtaaattttgaaacagctgcagctgtttatgccattgctcttgttgtccaatagagccaagtggacattcttttttgttgttgttctttccttgaatagagtcgaaattatgaatctaactttctccgacatgttgtctaaaaggatatcatcttaccttactcagtgtgagccctaaaactaggaaatgtttatcaatctctgattgcagatcaagtttaactatcaaatacagattaacttttcagcaaaaatttgttaaatattcagagatagaaatcttgatgttggatgacaaagatcacttgtgaagaactttattaagttttatttggttgaaaaatctataatttttagtgaacaactatcatccattatgttccaagctttgtgacaactgtttttatgtccattaaaacagtcctataaaataggtacaagtatctcaatcttatacatgtcaaaactaaagcacagagatgctaaataacttgactaaacaagatattgaaggtgaagtctgagatagatttttaactccgaagtgcataaactttacctctatattatctgtcttcaaaaagaatgattttaaagattaggcttttttatttcagaagaaaatatttttacacaattctagattcttaacagtaatttgaaggaatgaatgtctgatgattcaagaaaagtgaggtacattttaaaggaaaagtgacagacaaaaaatggatttttgaaaaatgaataaagctgctttttttttttttgatggtgtcttgctctgttgctcacgctggagtgcaatggtgcaatctcagctcactgcaatctccgcctctcggattctagtgattctcctgcctcggcatcccgagtagctgggattacaggcgcccaccaccagactcagctaattttctgtattttttagtaaacatggggttttaccatgttggccaggctggtctcaaactcctgacctcaggtgatccacccacctcggcttcccaaagtgctgggattaccggcatgagccaccacgcatggccaaagctggtttttaaaagggatcattgtacattattatcaaatttcatttgaacgtcaaaaattctgaggcaagaaggaaattgagcccaggagtttgagaccagcctggacaaaatggcaagaccccatctttacaaaaacaaaaataaaataacactagccaggcatggtggtgcacacctatagttgtagctacttgggaagctgaggtggaaggattacttgagtacagagaagaggttacaatgagggaggatcgtgccactgcactctagcctgggcaaaagagcaagaccctgtctctaaagaataacaaataaataaataaagtctggacaagcctaaaatcagtaatatttggggaatatgcaaatagtctttgctttatttactcaattattgaaactatattcaaaaataggaagtaaaacatgatttaatattatttagtaagttaaacatgttataataatttggaaatccatgtatgttagttaaatatacattactataaaatgtaaatcagtgtggtttgtagcagagacctggattttttatctttgtagtgtacctacaccatcacagaaaggtttgccatcagtctctagattaggtgcaaattcatttaatgtgatccatcctattatctaaaaggtcattctgttgttttcagccttcatctaagacactctcagatactatttcaggaatttatgacagcaaaatgatataaggtgacaaagtagaaataggtgctatgctgctttacctatattgagttattttcttctctccaggatcagatattaatgataaattctctaacatcaaaaaataaaacctaggtcatataaattttacacaatcaatgtcagtcactcagcaaccattgagaatctactatgtttagaatggaacacctgacttatagaaaaaaaggtaaaagattggttttgtaaaatgacacatacaatttaagaaaaaataggctatctatattagatagttaaaagaagattttaaaatacgataagaagagaggggagaaatggctagattaatttgaggattacctagtgttaaaataagtccagatttaaatcaagtttattaattctgaaaaagatcacatcctaaagaaggcatcaaattgacccataaatgtggataaaacttctgtaagataatgaaagccctagagagtaatgttcaactccattttctaattggcaacaaatgtataatatgggtacaccagaatatctaactcaaaaagtggggaaaaaaactcaaaaagtacgaaatgttggcaaaaatgcagacagctaggacactcataccagctggtaagtgtaaaaactagtactgcaccaagcactttagaaaacttaacggcagttatgtagtaatggtgatcatatgcatactctatgatagcaatttcactgttagatatataactaacagaaatttgcacatatgtgtcagaagacgtacataagaatgttagtaacagccctgtttacaatagccctgaattagaatgaaccaaaatttccatcaattgtagagtatttcaatgataatataatcacacactggaatgaaaatgatggaactactactaaacatacaacctggatcttacaaacataatcataagtgaaagaaattagacacaaaataacacataaatgttgattccacatagataaagttaaaaacagataacaattaatctatggtgttacaaatcagtatacggatttccttttgttggcaggggggatgttgttggagaggaaataggaagagagcttctggggtgccggtcatattgtacttctcagtctgaatagtagttacaagggtatgtacactctgctgtaatttgtccagtgatacatgatggtttgtacatttttatacatgtgtgataattcaataaaaatatctgaaaagctacaacagcagtggcaacaacaaagcccattaaccacaagaaataatcatgtaaattgttttcttcaaataaatgtgttgtaaataacttctctcactctttggcatatatttttgtcctcttttgatataccctaattttaggtttgtttaatttttcaaacatgtcctttatgtttaatacatttgaggaaatctgcttaagaaatgcttatctactccaacatcttatcaatgggaattttatttttttaactgtcaaatttagatctataagtaacctggaatttatgtttgtatatgatgtgatgtagaaatcaaatttttattttttctatgtagatatcaatttattcagtatcatttgtagaaaagatacttctttgataatgcagtacatggcacttttgtcatatgtcaagagtccttatatacgtaggtgtggatctcaactatttttgtttgttttgtttttgttttggatctcaatttttattctattcccttgatctacatttatatccttgtaccagtactatactgttttgtttactgacactttgtattaatatttgatagctaatgtaaatccttcaaatttgtttttccataatataatactgactaattttggcccattatatttttatataaattttgaaatcagcttgccagtctttaccaaaggaaagctagcattttaatttggaatgcattgaatccatatatcaattttagagaaaactcacagccttacaatacttattcttcgattccatgagtagggtatatccccctatccatttaggttatttttcatattcctcatattttacagtgcagaaatcatgtgtttctcattatttttttcctagatgttgaacatttattattctattgtcaatagtatcatctatttaaattgcattttctagttgtttttatttaatagaaacataattgattttgcatatatacattatattttatatatcaatttcatgtgctcttatgttacatattgttttatattcagcaagtgttactaaggtatttattaagattagtagtttatctggagattctttcacacttaataagtatgccctctgtggataatgataggttttatttaatcctttccaaacttcattattttatttatttttattgctttattacccttgctccagcacaatgctaaatagaaattaccataaaagactttgtgcacttactcctgatcactgagggaaagactatttatgtgaattagtatttgtagatattaacttttgagaatttagctgtcaatcccaatatgacaacttggaggtgatgcatttttttcttcctgctttaagatttttcctttcgtcactggtttttcagcagttttatgataatataagtgggtgtgattttctcttatatttatcctggttgaaatttatagcacttcttatatctacaaatatatacctttaattcgttttgaaaaattcttagataatgtatttgccttgccaatatctttttaaagattgcttttgtctcatgctacttctatacacacatattgagaatccaatcacaggtataatagaattttcaccatgtgttatgcacactcttctgcattttccttttttcctctctgttctttagcttggatattttctattagtttgtataatcctattagatggttttatctaatctttctttctgttaaatctctttgttgtgtttccagttcacatatttttaagttctataatttccttggactatttttctattttttatattctttataatatatctactttcttgacattattaattcaatcattttaaaatttctgaaatattttatgaaaaattgtagaaattattttatgttctagataatattatcttctttcacagagaatttgcttttgctttggccagcagctagtgttgggacagaaaaccactatcccgtcagtcactggaggctttggaagctgggcttcattctttaggagagcttgtctacttcagatttatccctatcagagttcataacttggagttacagctgaaagccagggttgtttacctacttgataggccttgaactccaattatcatcttatttttggttaggtactaaatttccggctcagcatctcatattatcagctttgttctctgtttctcttctcctgttcttagctagagtttgcaaattgccaaaaactttgagaagaaaagaggctaaatgccagagcatctccctcttgcattttctccaggatattggcctttgatgtcccttctgccttagtagctttccaatgtcttaaagaaatgtgtaacacttctggttgttttaggtgggaagtttgttctgcagtaagcttatctgccgttaccagaaatagaaactattttgtaatagtaaaacaaatgtatactttcgtactacaatatttagtacttcagagaacaattggcactttctggatattctcaaccaggagtatgtggttgaaactgcacagttttctggagatgatttaggttcttcccttcttactctaattctgtcactggttgatcttatccactccacaagctttaatcacaatttctattctgatgaatcccaaatatttacatgtaaagaaattatatcccctggagtatagaaccataaatctaaatgccaactgggtattgacactaggataactcacaggtgcttcaaaattacatatacaaagttgaatttctcatcttctatctactcttacaaagctacctcattatcctttatcccctagctcagtgagcatccccagctgtcaagcaatatacctgctaatcatcctcagttcttcttactctctcatcctcatatctaatccctcactaaggcctgatatttcaacctcgttattatttttggcattcacctttttccattttttggttaccaacttgctttcttggaattttaaaactgtcagtattaatctctctgcttgcaacataaagacatatattttccacatattccgcctaagtaatctttgaaaaatagtagtaagatattgccattctgttgcttaaaatctgtcagtaattttgtaattttccaattctccatagtctgtaggacaatatccaaatgttttaactgaatacacacacacagaaacacacacacacgctcacacacattttatgattcatactttgagtttaattgaaagatagaacatctataagatgaaaacagttgtagtcagagattctggtatgcaaagtaggagagagagccaagaactagaggtataactttgaattataatattgggttggtcttctatagatgagacataaagttgtgagagtcaataagaacaactaaagaaagataatgaaagaacaaaagacaagtggattaaagacagatatgcggtgaaagagaaaagcatttctacagaaaagacccccaaaataagttcattgcaggtagtaagatgaacagaagtcaaatgtcttggggaggatcggattggttgcttgtgtatgttaattaatgcaaaagggtcaaagagaaggactgactttatggccctgtagaactctgagaacagggtcaaaatccagatgcatttctaagacatcacactgggaacggggacttgtaatgagttatctacaaagtgtaaaaagatgtgggtgaccaaaaggttgtcatttcctccaaaacaaattttcctggagtgaaactgtaactaccaggtatagtcattaatagaactgcagacactaagactatggaaccttccgtcttcctaaccttttcctcaggccagccttaaaggcctgtgaagatctattaataacactgctgttttgttctctggcagctcttggtgccagaaggcttggtgccaatttgtggttgagcccctccttgggagaaatcatgccattcagagacagctgataagtcaagcctattttcccactttcttcactgtatttttcctgtctgaagaacttgtttatggatttgatttctgtagagataataatcacaggattcagtggtatagcattcctctatgcattttctccctgcacatttgtgtgtgtgaagatactctttctaaatccctttcaagacaaattattaattgtgatatattaattattctccactgtacctaacggttatcaacactacagaggcaccattggttgacaaaagtgagagcttttctcaacattaacataatgagcaagtggcaatgagaaaatatttgtccaattagagacttttatattttcttttcttgaggaaataaaacccgaaacacatttaagatacattgctgtttgtgcataggcggtaaatttttttttttttttttttttttgagacggagtctcactctgtcgcccaggctggagcacagtggcacgatctcggctcactgcaacccccgcctcccgggttcaagcgattctcccgccttagcctccggagtagctgggattacaggcgcataccaccatgcccagctaatttttgtatttttgtagagatggggtttcgccatgttggccaggccggtcttgaacacctgaccgcgggtgatccccccgcctcgttctcccaaagtgccgggattacaggtgtgagccaccgcgcccggccagtaaatagttttgaagttttatttaatcccagcactttgggaggccgaggcagggggatcacgaggtcagaagatctagaccatcctggctaacaccgtgaaaccccgtctctactaaaaatacaaaaaaattagccaggcgcggtggcgggcgcctgtagttccagctactcaggaggctgaggcaggagaatggcgtgaacccgggaggcggagcttgcagtgagccgagatagtgccactgcagttcggcctggacgaaagagcgagactccagctcaaaaaaaaaaaaaaaaaaaaaaaaaaagagttttattcatattcatattagataaccatttgggtggcacatttcacaacacagatgcacttcttaagagtcctccatccgtcagcgttgtaaaaaaggaagtggcacgtttgcatgtagttcttctgagacggagatttagggacaactttgccaaggtgtgtaggtggagaatgggagattgagacaggcatattggctcaggaagacaagggagtaaaactagcaatagaaaggagggccaatgccgtaacagtgtgatggagtgaaaacaagaaaaaggaaaatgcctcaggatttggtggagagtttgttttacctttttaagataatactcctggtcagcttcccaggttcttaagtctggatactgtaatgattttggatgactgcattccatgacctgtttcaaggtaggttttttgaaaataggagttaaatataggctttcttccctatgtattcagttgcgtttttttctttttcatttagaaatgttgttttatttcacgttctcttatttatatttaattgagatggtgttggccattttatccttctttttttttgttttcttttctttttttattttattattattatactttaagttttatagtacatgtgcacaatgtgcaggttagttacatatgtatacatgtgccatgctggtgtgctgcacccattaactcgtcatttagcattatgtatatctcccaatgctatccctccccctccccccaccccacaacagtccccagagtgtgatgttccccttcctgtgtccatgtgttctcattgttcaattcccacctatgagtgagaatatgcggtgtttggttttttgttcttgcgatagtttactgacattttatccttctttaaacattattttctatctagaaaatccaacttcaaataaatatactcagttctacattataaaaagtattacaatgaatttaatgcttaaaactcattccggaagtgacgatggaagcaggttcaaatgctttcactgacactttgtggcaaagtgtggaactacagtatatttttccaagttgtttcctgatatattttttatgtacataacaatcaataaattgttatgctatttatttatgtacttatatgtaaattaaacaaccaagaaatcgcaaagtgttttattaagatgatatctaaactgaaatatcacaacttactacaaataatactttgtttcaaaaataatttgaattgcatataaaaatcacagttgctgtgattaacattgcattgatatattggaactaaggtttttggaaaaattgtgttttctttcaatcttttaaaaaataccatatttataaaatgagtcattaagattatccctaggcattttcattctgtattgaaggtttttgagggacatcattattagttcaaagtgtgtttcacattttgtagtctgtcttactatggcaactaatttttttttttttttttttttttgtgagagggagcctcactctgtcgcccaggctggagtgcagtggtgaaatctcggctcactgcagcctccacctcccgggttcaagcgattctcctgcctcagcctcctgagtagctgggattacaggctcccaccaccaagcccagctaatttttgtattttttagtagagacaggatttcactatgttggccagtctggtctcgaactcctgatctcaggggatccacccacctcggcctcccaaagtgctgggattacaggcatgagccaccactcccagtcggcaactaatttttaaaattgtggtaaaatatacataatatacaattcaacaacttaatcagttttaagtgtatagttcaatgacattaagtatattcaccttatagtgcaaccatcgtcactatccacctccagaacatttaaaattttttaaaactgaaactcttcactcatggaacaataatgtctccttcccctcttctcctagcccctgggggaaaaaaaaatctactttctatctgtctgatatgattgctctgagtacctcatataagtggaatcatgtaatcattgtccctctctgtttttaccttattttaatataatcaaaactaaataaataagcaaattcttaaaataaaattgatatatttagtacagatccttttgagacactcagtggtccactaattatgtaccatatccaatcacatcacaatatcataaattttatagtcaattattagttggcatttcaaggcccaagtatatgtttaataagagacacaatcttacatatgcagtttacatgtttttaatctagtcttagcaccagcatatcaccttagtttacatttgtctaagtgcaagtattggttttggaatgtaattttgctcatatacaatctgtaagatactaaaacaaaagctagtttattataagtgaaataatggcaaaggccattttaaaaatattgtattattttcccatttgaaaatcagtttagtctttagcccacaaaataacaggaaaataacttaaatcataaaaactatatctgaatattatttaacatattttataaagatatccttctttggatcatggctgcagatgttttcatgcagcttgagccactttccatgtcttacggagaatgtgcaggagctatatatcatcagattctttcagagaaagaaccggtaagacaaatgacagtctgaaagataaaggaaaaaaataattgatatcttcttggcacctctgcatttcaaaaatactatttcaataaagtccatgttagaggtggaattcaagaattcactgaatctgcattcttgccttctgctatcctcttttgccctcatttgctcaattattcctcactcctggttaatgaaggcaggcttttaaatacagactaaccataaattgactttaatattggtgtttaatggttattcacagaactgatttaaaatgtggtatcaagttcaggtcctgggatttaccaaagttcatcagaggacacagtacatggcgaattgagaaccatagcctactttatgtctaagagaatattgacaaacagctaagttctctgtgagctctcagatttcactcaaaagaaatgaagaaagtaaattctctgtttagactttgtgccttttttctccttttaaagaatttgctcatcggaaaatataccataccaatggcagcaacatactataagtttatgagcaaatcaattccatccatagttactgcagaatgtattataggcagtatttttgttgggagaaaagcagcagaaacttagcaaagtaagggaaagagaaaaagcagcttataatgataaagagcctttgtgcccgtagagagataagaaaaaatacaaaagaaatccataatgatccacaataattttagaatgcaatttatggccatgaagggtacaacatgtgattgggtatcaaagaagaaagaagtcatgttaatttaggctaattaaaagatattttgtgaagcagaaagttttttattttgttggttgaccagttgattttggacagttttggatactatttaattggttaaaaagctattgaaatggagtatcaaccatttccagacagaggaatggcatgagtgatggtctgggcacggaatatgtttgacacacagtgaaatatcagattcactctgatgctctgtgtattttacgggaaacattataagggataaagggcaaaaattcaacagaaacccagttactattggccatctgagaattttgtactgtccaggagaaaagagagctctcattgaaatggaagagttaatacaacaagacattgtgcttgtctgtactcctatatattttatccattaaaggaattaatggattttatccattttatgacatttattattttatgacacttatccattaatgacattaatggataaaacatataggagtacagacaggcacaacgcatggggaaactattaggaggtcactgcaatactctagctaatggttacaacaatctgacattgggtatttgcaataggaatagaaagaatataatagaggaaagagatattttggagatttcaagcataattaatgggagaaaatggaagcttatacttcagagaagcacaaagtccagtgataagtttaagttgtataaatttagtgtgctctcaggagaaggtgatgtttactttgtacttttacaaccttgcacgggtgagtgggttactgaataaacaaataaatgtttgtgtaacacaaatttagagaatgtgcagttgtagatatatatgtagttctgaatagtccatttaaagacagatactaggttttcttccagggtttctagagtttcgggtcttacatttaagtctttaatccatcttcagttgctatttgtatatggtgagagatatgggtttagttttgttcttccgcatatggctaatccaattttcccagcaccatttattgagtaaggcgtccttccccagtgtctctttttgttgagtttgttgaagataaattgcctgtaggtatgtggttttatttctgggttttctattatgttctattgatctatatgtctatttttatactattaatagtatcatgctgtttgggttactataggcttatagcataatttgaagtcagttaatacgatacccacagctttgttcattttgcttaagattcatttgactatttgggcatagccacagtctttaaatatttgaatggacataatgtgaaaaccacacttaagatatgtttaaacggcacagtaatattatctaacacaaactcaaaattcaaatgtatccagttgtcccaatagctttctttataaatatctttttttctttttatttcttcttaggattgaaaggtaaatatcctagcatctacacaagggaaccgatgtgtgtgtgtatatatatatatatgtatatatatatacacacacacacacataggaatacatacatgtatatataccagtatacacatagaatacataggaagattttatatatatatatatatatatatatatatatatatatcttccccaaaagtgtgccttggcttttaaaaaagcttacaagatctcaaactgtcttaatagactgacagtaaccaaatcaatcatccttctcattgttgctctgagtagattgcacctggagaaatgattgcaggtatggatagctcacttagagctattactgataatctgaagtgtgttcagaataaaataaccagggtgatggggaatgaaaagcccataagtttcacatgatggattctgattatctttaggctggagaagcataggctagggaagtgggcatagctgttgttgttaaatacttgaatgaatgcctttttgatttgaattgtgtttctccaaaaatatatgattaagtcctaatgatcattactcagaatgtgaccttatttggaaatggggtcattgcagatgtaatttgatatggtaaagtcatattgcagtagggtgggcctttaatccaatatgactgggatccttatgagatgatggccatgtgaagatagaaacacagtagaatgtcatgcactgacaaaggcagaaattggagttatactgcacaagctaaagagcaccaaagattgcctgaaaaccacaagaaaataggaagagactaagaagaactttactacagctttcagagacaggacagccctgctgacaccttgatttgagagttctagctccagaactgtgagacaataagtttgtattgttttaagacaccaggcttatggtacttttttacagcagccttagaaaacaaatacaatgtacatatataggtaaagcttattcattcagttccaagaaataattaggatcttgtaagcagaaacgaagggaaaacagaacatgaacaagaacttgctagtaattaaagccactgcaaaatgaactcaagggctccagcaggttttaaattacctggtattataaatgttcaagcaggatgaatcagagatggtgcagaggtgattattcatgcatcagatggaaggttagactgaataatctccaagtgaaaaaattatatgatcctatcttaaagccctgtcaaatagaggttggtagcttccttttcattttctgcttcaatcaagaggatatatggatgatatagcttggtggataacacttaaattgaagacctagtacttagttttacttttacttactctagtacttaatttttcttaggtaggccccttaacttctctctccttattttcccacctgttaaacagagatattaatgctattcacttcctagtgttattatgatgaaactagttaataatttaaaaaatgcttagaacaaggcacagcacatagtaatgactaaagaaagaagtgcttttgaacatatatttgctctactattgtctagattgtctagatataatgcattaagtcttcccaccagtgccattgctcgtgtccaaaatacagagttaaaagattagaaataattgcatgttttctaagagtcctgcgcattttcctagatccaatattgtactatttggacaatttattgaccaagtaccagaaatataatatttttgccaattttctcataacaaactgtgataatgtgtatgtcaactgctagggtgggtttgtgtgtgtgtgaatatgtgtgtgtgtgtgtttcaagtgtttatagaaaataaatcactcaatggcataattttcaaataataaagactacagttaccctgattaaggttcacctgagttttggatattaccacgtgagagttagaggacaatgtgaagttttcaaaattaaatcctctgaaatccaggtatcttgttaaattgacatctgttggtagctgacagccaatttcagcttcaggaactagtaagaacattttccagcttatgaaactattaataaatgttacataattgtccaaagaaatcctcattcagtgattcaaatttaacaaaattaggttttatttattcgctatgtaaagatactaatccctgcattatttgggtgcatgggtgacagctctgacaggtttgtgatgccccagacaaattcagtaactttcagtgaagcaaacccatgaatagatgtgatggcagcgtgtacacctatataattccagagctagtgattatgtaacttttatatacgtcagaccgaaggaagacagagaatggaggaactgggtgttctttcagtaaagagcaactgaatgagacagtacatcttttgaactggggatatactacaaggcaatgagggaggctggctatgaaagtattgaaaaatatgtttgattgctgggtgatgtttagaggccctaaggtaatagaaaggagacaaaattgagagtctggaacttatatgtactttattacagtactctcattttcaccaaagaaggcaacccatgtggtgaaaagaccacaagcattggagctaaagccaagttatagctgtagttttatattttgtgagcccatatgtcctcagacaagttttgtgagttaatttcctttgtctcagcttcctcttttataaaatgtgggtgatatcattgtcccttaagattgttgtcagcattaaacaacataagtatatgaaccatctagctcggtatttggcaatggtaggagctgaataattgttagctcttaccttaaaaaattatttgttaaaagttccaaatgcagggttcaggagaagatatgggtcaaggtcatggatgaggcaaacactacaattcaataaaaattgttagttcttaatttatcttaactcagcaaccgtttcttgagactctactacatattgagtactgagggaatagaaagatgaatcaaagaccattttaaaacatctggcatttgcaattcaaaatcaagtaaaaataaatacagccttatgatttattgagaaatgtcatgcaaggtaaatgaactgattttaagcatgtacttagcattcacacagattgacagattcagtgaaaacacggcacagccttcaattatttttctttttaaatacatatttgtggactttatagaaatactgacagtgtttcctcaccaatacctattttctttgttgagtgcctattcctttttcttttcaaattagtttgtgtggcagtgtggaagaaccaccacatgaggacggtaaccaactacttcatagtcaatctttctctggctgatgtgctcgtgaccatcacctgccttccagccacactggtcgtggatatcactgagacctggttttttggacagtccctttgcaaagtgattccttatctacaggtaattgtttttaatgcttttttgaagctactaaaaagaatgttcagccatagcgatggcccttatggtaaattaactagtgagttgagaaatatatttgcctaaggcattgacaaactgaaggaaaataatacttgagaatttctggagaaataagttaagttctgggtaaaaattaagcaatgaactgccaaatcatcattagatgctgcacaaacatttttgcacaacttttttgattactaatttgattccaaaagtttgattttgcacaaactttttttattccaaatttgatcccaaaagtttgattttgcgcaaacttttttgattcctaatttccccattgttaaataagaaacttgaaccaattaatgatttaaccaattaatgatctccccaaaccaattattgatctttctcttgaaccaattaatgatctgccagtccaagtcattgagcatatttgtttttacaagtgattttattttatactgaagaattaagacctacttggtcaaatcagtgccatgaacaggttttagtgtagattctaattcaaactaccggatttggaatctccgttctgccattcaccaattgtatgctatcaagccaaatagttgtaattcacttatttaaaagaataatttaaatgagatctacctcatatggttgctgtgaccatttacttacataattcatataaataagttggcacagtgattaccctctggaagagatgatcttataaaaacagtatattctcaataaacatcaattatcagcatcagaatcatcattactaggtgtttttctttccttaagagtgaaaacagcttctttttctatttaattgccatttcagtaattaagaatgaatactttcagagattagtgttctgattgttattatagctctaaaatttttgaaacaaaagattcatcagataatgttcacattcactcatccatcctaaaagatggatttcccttaggaattggacagcaaatgaaatggtgaccactctctgcttgtcttcccatagctttcctgcaccctcagtttttacgccatgcagtctcccagatggtgcctataatattttaagaaaacagaaaataagctcccagtaacaaaaaattagggaggggtcacaaatagcctattactagacattatgccgattaggcttttggaatgaaatgttgcaaagagatatttagttcaatagttcctcaattacctcttataaaaagaagtgaaaaatttttaaggttaaacattgtttatagaatagtaagtggaaaatactatagaagttataagctccatgcatatattatgtttaattataaagctagtttggatcagcctgctgaaaatcatgaatggattacaaaacgaacagtagcacatttttttgtgtgtgaggaaaaactacatgggacaatagagaaaaatattctcatagaggaaaagttagtaagaaatgaatggctctggtggtgtttgcatagaggcactaggaaagtaatacatttcagataattctaatatttcattatctctgtggtacttccagaaagccttttacctctcttggtttcaataactacccaggagaatattttgaggattctcttaagttttgggatggctgcagttgcccagaatcttcaactgactggtaacatttcatgttctctctgtgaaacagaagattccctggtgggaagtgaagtgataagggcaggtgcagtcatgtgctaatgcacagcgatagctttctgcagagcaggcatctcagagtttcctgtgagtatttgcattagaggacagaatggaagcagtgtaaccagtgagtgatgcagagcatgggtatctcttataatcacttacagtcctctttcacacagcagaactatttaacaagtcctacagttcaaggaatatcctcatctctggaaggattctgtctgcctctctgcacacagtgtccaatctaatcaattccttagctgctcctcttctccatagagcaagggaaaaaactactgggtaaccacatgatgcaaaagactagatccatttgttaccccatctaacattacttcttgatggaaaggtgtaaatgcaccaagagattggtgcacaggtaaaactagtatctccaaattcttcatatttattgcctcatttttcatagaatgttcccaaatgcaatgaacagtgccaatgggcaataaacatataatttaaatttgagcagattttctccctagttgtgacattctgtaactaatgacttatatccctgatatgatatttatgtcttactgaatatttaaaaacatgttacatcatgcccagccacattttaaagttatttggttgcattttagattacttggacgtttattaatttgctataatttatatgttctttttcttctaaatacaatacagcctttagatttatgagtgatatgctgtaacgcattggcaaatgcacaaaaatctcaaaagtctcacaaatgttataaagcttagctgaataattaaaatgactcttttgtatctttaataattgcataactccaagaccattaacatgtattcagctatttgctgaacaattatcatgtatttcacttctcttccaacaatgacaagagcattggttactttttcagagtgattttttttaactgcagaagacgccctacacagaaaatgccagaaaaaaaagaagccaagtgagatgtgggaggtgggcagtgggtggtcaaacaagctccctctctttcagtcatactttgaaacctttctacctattagtgcttatcatccaaatctgtgatttggcaaaattttcatttctccttatagtgaatctttaagatacctttgccgtatctatttgctagtataaaacagtggacttctctactaaaggaaatccccaaacattatcctgtgcgaagggtgcccatagtataggtcaaagaccaagtacctgaaggcagaagaaagttcccattatctcactccacttcattctcaacattcataatccacactagattcatttctcaaatgacttactattcaacaaacttgagctaatatcagaatccaaatgaaaaagacacccagaagtgcactcttagaagttaaaagcaacaacaaaactttcacttataattacttatgataaaatgcaattttacatcacctccaagaaaatcttatacattgcacataattgtatattaatgtgttaattgcacaagcaaatatagtaggtcaaacaatgaatattagctcactgattgtcaagggttcattcaatggattggttcattctactgttagatacatcacactagcatattcctcccttttctgtgtgatgaagggcagtgctccctgggtcactattggcactggatgtcagtcttccaagtgaactgatatgaattgattattatgacctaatggcattaggaaacactagaaatgacattgatatttgaaccatgctacatctatcccatttatccatgttgattaaattaatggattataaattactaaggcttgatgaacactttgtacttctaattgctagagaggattgatatatctctagcccagaagctatgaaaaggcgactgtgcgaatctatacaaccatagttctattcccaggttagcaatggtattgaggggccctaggtgcttaacttatttgcagagaaggaatggaggttgtagagaataaggtgatactggtttgagaaagagagttgaaggtaccctcaggtagcactaagaaatttctaggagtcactaatcaacttaagcccattctcatagagtccagccccttaaaattacacttaaaatgaaattagcctccaataatttagcaaaggttaggctttcacttgtaatttctatgaatattcttctctgaaaagcaatctgttccaattaaaatatagaacttcagactcaagaatgaaagataaaactaatagtatcatcatcattattattattataatcataagaaatagtaaacacacagcacttatatgccagccctggaatagacattttcatctcaactaactgtccatacaattccatggttaggtactattaatcatccacattttacagatgagaaaactgaggaatggagaggttaaataatctccttaagatcactccatatgtcagatgggattcatgcccagaaaacctggttgcagactcgattccagctatactcttctgcctctcccatagagaaacaaaagaatcatacttgataagaatcttatcctgttgatttacttcatttagcacacacacacacacacacacacgcaacacacaacacacaacacacacattaggcctaaagctgtaaagtgagtgactcaatagtgtgcagctagctgatcagagagagagaacagatagttcatcctgacagcccagagactttctgcactgttgcactggatcttagatctctttcactcatttgtacctataatcaacatatcaacaagaaaggtcctcatgtaaaagacagagataactaccctttccacatattatgagatcaatataaccaggacagaaaaatagaagaagatgactggactatatctactgccttcaattaaggctcaccactattaatggattaacaaatatttgttttaaagacacatgcaagtatacgttcactgcagcactattcacaataacaaaaacgtggaatcaacctaaatgcccatcaatgatagactggataaagataatgtggtacatatacaccatggaatactatgcaaccataaaaaagaatgagatcatgtcctttgcagcaacatgaaaggtgctggaggccattatccttagcaaacaaatgcaggaacagaaaagcaaatactacatgttctcatttataaatgggagctaaatgatgagaacacatggacacataaaggggaacaacacgcactggggcctttcagagggtagagggtgggagaagggagaggatcaggaaaaataaccagtggatacttggattaatacctgggtgatgaaataatctgtacagcaaacacccatgacagacatttatctatgtaacaaacctgctcatgtacccctgaaattaaaatagaagttaaaaacaaaatatttcttaaatgcataatggatatcaaatgttgtatcagatattggggacacagttgtgaaaaaaacagaagcagtccctcctaccacagagctttgttccaatagagaaaacagatgataaataagcaaattaagcaaataatttactacattatacatgctgaaagaaaaataaataacaatctgtaaaaaaaaatgtaaaagaaatcagaagtctttttaaagggagaggggattctgagagtgatatcagaatcaatatttcatccagtataagagagcacattgaacataattacattaactaataatgtggatatatgaatttttaaaattttttgttgttgttatttccttaaagtgtcaagttaaagaatgatttgtggcattgttaattatatacaaattttgactgggtgaacttacctagtttttggaatcacattgactaggctagcagtgagcaaactgtcataaggagattcgcatacaaaattctcttttaatatgactcgtaactttccttgggtgctacatgttgaaaatgcactgatgtacaaatagcccttattatttgaaaatatgaaataagctacccataatttaaaaatgttaattaaatataatttcaatcaaatttctatgtggtaatttagaagaaagacatattattctttataattgaggcttttccagtttggactaaacatatgtgtttttttttttctatatgagggtatgatttcttccaatcaatggaaaaattacaggacaaaataattacagtaattatttaaagaatgccatattataaattaagacatttggagtaaaaaaagattgcaaagttttcatcataccttttcatgtttaacaataaatttacatttaaaagtatatttctaatatttcatttttgtgatataatttctttttaaatagaaagcacttgcatggattgtttatttttggcagctttgaatttgcttatatgttgtgactacctttctcatatagtaaatatattaagagtaattcttttaacagctggtgcttctctattactatgatctttcttttctctagaccgtgtcggtgtctgtgtctgtcctcacactgagctgtatcgccttggatcggtggtatgcaatctgtcaccctttgatgtttaagagcacagcaaagcgggcccgtaacagcattgtcatcatctggattgtctcctgcattataatgattcctcaggccatcgtcatggagtgcagcaccgtgttcccaggcttagccaataaaaccaccctctttacggtgtgtgatgagcgctggggtggtaagtaccttatggcccatcaactgacatttatattacagcagcaaattgaaaattggattagcatagccattgtaaagctgggcttatatattttattgacatttgtgaatacagttttgcaagagcatgaaaaccaacttgaatttcaaaacaatttcacagaataactctacctatctgaatcctttggaaatgttatctattattttctcattttcatatcttttggataggaaatgaaaggagattattctacaattcagatttgattattttagtttttcttaaactctttaaacaaaaagcaatatggaatacaaatccgattatgtattctggaatgatccacgatttataagatggttcaacactgtgttgtctagtgtcagggtccctaatgggcttcaaatacaactgaattttttcattttaagaccatgtcctggatcacatggtcctgggaacatggccagagtcagcatgtggttctctaagtcaaataatccaaatttgttttctctattcataatacattattgctactcgcataattattatccagtttaagaattatattaattatgaatcaatctggtttcccatctgacaagtatgatgtgaaatttaagcaatcaggtttgaaggctttatgtttctttggttagaaattcttagagtcagtctgaggtttttgtgtaacagtgagaatactgctatcaacacctggtgctagcacaaatctgggcacaggaaagaatgacagaaaataaaataaccctgcatttcagcatagcatgcactgattccaatatatcatatgaaatatatatttaaaaaaaaaccaatctgacctcttctaggtaagtatactaaaatggctgatatttagagaattcatatgttaacattgttttttattagaaagatgtatcaaaacaagcagtgcacaccagggactgattaaggataatattcttaaatattgtaatctttgaatttctgttatttcctaccttggtgtttgtactagaacaccgaaaggaaaaaaagccaatcactgatatattaggcatatactacaggatatatctacagcaagataatatttaagagaggctgggattatttcatatattgttgcaagacctataataactaaaattttataatttgctttatctattaccccaaatatcaaatatctgtcttttattgggatttacttttcctttttaacattccaacttttttttgctgtatttttctctgtatcattttcagttttttccaattttccaaattaatagtgcagacaaaaaaaaaatcaatggaaatttccaaaatggtaggaatatttatgaagtgtcttatgtcccattcatttaatgctcaaacaccaccttgagaacttagtatatgtcaggcattgtgcccacctggagagaaacagactctgcttacgggagcacactctatataataaggctcaaaggccaataaacaaatttttatagggtaatcagtattttaatatatttatatacaaaatgctgagaacacaaatgagagaacaaactcagttctggccatttgaacaaaagtttacagaggaactgctaacattccagcagaacattaaagataagcaaaaattctccagactgagaagagggaaaaggatgtccagaaagcaagaaaatccacatcatggatactacattacaaagcagaaagagtgaatcagcacttgtagtttctggaacataggggcagatagtgtaaataattgaattttgaaacaagatgggttggggactgactgtgacatgtctcttatacgatccttttacactggtttatatttagaaagcctaaaaaggtctttctcagaatcctgtattaaactcgagactaaatttaaccctagaaagattatattattttttcaagattatgaagcaaataggtacatttaaatctaaagcttccaacttgtaagttgggattccttaagttttatagggattgctattagataaaatataaaaatatttttcaatatgtgtcagcagtattttctctaatattccggcaattagtttcacttatatgtttatgggttgcttttataagcttttctttttttaatgtttccctgaataatcaagtaacagtaacctccattaacaaaaagattgcaaagtcatggattcctgttcagttattatgattatgtaaatagacgtatgatttttaaattacctctgagtggtaaatataaatacataaagctcatttctactctgatattttattacataactctagcatggacattttcattaaaaaaaggaaacaattgttgaatatgtaaaaacctaaacttagccttcagaagtcatttaagaaaactatttgaaggtgattttataatagcctataattaaatgcttgtaaagactaaaattaagtattattggactgaattgattagctacaaaatccaacttagtaaaagctatacagtcatttaaatattaaatgaaattgctaagaatatttttaagaaaaaataattcaaggcagatttttatctttcttattagatatttattatgatgatttctacatagcatgtaaaatcattgttcatgtaaactatttataagtccatgttcgacttataatgttaaacctttgtatatgtgtgattgtcacaactttttaaaaaaccataggaaagtatattttacagtgtcatctctctaaattcaaatatttttaaaggccaactgtcatttagcctgatttttaaaactattgtaaaatatcttctatttgagattaattcataatctgtgtttcttatctttattctaagttaaatcaataatgtagttataaaagtagagagtagaatcataattatcctacaaccaatgtggcagtggaaaaaaatttggaaaagcaatttggtcagttgatacatatctatcaaataacttttggaaaagttctgtaaatgctgttttactcatggtgcaaaataactgagaactctgtctaactaaaaaatttaccagcaatatgtaattatatatggataaatgatttctaaaactaattatattcattattgcctattacttcttcataaaaagaaccataagccatgatttctggcagacacacacaacactcaagaacatataaataatgtaaatacttattttaataacctttaaaatatacatttgtatgtgttcactgtttgcttcagtcacatcatttcatacttctaaaattattaaattaacccacaatttcttgcttgcttggtttgtaaatgcatagttctacaggaaagatcctacagaaagaaattctttgctgggtgtggtggctcaagcctgtaatcccagcactttgggaggccgagatgggcggatcatgaggtcaggagttggagaccagcctggccaacatggtgaaaccccgtctctactgaaaacacaaaaattagctgggcatggtggtgggcgcctgtaattccagctactcgggaagctgaggcaggacaatcgcttgaaaccgaaaggcggaggttgcagtgagccgagatcatggcactgcactccagcctgggcaaaagagcaagacaccatcttcaaaaagagagaaaataactctttttgtacactcaatcaaagttatattttcttcactattcattcatccagtgtttaattagcatgtacccttggtcaattgttctggacactggagattagtagcatctctctttttgaatattactgacaaattgttctttggtaggctaaaaaaaaaaaaatggaaccatttttacagtcaaagtaattatggcatctggcctattatgaggtttgaaagcatataaatatgtgtataagtctattaatgggaagatttattaaacatatttattagggagaagatagtaaaacatattaaagattcaggtaaacttaatgaacccctaaactttgaaaagacattccatgttgaatattgggaaattatatttaatttacttgttcattcaattcctgataagtgtaccatgaaagaggaatgtttctagtttctagataattaagataacatgctggctgaataatgaaccttaagtcatctgagagaaattaagttttgcctgtcaaatatacaatataactctttaatctctgatttcaaagactaaagatccacatttgttccttattagttagtttcatatatatatatataaaatttatttagattgtgcttattcatcagttgagtaaaaacagtaatttttaatgattatcaatatttaaaacttttttaaattaaagtaatgcttatgtgaaacaaattttgtgtagttatattctaggttatatacaaatgtcttaaatacattgaagacattgcttatgaagtacagaaagacttcaaagatattttcatcacacataatttaaaatttcaatggcatatctgagtttttaatcagcttagactatcatgtttccctagttatctattataatctccttattcaaacaatctatcctaccctggaaggataattttgcttgatcttttttccatatcagtgttcattataataatttgcatttagcagtcaattacatattttttctaattattcataaatataccaaccacataggagcttttgctaccatctattcaaaacgccaaactgttatcacagtgatgctatccatagctgcagtggaaaaaatttacctctcaaatctactttcctctatccactcaattggtcttatgcagacaacagggcttcgcaggtatgtaagcttcaaagttatatagattttgtcatgaggaaagctcatgtgacacctcttcaaaacaaataaaagttcaaagcctcttaggtgcctgggaagtgctgagatcactttcagattcctttgaaattggcccgccatatgctgtgtaggctgtggcacttcaaagggaaagactgttatttctcaagtcagaatgcttgaatgttatcactttttatgtaactggcctgctttacaggatcaacttgaaagaaagttggaaactgatgaggtaggtgagtgctacctgggccagagagtagctaaaaatgacacctcaaattggtctcttagacctgccaacacatgcatcctactgaccctgctgaagactgcagcggataaagacatctaaaccaaaagagaagatgggtttagaagcatgaatatggagaaaattagactcaaactcaactgcatctgaaagacagcctatggaaataagattgtggaggatattaaactcataaatatgttaaaatatatccagcaagaatcaaatgcatgattgctcaataaatattatctattattatgacaatcatcatgcttattattgattaatcctgactgtaaactgctcttatcacaaatctgatcacataaccaagctttcatgcttctacatcccctttatgaagtaatgaaaagaataaaatacatagaggtaatagcattattcctcaacaatactatgggataaacccccttgtcaatagaaaagtcaaaacaaagtatgtaaattttagaagaaaaacaaaacagctctgttgtgttagcattcaattagaattataatgagttaattacatttaatatctatggaatctatgcaagatatattgcttcctcttttacattgcagtaaaagtaggtagaccattgtgatatattcgaatacaagtacaaaaatatcttctaaaatctacagggaactcaaacaaatcaggaagaaaaaatgcaaacaatcttatcaaaagttggctaagaacatgaatagacaattctcaaaagaaggtatacaaatagccaacaagcatatgaaaaaatgttcagtatcactaagaatcagggaaatgcaaatcaaaaccacaatgcaataccacttttttttttattttttattttattttttgatggagcctcgcactgtcgcccaggctggagtgcagtggcatgatctcagctctctgcgacctccacctcccaagttcaaacgatactcctgccttggtctcccaaagtactgggattacagacgtgagcctgtaattggtgtctggccaataccaccttactcttacaaggatggccataatcaaaaagccaaaaaattaaggacattggaatgaatgtggtggagagggaacacttttacactgctggtgggaatgtaagctagtacgacaactatggaaaacagtgtggagattccttaaagaactaaaagtagatctactatttgatccatcaatctccctactctggtagctacccagaggaaaataagccattatactaaaaagatacctgcacatgcatgtttacagcagcacaattcgcaaatggaaaaatatagaaccagcccaaatgcccatcaatcaatgagggaataaaaatatgtggtatgtatatagcatagaatactacttagccataaaaaggaacgaaataatggcattcccagcaacctggagggatttggagaccattattctaagtgaagtaattcaggaatggaaaaccaaacaacatatgttctcactcataagtgggaggatgcaaaggcataagaatgataaaatggacttcaggtactcaggggaaagtgagggagagggggtgaaggataaaagaccacagattgggtaaagtgtacactgcatgggtgatagatgcaccaaaatctcagaaatcaccactgaagattcatgtaaccaaacaccaactgtttccccaaaacctatcggaataaaaaattaaaaaaatacatacatacaaaaattcagattcccgacataatatataaatatatattatatgttatatataatattatatataaatatataatgtattatagttatatataatattatatataaatatataatgtattatatgttatatataatattacatataaatatctattaatatatattatttatattatatctaaatatataatatataacttattattatatattataatataacttatatattatatataatatatataatataatataacttattatatattatatatttatatataaataaaatatgtactatattaatatatgaatatatctaatattaatatacaatatataaatttataaatatataatgattatatattatataatatataaaatatatattatgtagggaatctgaatttatttatgtatttatgtacatatataaggtagggaatatatatatatgtattaggtagggaatatatatatatatatatatatcttctagagcatttacaaagttagtaatcaatataatttagaaaagctaaaatattaaaccacaatgccatgaagtgattaatcgacttattcgtaagtgtctaatctgtgatgtgtatcatttgtgtacataggattaattataaataaaaaattactacagtcctagaggtgtttatgcttaataagtgagaaaatattcatattggattggagaaaataaatgttataaagccttaaaattctcatttttattaaaagtatatacatgtatttttaataaaagcatacacacaccacagacatactatgcttaaagaggaattttgtatatgttccaataagtcaacaaaaataatcattgtcaaatttgtattgtatttagttttcaaaatttttttcacatttgtatttggagatacaactgagaatagcctcccatttctcagggaacttacattctaataaggaacaaccaactgagtttatattttcttcccattttaaccaaagcattagtttttaggttttcattgattcatgtccctttttgtaaataaaagtttagaacaacccaaattaattttgttaattagccagatgtaatcaagtcaaataaagggccttttaataactgaacacttgactttgggtagcacaaattaagaaatagctaatgcttatttttctgagtacattaagtgaaattacgacttcacatttggcatgtgtatacccatatactgagtaaaataagttgttaaatattatgaattatttttcccctttgcatacataatatgacaatgaaatcatataaaaggtaaatatgcactttgaagaaaagcattgacatgtatcttttttaaaagtccatcaattgtaacgtaaggttttgttgttttgactttcatcctaggtgaaatttatcccaagatgtaccacatctgtttctttctggtgacatacatggcaccactgtgtctcatggtgttggcttatctgcaaatatttcgcaaactctggtgtcgacaggtatatagtttcaaatattttgcgtgcattattcctccacacataatttgttatttgttattccttccaaatattttgtctgtgctttttttttaggatgcacttataaacaaaatttaagaatgcattgaaccaatataacatgttcataaaagtattatattgtgtgttcttttaaagtaatgagaacccagacatagaaatatgtctaggcatttttagagtaatattcaggaaatgtattttataaactgattaagtactttacattttaaataaaatttaacatctgtgattaattgtcttttgtctaggaataacactaatttcgctttctatgagaaatagcaaataaaaattcctttagagatttttgagactctaagtctgaaaggttatatttgtaatcagatttatttaaaacattggaacatataggttaaatctccaacttcaaagatcttattttttagaatattataagaatcaggcagaatgtataattttaaaaactgtatataatgctgatttggggttactacactttgttagataattctgctgtatcagtgaatgtttgtattcattcactcagttattcattcctgaaatacatatcatgaacttttcacatacatgtctcacacaaaagctaaaaattctactttttgccattgaggaattcatagtctagaggaggggcatcatcagatgcagggcgaaaattactttaaatataagcacagagaatcagagcaaaatgtactaaaaccatatctaatacaggaaaggtaacatttaacttaaaccttgatgatttgaaggatattaccaacaaacacatttagtggtttgtaagatagagacaaaaaggatatggctcagtctctcccattttgtaaaatgtatcttaaaatgccacaattcttagagatgtatttctctcgttctctaaacttactgccgatacttactttatcaggcttgtggaaggacatgccattagtctgttttctctgacacattttatccaactgaaaagatttactggagtcaccttaattcattaaaaagatttcacaaacactttatttggtctttgaggatgtgtctttgtttttttaatcaacacttgttattcaaagcatttttcaagatcatctttcactgactggatatgagcaacactcattttttttaacactatatggctcataatttcaatattttctcttttcctctgctattacaaagaagtcatttcttttatgaccttacaagtgaaaccagtagcaacatttattaacattttgtttcccatcattttttactataaaaactaatgtggaccactataaaatatgagtggtgattttctagatgttggtgacagttttctcagcactctccacctccctatgaagccaatgcttatattttagggtgtttgttactgcagcatcctgcttcctagtacctattattgtatctgtcaggttttgctaggttattattcttctattaaaaaatgtggtttgcaacaacagttctgtttcactcctattacaggtcagtggggagggctggctggggcactgtgctccatttgttttctcattccagaacctagtctgaagaaatggcactttctgggacatggcattctgagactgagagaaaaagaaaactggaagaaaagtatattttcttttaatgtcttttatgaaccggcatgtgttacatctcacttttcattggctaaaacaagtcacgtggttaaacttgatcatgaagaggggacacattcttctctgacagaaagacatcacacatcacagggtaatggggagcttcctacaagctggggatgaatgatctggaatgatacactatacagaagtcaaaaacacaagggccagactgcatgaatttaaatcctgactccaccaagtagtagtgacatgaattttgtaaatggcttaaatttttgtgactccctttattaactttaaaatggggttgtatagcatcttcctcataggtttggtacatgcattcaggtgtgtccaagggagagaacaccgtcgtgggttctcagtttctatttctatttgggccagtaaaaccccttcctatccctcttttctgcttattactagagacagaaactaaaaaccagggcttcaggctgctaaaagcctaaaacaaaacaaaacaaaactacaacaacaaaataaggtgggttggacaagcttgcttagatgaattaactcaagtgcctaaatatagacagtgctcattaaacaaaatatcttaatggatgttgtttaataatggcctctcaactaattgtacttacatttaaatagcaagcatgtgttgaattggtatatgtgactattttttaaaaaatgcacattgaaataccagtatggtgcttcttatttgtctggttcttctactctactaagataaagatagtctcgctgtcatctttgtatccctataaatagcacatgctcagcacacatcagttgcttttttcataagaacaaagtgagtagaataggagaaagtgctgggaaagtttagagaggacatagagaatctattgcccagttactccgataaacatttgtagaaatggattagaatctgaaaaatttcttgaaggggaaaaagcaattaatgagcatgtaggaataaagatattttagatttagattcagattttgttggggaatgttcagtgttaagattatcccctatttccttatttttactagttagtgtgcattgtataaaaggtatgcttataatttcttattcatttatttacaaattgacatacctttaaaactctttcaaggttgcaatgtatctgtcttgttacttttacatggtaaaactttaccatgataccatggttaccctaaagtttacatggtaccatcagagaaaatgttttaaaaagtttgttaaatgaatgagtgacaccaaaatccaaacattttaattttccaccatttaagcatatagtttgacatttcccaaactctaaaataaattttaaaataaattgcatcacagattcataaataatccacattcttttcatgaattatcctcattagtacaagccacatgattcagaagatttgcagtaaaatgcttgggctgtgaaactaaagtcatttacaaaacagattggaatggaaaataccaagttcagctgaactcactttagcagccacaataaagtgaattaaccccaaatgcgtgattacatagaattctgcttgagcaactctcaatttccaactgttagtgtctataaacaaagttgtaaggcattatgcgtgccataggctacatcaagtgagccatcaaatgaagagcttgtcctatttgcttaaaattacagagatgcatgaaatctgttatgtacttttgaattagtaagtgtaagattattagtgagcaaattgtgtgtccttgtctgactttctcaagaagtttaagcctcattaaaagaattagctaatgcattgctgtgaactacttaaattctctctctctctgtttttttttttttttttggcaattcgactcagagtactcaggaaattctacagattatttgctaaaacttatttttttaaagaacttagcttgcttgactctttcatttatctgtcagcattttttctagttcagacccttcatataattcaacactaaatcttaatcgtcatgtgcttgtgttaatttatttcacatttattaagcacgtactctgtgtcagctatggtgtgaggtactgaggatggactgtaatagatatttgggtctgaaactatagttcagcttttcagggcctttgaaagaccttcttgttcccagctcttatcacaaagttttctgctgctctttattcagcactcttctaagggaacttaagataaataatatttgatgatgacaaatcagtctagtgtgagaaaataggcagcaaacaaattacaattgcaggggcagaatcaggaaggcagtaactcgagtccatacaaaaaaaaataaggagcaccagtaaaggtaactacataggtaaatactgtagacagaataaacatatttatcttctgttatctgatgtaaagaacaactgcataaaataatagctataaaattgtgaagattcaccttataatgtatacagatgtagttcaaaaaaggaggaggaaatggagctgtattggagcaaatttgttttatactattgaaattacattggcataatctaagcagcttgtttagattaagttgctaattttaattcctggtgtaaccactaagaaaataattttttgaagaatgtagaaatataggtaaagtaacaaaagaattaaaatagtatacagaaaatatttaacacaaaataaagcagtagtgaggaaatagaggaagacaagagatacaatatatataagtcacaaatagtaaaatggcagatatatattatattttcttaataattagattaaatgtaaatggatacaatacttcaatcaaagggcatagattgacataatagataaaaaccaaccaataatttaaaaaaacccatgatccaactttatgctgtctacaagagacataccttgtattcagatatacaaataggttaaatgtaaaataacagaagtagtactaaaataatcacaaaaagggagttaatgtggttatactaaaattagacaaaataaattttaacaaaatattactatacatagagagggacatttcataatgatgatggagttgatccatcaggaagatataaaagttgtaaacatacatgcatttagccactgaaacccaaaatataccaagcaaaaagtagtagaattaaggagacaagtaggcagctagacaattatagttgaaaatgttaatactcacttgtagtaatggatagaaaacacaggcagggtgcggtggctcacccctgtaatcccagcactttgggaggctgaggcgggtggatcacgaggtcagaagattgagaccatcctagctaacatggtgaaacctcgtctctactaaagatacaaaaaattagccgggtgaggtggggggcacctgtagtcctagctgctcaggaggctgaggcaggagaatggcgtgaacccggggggtggagcctgcagtgaacagagatcgtgccactgcactccagcctgggcaacagcaagactccgtctcaaaaaaaaaaaaaaaaaaagaaataaagaaaaaacaggcagaatagcaacaaggaaataaaagatttaaacaaactatgaaaccactgggcttaacagatattttagaacactccaccaaaaacagaagaatgcatatttatcccatttgcacataaaacattttccaggttttctgactaaagtcagaaacaagacaagtatgtctgctacaaccattttcattcaatgttgaacagaactgattcttttcagggcaaacaggcaagagataatattaacaataataaaaaataaaaggcatgacgatcacaaaataagaggtaaactatttctacttgtaggttatgtgatattttatatagaaaatcctaacgaattattttgcaaaaaaatacattagaacaaataaatgagttcagctagttttcaggatgaaagattaatatatatacaaaaatcaatttcatttttatacattagcaaataaaaatttaaaatgaaattaacaaaaaataatttaaatagcatcaaaattaatcaaatacctagaagtagatttaataaaagaagcttaataagagacttcatccaggcttgattgcttatgcctgtaatctcaacacttttgggagactgaggcgggaggatcacatgaggccaggagatcaagaccagcatagtcaacgtggtgaaaccatgtttctactaaaaacacaaaaatgagccaggcatggtggtgcagtgcaagactataatcccagctactcaggaagctgaggcatgagaatcatttgagcctcagaggtggaggctgcagtgagctaagactgcaccactgcactccagcctgtgtggcagagttagactcttgtcaaaacaaaaaaaattcttcagcataaacatgtatatttagggaatgtccagaaattatagagacatggattccatgcagcagttataattccctaaaaagagaattatgaattcactgtattgctgaggattctaacataaccaccaaagatccagggagaaaattaccctatttttgtatttaaaaagatgcatttattaaatgatgtggtactagtctctatataggcaacaaaaataatgaaaaggaaatagctctggattattaaaaataaatagtctgttaatcaaatcaattaaatagataatgttccttcaacattttcaagtcctatacatgaatatcatttacaatcataattattagcaacttcaatgagtaggccacagttatacaagtttcttgagtcagtttggaactatttccattcaagcaacatatagtccatttctgtaacattttgttctccatcattatattcagtctcagaaaggttaccaacacagtccttgaatcacatgtagtacaggttaagcatctctaatcccaaaacctaaaattctagctgctctaaaatcccaaacttttgagagctaacatgatgccagaagtggaaaagtcccctgctatctcatgtgacaggtcgtgtcaaaagtcaacaaaaactttgtttcatgcccaaaattattaaaaatgttatataaatttgtttaaagactatttgtattgggtgtttataaaatgtaagtaagttttgggtttagacttaagtcacatctacaagatatctttttatgtatatgaaaataatccaaaatccaaaaaaactcacatctgaaacacttttggtctcaagaatttcagataagggatattcaatcggtacacaacatatacacctacaattacaaaatatcattgaaaaaacttaaagaaggactacctaaattaaaagatattctgtgtttatggattggaagattcaatcttgttaaaatagaaataatcttcaaattaatccatgaattcaatacaattcctatgaaaatcccagatggctttgtattttggacacaaattgacaaactgatcctaatattaatgtggaaatgcaagggatagagaagagccaaaataatcttgaaaaagaaatggaaaacttacttcctaatgtcaaatcttaacaaaaagccacagtaactaagacggtgtggtacttccatacagttagtcatatagatcagtggaatagaattcatggtccagaaataaactcatatttatgattaattgagtattgataaaggttttaacacagttcaatggcaaaaatcatagtcctgacaacaaatggtgttaagacaattgtatatccacaagcaaaaggatggagttgaacctcacctcacaccacattcaaaacttaactcaaaatgaatcatagatttatatgtaagagctaatctcttagaagaaaacacagaagaaaatcatcatgaccttggcttaaccaataggttctaaatatgacaccaaaaccaaaagcaacaaatgacaatgtagatacattagacattatcaaaacaaaaacttttgtgcttcaaactgcaccattaaaaacgttaaaagtcagcccatataaatgcagaaaatatttgcaaatcatatatgtgttaaggaatttgtatccagaatatacaaagaactcttatgaattaataatttaaaaaaattacaagtaggcaaagacttgaataaacaattctgcaaagaagatatacaaatggtcaataagcacataagaaggtgcttaacatcattactcattagagaaatattaatcaaaatcatgagaaacctattcacactcaacaggatagatttgttttaaaaggctgtaatcattattggtaaggatgtggagtaattggaatccttctacattgttggtgggaatgcaaaacgatgtaactgctttggaaaacagtttggtagttccttaaaatcttagagaattaccacattacccactaattcaatctctagttatagacccagagaactgaagacatgtttacacaaaaacttacacatgaatgttcataacagcatataattcatagtagccaaaaagtggaaacaacccaaatgttatcaatgagtaaatggaataactcattgttctatatgcaagcaataaaatattattcagctactaaaagaaatgaagcactgatatatgccacaagattgatgaatcttgaaaacatactaagtgaaagaagccaggcacagaaggccacatattacataattctatttgcatgaaaatgttgagaataggcaaatatatagagccaaaataatttgtccttggcacgggctggcagaatgggacaatgagaagtgactgctaatggatttggagcctcatttggaggtgatgaaaatgttctagattagttagtgatgatgtgatagttgcacaactctgtgaatattctaaaaatcattttttgaaccccttaaagcagtgaggtttatggtatgtgaattatatcgcaataaaatgttttcttttaaaaagaaagaacaaaaatgatgggatattttaaaattttaaaaattgaagactttttttttttttagaaagttctgctgctgaaaccacagggaagcaaaaaaggttgaacacacaatttgacatgttaatgtaatgagagactataataggaattatccacgggttgttttatctgtactttctgactaaagtttttttccgtacttctatagactttaaaatggtccatagatgtgcaaaaaatgagagaacctattccatgaaaccatatatcaagtcccagagagcagagggaaaacctttttttttttttttttttgcaaagaagaagtcatagactgtgtgaaagaataatgttgcgagacaacagatctggagttggacaggggcaggaggcatagtgagaagatcagttattgcagttgtcatccataagggccatctgtacactctgaaagtggagctattcatagtgagaatgatgttaagaaaaggaacaaataaaattacagtcctcgttataagaatttagcatgcaaatcttatcagagcagtactgaggtaaacaaaaagtgtcaagaaatcatgggatttaatgtgaaaaactccctcagtgttggaatacagtcatcttcatatggtggtgggtgtaaggggcaaggaaaattttcatggtccctgctgaacagggaaatgtaaggggattattgtttcatagaagaccgccagtgcctaccaaatatctgttatactctattatgatgaaatgggtaataggttaaggaataccataaggggaaaggagacttgtcctacaagtttcttagcacttagcaaatggagcaggcatttgctatgcattaaaaaataagcatcatccaaactctcagactcatccagccacaaacttaactttttgttcctcctcctcccagataaaattctcgacttatttccatttgtcatctttttctcactaaccgccacctccactgatgtctcagcccacttcagtgtagcttcagctttcatcattacagtgaaacagcttacatgaaagttaccaatgatttctaaagaatatatatttttaaagtttatttattgatcttttggcagcattaagcaatgttgtttgtggtttcattgctcatatactttcttcctactttgatttgaatactttttgctttgaatacttacctttccttccctgaccagtaaatgccactttgctaggtctcttcacagctccatgctttttttcaggtagtcccttgcccaggtactttttaagtgaggtgagtatcaaatatatatacacatcagactagtcctctgggatacacacaatcacaaatacacttaaacactcaatgtacctttattataaatcttgaaatgagtttttataagtcttgcaaccaaagtttaaaaaagaataaattctttttttaaattgctttggctattccaggtcttttgcactttcataaaaaattaaaattagtactttcatttccagaaaaaagactgtcgtggtattgaacgtgattaattgcattaactctatagatcaatttggggagaattgccatattaacaatactaagccttttaatgcatgtccacaatgaatatatttatttaggagttctttattatctctctgcaatgtttcatcattttcagtatatatatatatatataatgaaatatatatacttatacatatattttatgaaatatatatacttatatatatattttatgaaatatatatacttatatatatattttatgaaatgtatgcctaaaacacattcttttgatattgaaacttttaaaatttaattttccatttattgctagtatgtagaagtataattgatttttttgtttattgatttaatgacctgctccttgctaaattcttttataagttctagtgggtttttggtagattctttaggatgatctttgtaagcaataatttcttctcaatagaaccaatctgtaggcattttatttatttttcttttcttcttgtattggctcaaagtccagtacaatgttgagtacgagtggtgagagaagacttgattttttgagtggtaagccaacactgcattgctagaataaatctgattgagcaaatggtattatcctatttatatattgcaggatttaatttgataacatatttttaaagagatttttatctctattcatgaaggatatttagttgttagctgtcttttgttgccatatctttgattacaaagataaatgtgacctcatgaaatttgttggaacatattatattttctgtacatttcattaaaagtctgaacaagattggaattatttattctttactgtttgattgaattcattaatggacctatctgggcctggagattttcttgtagcatagtttgtaagtacagagtcagttttggtcatctttgtctttcaagggctttgtccatttcatgtaagttggcaaattcattgtttattcataatgtttttaatgtttgtagcatgtttgcctcttcctcataactttatcctggtcacaaacattttttaagacagagtaggttttaaggtccatcatgtacatgctatttccaattcataactgtggtaatacatttttcagggtgtatttttgcattaaatatgatttataaagtttattcataatagtgaaataaaagtggggtgcatgtattttacttaatccttctcagtgcctgcttgattgaaacctctgagatttacaataatgtacttttagggatgcattaaggattactagtgcatagttcctggagctcagtaatgtcagttattcctcttaattttatacggagtttctctgaattctccatgtctctagacagcttatcaatggagaaatttatgtgtcctcaaaatgaatgcaggattcagcatcttctatccttatttagatcattatctaaaaagggcatcactacattttttttttcccgatttcagggaccatagctttctctttatgaaaactgtattttttttttttttttgagatggagttttgctcttgttgcccaggctggagtgtaattgtgtgatctcatcggctcattgcaacatccacctcctgggttcaagcgattctcctgcctcagcctcctgagtagctgggattacaggcatgtgccaccacgcccagctaattttgtatttttagtagaggcggggtttcttcatgttggtcaggctggtcatgaactcccaacctcaggtgaccgaaaactgtttctaatggcggcagaagtcatcagatgcagaatgtagattctctccttcaggggaacagtcagtgatagaatcactaaaatttaattgatctatcagagatcatttagaagacagttcaagatcatttagcagacacatacaggcttttcatgataggagtctcctggaacattccagcatccattgctcattcttttcagttattttttaaaattgctttttaaaatgagagtcacagaagagaaagttcctatctctccccaaccagtgggttaaaagattgagttgaaccactactatgtaaaaaagattgtctacatgacaagacatacagagtgagaagaaaaataatttatccgatattttccattcaagggcaggtctttgttaacatcatttgcctcttcaagaaagaaaatggtcaaaggaaatgtcatattaatttatctgtgtggacatataagtaaaattctgttctcaaattaaagattatcgaacagactttgatctggtggtgtaaaaagcaacaaaatctatcgaacatctattctgagaaaccacaaggacacattggtcagtactggtttgccgcacagagacagaaagtaaaagctgaataatcttaacagagctaaggtggccttttcttgtgtttgttggcacattttcctctttaaaaaattatgcatgctgaattttattgttctgttcactaaaccctatcaatcttcatgagcttacaattaagagaatattgtacttggagggattccctgctattatcaaataactttgaaaagaaatggaaaagtacaagttgtgtaattactgttacaaattccagctatttgaaatattaatgtaagaccgcaaaaaatcctcaatgggtttgtgtgcattttaaagggctggaccacaaaactgatttcaaacaatttcataactacaaatagtgaacaacaaaaaatacttgattttttaaaaatatcctttcattcaaaggtttgctttgtccgaactcgagaagcagaaaacctgaaaagctacaggtagttaagttctatctctctggcagcagatggcagtattgatgcgtgaaaaatccataacaggttgcttgacgttacttgctgggttttcctctgctttaaactttggtatctgagctgaacaaaaattcctaataagataatatggctgacatccctttatcattctcctttcccaagctttgttctttttacaaggaaatatcttttccacttgcagctttctttagacattgacaaaattttgatgttttaacttttttttccacacaaactcctatttggtattcgtctgaattaacgccaagcacatactaaggtcagcaaatgctctggagaaacaggcgctcaaacctcccacacctcaggcgtctggaagcctttccttactgtgttttctaattacttccccaaagtggaactttcctaagtcaaattgcaataagggtctgtctcttctcctttcagatccctggaacatcatctgtagttcagagaaaatggaagcccctgcagcctgtttcacagcctcgagggccaggacagccaacgaagtcccggatgagcgctgtggcggctgaaataaagcagatccgagccagaaggaaaacagcccggatgttgatgattgtgcttttggtatttgcaatttgctatctaccaattagcatcctcaatgtgctaaagaggtaaaacttatctgttatttgaaaatgaaatagcctgccttttcttgattcttaattaactttttttttttttttaactaagccagagaaaaatctaaactttctgcttagataccttgtcaggccagatgactcagttatgttgttaccagcaggtaaggcgaacagcctttaagagtgctcagacatgtgcttttgtcatgcgtattctcagttgcatggcagacataaaacagatgtttctccaatctcttcaagctagttgctaaaccttagatgcagacaaagttctaatgcgtaacaactcatttacagcttgcagttctttcttgatgagaacaaacgggtttttcaaaacttcgtttccaaaaacataggcaattgtgagagaattatatcttaaggataaaaagagataagaaccttatgttagtattctaattatacttaaaagtgcattggcgagcactttttaaaaaaagccatcaaggcagatatgtatgtcgaatgtctaaacagaagaattcatttcctgaagtcactgaatgaagctcagggcagatagtaataaaaatcaatgagggaaagtatgctatttgctacaatgcaggcacaactattaagttaaaaattttgacccatgacatgagcagcagatgcagaggcagtggtacacactaaacttcatggccagccaactttattgggaattatcgaaactgttccacatagactggtcccaaggcaataccaattcttgtttacaacaggcttcgaacttaagctagaattgctcctctcactttggcctgattcagaatcaatattatattcctcacagctgggaactctgaagaacagcagctttggctggagtcagaagaagtggtataatcagccgcaaagggttctcattctctttggcccctgtttttgatggtttaacggctttttcaatggagaagaaatggagaacaaacttctgttcagtgatactatttactacagtcacagccttaaagatatatgattttttttgtggcctgggtccttgagacatatgccagctcacaagaaaatagaaattattttgccctccatatctttttgtgctttgcttcttattaattattattattattattattattattatttttgctaacagaaatttaatacaaatttattatggccacctgctagatactctcttctgcttttaagaactttataaacatgttatgttactggatgggttttattctttctttctctttctaatcttttttctcttttagtcagtctaaattcaatgaaaattggatttacctctctctgggttacgtatttggatttcctgtatctcagaacttgctctttccttttatttccaactactttttttgtcaataatatatgtcttattcttctgactcaaatcccttcctttccaaggaaaacaaataactttcaaaggagcaaggctgtgttaaatttaagatatttcaagttttggggcattctactcttttccacaacataaaaacttttgaaaaaaagaacttgaaaattgtttttcttgttaccacacacattttttttcaaatgcttatatttatttatccttgcatatgaaatttgttttttctttctcccacaaaaaccattcctagctttttctccttaaaacttaactttttgccgaattagtcaaaagcaatttctttacaacagttcaggtttgtccaagatttcaaagacattttgaggtaaagggtcataacatagtacaaatttcttttgtccgtattatttcactctatatagtatttttgtaaaactctagtactctttataccagaaatggtataaggtacaccttataccagaaatgcattgttgtcatgccttcttgctgtaacacacacacacacacacacacacacacacacactgatacagacaatcgaagatggagactttagcaggaaatatatatgatttttggcctataatcttattgagtagctgtaagttatctgttataggttagtgattagaatttatagatggaatatttctaagtatggagaaaattttttaatagtctttaaggatagcataacaaaacattttttaaagtttaaaataatacatgaaaaattaacactcattaatttttaaaaattaccaaaattctgcccatcgagaactgtttcttctctgggtattaaggagtcccagaaggcaagtttcagatagtccaggaagattggagttgaaggcatatgatactttgatcaatacataaatgaaagtaggaagaagtacttgaagactatcatttaggagtgatttttaaatgatacacataatagaatattaatacaacattattcaattgtatttagaaagaaaatgaaataaagaagatatatattcaacttccatattcttatttacaagaaatactgcatctgctatttgtgggagggagagacccttctctgacctgatttggcttttgatttattgattgtgctgtggaggttctgttcaggcactgaagttattctaaaccaattatggggtcagaaaccaatctgtggtcaattcctgcaactgaagaggacaggagtcagaccatcctctaccaatagccttgttcacctttgaatttaattatttaaaagacacttttctgttgtttcttttcctgcagagtatttgggatgtttgcccatactgaagacagagagactgtgtatgcctggtttaccttttcacactggcttgtatatgccaatagtgctgcgaatccaattatttataattttctcagtggtgagttttcaactgttcttccataagccacaattgtaaccaaggatgaggaatcaatgaacactcttcaactatatgaggagtttagttgctatgtgagttgtattttttccctgacctgatttatcttgagtttcttctcttttgaggcaaagtatttgttactgaactcatcagagaaaatgaactgatttttccatgtcaaacgtataagaaatgttataatagaagaaaagtaaacattctgagaaatcaataacacaaaatcttacatgacatactttaaactcatgatttacaaaaatataaaatactttgttctgttttgccttgctatattattcctttgccaaaatgtgtagcctaattgagacagaattgggatctattcacttttagatattttactatatttacgtttctcttgtgagtatcatctcttggatttatctcaatatttcccactgactaccaaaaatagtattactccaaaataacacataagttaaatgatacacacatacatatatgtgtaacttatacaatttgtatctgtttatggaatcaatataattataaaagtcatttaaatcactattgtttattcacattttgcccgactgacttttagaattatgttttaattagctacctttttacattgccttaatctccaactcattggcgatttctttgttatttctatcttcaaatatatggtgattttatgtggaagaatagaaattcattttgtggcatatttaataaagcttctgcatcttccaacttgatctttggccttctggtttgcataggtttaaaaaaaaggcaacaaattagattgatgagaaataattttgttctatttaaaaaaaaatctagcacaatgactaaagctctgaacctcgcactaagcaggtaaaggctatgaggaagttgtaatgagaagtgtttgaagcagaagtcacagaaccaggtcaaagtcctagtatggaggataaaagtgagttagaggaggcaactgataatcactgataactcattatgtgactgctattgtgctgggcccgtgaacattcatcttctcatttaatcactgataactcagtgcgtagctgaggctaagagagaagaaatgattcgcaatactgccattcacactaataaaagtgattcattcattctcatagttctccaatatctcctccataatttaaagacaaggaatagcttctacagtatttttcccccttcagtttttgttctttcttatatagattatgaaactgaaaattttctggatatttgagtgtatgtttctaggtattttgtggatttaattgtttcagtatcagttatttagagtaaaatgcaggagtaatttttgtataattttggctttgtatgacataagtttcattgtgtttaattattaaatatctctgagagttcttctactgatgatcacttccattatagttatgtagataaaatataccaatatgcgtaaatatatgaggtttgactataaaggaatgaagcaaattccaagccccatatgtgaaaggcagcctcgttattttatgaaaatattcattgtttcaagagtctaccaagcttccaataaactcaatttccttattctattttacccatctttgcaaaatattacacctcattgttagtttggctcaagggagcaactcagttgtaccctattcataatttgttgaagcatttatgtataattccttttcctttcattctctctgtttgccaggaaaatttcgagaggaatttaaagctgcgttttcttgctgttgccttggagttcaccatcgccaggaggatcggctcaccaggggacgaactagcacagagagccggaagtccttgaccactcaaatcagcaactttgataacatatcaaaactttctgagcaagttgtgctcactagcataagcacactcccagcagccaatggagcaggaccacttcaaaactggtagaatatttattcatatgacaaggatacctgagtaaaactatcctttttaaaatcactgggaacagaaattttattatcctatgatgtgaagctaaaattacttgtggatcttttttttttttaatctattgctctttggaaataaaaaaaaagtcagtttaaaatgatttctcaacttttgatttaaatatgttagaagtttaaccttcaattgagcttatttcaggctatttcacttttagtttcatgtattaaaatgtgtcaattaaatgtttaaacatttctaattctttttataatcccttgttattttaatctctcacattcagattggttcctaaaaattaccagaatctatccaatgattttttttgctactaaaagaagtagcaattactaattctgaattaacaatagacatgttagttgacttaatagtttttttaaaaaaaatcacaagactgttgttataatgtgatatctgagaaaatatttatatataaaatagcatattgtgttaggtaattcaaaaactatcttacaaaactatatactcactcatttacacaattttctcaggtttgcaaattgaccattgctaacatttcttgtctcaacatatggccagtaagactctatcacagtaaaagttttaacgtaatttccatctctaacactttaacatttaagaataagctaaatcacatcattatattcttttaacaacaacaacaaaaagtgatatagtcagccttgctggattaaattaaaaatgcaccactgtgctaggtgctagggaatgagatggcgtcgatgcaaacatgccttcaaaagagcttcagtctagtgagggagacatgttgacagagtgcaaggcagcaaacaatctgggggacaattcttggtcatggcagagcagtgaagctaccaaggacagtggtcttcaccagaaagtttgtagcgcagttgcactttttttttttcttcaatttaattacaatgacagttgatgtcagtggattccatctgggcctggggctgagtaccaggtggttaaaaaatagaggggcttgctcttaactcacacatacatgaatagactatcgtatattttgtagaaaatgtaagatctgggagtcaaagcactgagtattcaaacttattcccctgaaaaattcttctgattcaaatatttacttgaaaattaaactaaaagtaaaagaagtgtttatgaaagatgattttcatctcctattatggtaacaggtgttctgattgtattgaaacaaaagatatggggcacagtgtttaagaaaaactttcatagaaaattaatttttgttattttttcatttttccattacactcagagaaaagtaaaagagcctaattatccacaacttgttttcaaatcttggaatttgggattctgttaccttgtgccttttatgactcaaagcaaaaactatcttcttatacaaggtttattgagatcatattgtaaaatatcagcactatatcagtgaaagcaaggtattttaactctctcctttctcccctttgtatattttagaacttcttttcttatttatgctgcatgaaaggagagttgtaattttcggatcgtgatgacagcactttaaaaagtttgaggataacttcaaataacgttgataatatgccttaatagccagtaatagctcagaggaagagtaaattccttagacccaaatatacctacttataatttaaaagagagaaaagggagagagattgagagggaaagggggagagaaggaaaaaactgactcagagagcagcagttatgtgacgtatgggaagtcagaattcctttgctctaaatcagtgattctcaaaatgtggtttctataccatcggcatcagcatcatctgggaacttagtggacatgctaacttccaccctatccctcacctacttaaccagaaactttaggggtgatagcccaaaagctgtgtgttaagcactacaggtgtttctgaagcactttaagatttgagatccactgctttaagtgataccatctgacatcagtttatctgcctgtgtgaaataaagtcttttactgcacaggtgtctacaacaggggccaccatcatcgctaccgtcaacgtggttggatgtctgaaagaagaagctgagtatcaatgttgactctcactcatgtcatcttattaaaaaaaaaacagtttacaaaacaattgctactgataaatgcagtgtgaaagactggttttaaggcactggtttaaggcactgctttatgtccacccagataacttgagtttttaactaaaagtttcaaatcactatcttctttatacttactaaagttcgttttgcagaagcagatagtttctaagaatgatcatttcatggaaggagatataaaataaaataaaaccagtacttaaactctgggaatgtaataggccatgtacatagcactcaacatgtgaatccaggaatccttctaagaggtctagatttagtatggttaccttaataggacaaatggtaaagaaataggtgttcccaaactctgccaatcttatgaaacaaagagtcaactctttacctcattatttgctaatgacacaaatgcaaagacatcttttgaaaagaatgtgttgggactgttttatgctgtaccttgaatgtgtatctctcttttttttgctatatttcaaagatttaatgtaagttgtcaatgtcattgagttcttgttatcaatagggatgatataattttatctaacatggaatccattttaactttgttatttctgaatttctatgaaaccacaaaaaccttcatacttgaatttatttattcttggctaaagattactcccagtttgtgaggaaatttatttctgagtttccaaagcttggagaatttattggatattaaatacctgttataaattattgatgagttaattgcaagtagcagacacaatgatattgaatttcactcccaatacacattgttttaatgaagattaaggtaaatatgtttataaaatttagtctggctatgcttaaacctgaaatagcagaatggcaaaaaaccccaaagctgtttatggacccaaattgtgaggagggctattattttaatacttgtgtaataatagaatgcacttgatgtaaattgtaatagccatcaactgcatttcaaaaacctttcgctagccactacaatttagaaagcttttcagtgtcagttagttttacaacaaatgccttttctactttctacaagtcacaagtcaaaaaaaagtaaattccaccaagttttattcaattagttttcaaattgcatgaagcaaaaaatagatttttagagacaatatataaatagaaaaaatattgtaaaagtctactctattaccttatgtaccacaaaaaaataaagtacaaaggcatgaaaaacactattatttcccaaagttcaaagggaattgttttctacgcaactactgctactaacaaggggacaacaaccccctccacttgccacgtatttttattctcttttctttatatctttggagttaaatgtcttttatgtttttcatgaaatgtattctataattgttgtatttcatgtgtgtaacattatgtcagttgttttaacaattatcttatatcttgaaattctttatgcctgattgtactgtgtcttcatgaagaaatttcttatcaaatccaatgtgattacacacttactgctgtaaaggatgcgcattatgtagtttttaagtaaaaactatagtgagaattctataatcacattcacactcccctctctattgtatgaaaaatcttgttgttgttgattagataaggtggatattcactcatagttaatgtcaaatctctgcagttaaggattgaattaagccctctggtgcagtacctaatgatcaaaacattttttccaataagtttatataaccaaggataataatgatataaaaggtttttaatgttgtttttaagagcaggtactataacaaagaaggttaacactggtacagaaatatttcataaaagttatgaaaaccagataaatacagtattaaattttggagcttttatctgagttgagagatttagtctacattgactgagatgaaatgatgaactcataattttcaatttattatcagaataataagtgacatttacataattaatttttttctgggccattttgtataagtcatttaggactattttaagttcactggtaaattttaaaatgtatattttcagcttttcaatttttttcaaaatagttctgagaaattacagaatcagatactaaggatattaatttaaaaatcaatttttattcagcactatttattctaacatatataaaaaatgaagccaaagtaacccgtcaaggtaaatacttgactcctaggaaaatgtgattttagtaggcatctcaagaggaagtgaaacttctcgtggtgaaattacaagaaaaacaagttattcagtggtgagaatgtgttgctctaagcaatccattagcacagactagctacttggccactcctcttccttctggagccagccctgaagagtggtcacagcatcttcatttttatccaggccaatggccatgcatgagaagttgggtagcaaaattcttgaagcacctctttgttcttgctcttctttcactgttttctcactctccacctgtaatgctcactgccagttttaccaccaagctaagtatcagcagacctccctccacagcgtgccttgccctgtagaactcctggtccttccttcagcccaaccccatccaattgcctaggttcttgttgtctcctgagatgaacaagaggcaagtagctaatttgagaacaaatgaagcagagctgaaggaaaaagtaaaacatttattttttcatatcccaaattttataattttacatttttttaaaacccattcattttcttcccagaacatttatgcttatcagtggtcttctgaatctgtgacaactcccttttcaagccccagctaagcttcttgcctcaagccagaaggaatcccagttttgagtcttgtgttaaggccatggcaggtcagtagggagattatctgaggaggtaccgcttgtgacaccttcagaaacaaaacagctattgccttacgtttcataggcccaggccctgagcaatagcaaaaagataatacttatttttttaaactgttgtttattaggtgatcgatttctaattaatttcaaaatatttaaggtaatattttaattaccgaggaagaatggtacaaacaaaatgttgtggaactggaaaatcctcagtgcttggcaacatgaaacttatttaacttattatagatgagataatgagaacatcttcagaaaagaagctatgttccttaaaacaggggtacagatttaaaagctctgtttatatggttttggtagactaagtgaagaacttgcctataaagctgagtctagatcatatagcatatccattataaagtgagaaaattgcaattttagagtattgtcaatacatccaaaaatttttacatgatttctaaatgcagatgtgtgtgtgtgtatgtctacgtatgtctctccatatgcaacaagcagttaattagtccaaatatatcccacagtgtagattagtttcatatctcagctcttcaatgtctcttcttcatttaattcactccttggtgtctagttttcctcactcttttacaaatatccaggttctatatttctgcttttctagagagctttttccctcaagaatatatttctttttctttctttctctttatttttgtttgtttttaactaacattcatatggttataacaatttgagacaagtgaaaaggaaagatctgtaaactgcctatctcctttgaaattcattgccaataatccttaagaatataaagttccttgatgccaaagaccttctcattagtgttgctgcctgttgtttcattggttccctagaacaatgcctggcacataaaagttatttgataaatatctctgctattaatgaattaataataactgcatgacaattctttcctcaattcatcattttgcttcattttctcacagttgcttcaatgtgtctgtggaactatctttccatgtgaacaaaacactctacattctcagtgtctacaaagcacatatttccttttattaaaattaaactttgagagcaccaaatcctaatgtctaaccatcatcaaactggcagatagcaccagtattctttttgctcaccaattttatgcccaggcatctactgtttctttcatgaataaaacctgacacctgtaagaggatttatcatggtgaacttctctttgttactgacattttcagcctcttgggctctcccctccttacttatacacattggcacccagcttgaagtcatactctctagaccctgggtcaatgtgggtaatgcatccaggaatccagcttaactcttccttggtctctttgatgtgactgacctttatttctacatttcttcatcaaaccagtctcacagttttgcacagtgcagatcacatgctgcaccgtgtgcttattatctcctataacaacagatgctccactgaaatgcaaaactctgtgttaagccaacaactgcttctccatcctttcctcctatacgtttcttctcactacaacttcccttctcaaccccaaagggactactggattctttactcttttattttaccccagtctatcagtcccatcctggacttccttccttctctgcttagaggaaagcaagatgctcaggtagaattgcacttatgactagatattatttacttcaaacaaattcttactattttgtcctgatgaaattcatgacagttttcatacaacagaaagcctgccctcttagaagagaagagaactgaaaagaaatggttgaagtaaggtagaaagccctcatggagttaggtggctaggccagcagagctaggcactgttctcctgttcagaattgcactcctgatactccagatgggaagcctgccatggcactaaccacagcactttttataccctatctctgctattatgagcccacattagtttttcttctgcttcagaaattgttgcaaaaaataattttattatttacaaattatttttaaaccatataaatctgcttagtttgatttctcaaaccctctaaaacttacacttcttgttgtccaatctttgcttttaattgggtataatttgaggcagaaataaattaatctcatttttaaaaatgtactagctattaataatttttaaatttatcttctaaaattggaaagtatccactttaaatgcatctgtagcaaggactttttacatacattctgtagctttattacttccattgagaactgttaaaataacagaacttacctcactgtacgctggcttttgaaaaggcagcagaactgtttatctgattatcgaagtaatcatattacatttctttttcttttctaagagaaaccttcttcatgtgctcagtcaaacattttggtgtttaagaattgacttattaggtcaggcgcggttgctcacgcctgtaatcccaacactttggaaggccgaggcaggtggatcacttaaggtcaggagttcgagaccagcctggtcaacatggtgaaaccccacccctactaaaaatgcaaaaaaaaaaaaatagcaaggtgtggtggtgcacatctgtaatcccagctacttgagaggctgaggtgggagaatcatttgaactcgggaggcggaggttgcagtgagcagagatcacacgactgcactccagcctgggcgacaaacaagaatctgtctcaaaaaaaacacaaaaaacaaaaaacaaacaaaaaagagttgacttagttaatgaaaatatttttattaggaaattatacttctctttacaaagtatgtattatttgttgcatctatatagtctatcaattctaaaagcacactttatgcgaaaatgtagtctaggccttcagaatgtattattacaagaaagtatctatcaaccatgtttcatttgtttgcatgttttgttttgtttccaatagactatgaatattcagcttcaaatgctacctcatgattgttacattcctgttgttgaaagaacccatctctttcttaccttcttgtccctaaattgtgttcttcttataacttactttgcacataaccataatggagtgagatcatagaattaagaggattgagaaagaaaaatacttccctcattccattggcagtaatctgtgattcaaaagttaacaacataccatgtattcttgtaggagattctttcatgcttatcactgatcaacttacatgcaggttaaaaccagccctgaaaaaatgctcatcatcactggccatcagagaaatacaaatcaaaaccacaatgagataccatctcacaccagaagaatggcgatcattaaaaagtcaggaaataacacttgctggagaggatgtggagaaatatgaacacttttacactgttgctgggagcgtaaactagttcaaccattgtggaagacagtgtggcaattactcaaggatctagactagaaataccatttgacccagccatcccattacagggtatatacccaaaagattataaatcatgctactataaaggcacatgcacacgtatgtttattgcggcactattcacaatagcaaagacttggaaccaacccaaatatccatcaatgatagactggattaagaaaatgtggcacatatacaccatggaatactatgcagccatctgagcaaactatcgcaaggacagaaaaccaaactccgcatgttctcactcataggtgggaattgaacaatgagaacacttggacacagggtggggaacatcacacaccggggcctatcatggggtgggggtaggagggagggatagcattaggagaaatacctaatgtaaatgatgagttaataggtgcagtactccaacatggcacatgtatacatatgtaacaaacctgcacgttgtgcacgtgtaccctagaacttaaaatataatttaaaaaaaaaaagccctaaatgcaacttgttcagataactggagccatcttcctagctctttatttctcagacagtgtgggtaagtcctgctccgtacgaatgcttatgtcagttttgaagttcagtactttcttaagagccagagtcagtcaagatgttcccttaacaagatttttcaatggggttacacattaatgagttctttttcctcctttaagtatttgaaaattttggtttaataaaaggtttaactatgatgaatttaggatcctttttcctgttacagaacacagaataatagttaatattttacatacatattgcaagttcatgttgccactaggagtgtccagaatagacgattgaaacagccttctagctactactatcaaaaaagagctttaaataacatattttaattaaataacattattttctatagctatacctcaataaaaccatcaaccaatgtttgtacaatttgatgcccccactctaagatttttagctagtgtaaatcagagtctcctatttaatgagacactttatccaatcaggttgtgtttattattcaaccagatgatcttggaacttataacaaactagtaatatttaaagctgggctttatgtgcgtgatttactgggatgtttgcttataccttgtttccaagctaaaaatattgtgaccaggtgtgttagtctgttttgagttgccatataggactacctaatgctgggtcatttataaagaaaagaggtttatttggattatggttctgcaggctgtacaaagagcatgacatcagcatctgcttctggtaatgctctcaggaagcttttactcatgccagaaggcaaggggagccagcgtgccacatggcaagagagggaggaagcacaagagagaggagacgtaccaggcactttttaacaaccagctctcacatgaactaacagagtgataac

SEQ ID NO: 1260 - DNA, 31217 bp, Homo sapiens
atatgatttattactgagttcttttggtatcccccaaattttgcacctaagccaggtgcatcccctacatcaccctagtcccagccctcttttccattcttcctcttaacatctgacattctacattcacttcactctgttacaaatcattatagatataattataaatgtgtgtgaactaagaaaaataaacaagaatttgtcctactggatactaacacacactacaatgtcatagtaatcaaaatactaggacactggcacaagaagagacaaacagaacagtggaacaagatggaactcagacacaggcccacctataatgggagctttcagtatagcaaaggagacactactaacctatggggaaaaggtgaactatttagtagttgtgggaacacactggcccattatataaagaaaaataaaacatgatccccatcaaacacaaagatgaatcccagatgaattaaagtagtaaatgtgaaatttaaaactgtaggagatgttttaagagtatctttgatatctcagtatagggaagacttcttttaaaaaagacacacaaacaaaaatacagttgatggacttcattacaaaatattaaggatttctcttcaataaaggaaaccaaggagacagttgccagaagtcagattagaggaaaacatttgcaatgcctaaaactgacaagggactactagcaggactatataaggatcacctgcaaatcaataagaaaatgatggaagcacatagtacaaaaatggacaatgaatgtgaacaggcaatttatagaaaaggaacccccaagtggctaatcagtcctaattatagccccaattattagtaattaaagaaatgcaaaataaaacagcatatttctttatgcacatgaaattggcaaaagttagaaaactggataatgtccagtgttgaagtccatttaggagttgcaggacaattagagtactgacaaaggaagttcagatgagtacagccattctgatgagaagatgagcagtgtttagtcaaattaaggagctgcatctccagcaaccctgcaacccctttctaggatacatacattccagggatgcaggtcaggcccacatgtatatgcagttccatgtgagatacaagcattgcttgcaatagtagagaaccaggaatgatccaggtatcccaggagcaatgtagatatgtggattaatatgatttggatatttgtcacttccaagtctcatgttgaaaattgatccccagtgttgcaggtggggcctggtgggaggtatttgaatcatggaggagaccctcatgaatggctttgtcccctctccgggtaatgagtgagttctcactctattagtgcacatgaaacctggttgttaaaaagaggctggcacctctttctatgtctctttctccctctatgaccatgtgatgcactggctccacttgccttccaccatgagtaaaagcttccagaatcccccaacagaagcagatgctagtgccatgtttcgcgtacagcctgcagatctgtgagccatttaaagctcttttcttcgtaaattaggtaacttcagatattcctttatagcaatgcaaaatggactaatgcatggacatataaagtaaaatactatggaagatttggaagaaacaaactggatgtacaaaattagatctataatttaatgccattttggttaattaaaaatacatgtacactggacactactacatattacagaggatctatgcaaataaaaggaaacatcaaattcattaaaatgtttacctatgaggtaggggtaagaggttagatatgggagtaaggactggagataaaagggaccaaataaatcaagggagagagagagagctcggaggcaccaatgatgatcatataatgaactgagaagttcttaaccttttgtacctgaggtccagcatgaataacaataataataatgaattagatgtggtcatctgcatggaagttcactgtctaatgctaagagaattcccaaaacatataaaaatataaagcatggtgagtgttatgataaatagaaacctgtaagatctctggaggggcattttttgtgtgaacattgccatggaatgagtccaagtagagacagtaagtagttacaggcacccaccacactgtgttgtaattatgtatagaaatatagatctgactccattatttggcaatggactctggagaatttgaacttggtcttttccttcacaaaatagggtgaataggacagtggataaacagtcttggatccagactttctggattggaagctagccctactacttcatagctgtgggaacttgatcaaagtgcttaaagtctctgtgtatgtaaaaagatgtaagtatctctcatgtgaaatagtgaaaataatagtacctacctcaaagactatgtgtgagaataaagtgagttaataaatgtaaatcctcagaatagcgcctgaccatattaactactcagttagttatcggtgttgttgttgttatgtggctgaatgcttttaacccattagaagatcaatgaacacttatcagattgaatttttcctcccttccttacattctacaaatcctagggcctcctctttacattcccacctttacagtatttcacagggtcccctgggcccgggggtcatggccagaacgcagagactttatgatgaggacggtgcccacgatgatgccgactaggcccagcaccaggcccagggcacagagcacagtctccgttgtctcaggcatctggattggctcttgggcctctgggggaagaatgaagagatagggtcaggaggtgcagtgagggtggtgatggcctgggatggttgtgggaattgaaggttatggaccagttaattggatgttaggacgaggagaggactgagacccagccagtgcggaaagctggtgcagaggacaccaggtctttggaatagaggatgccaggagattatggagagaaaagcagttgcataccccagtgcttgaggagcggctggtccaagccccagtgctccaccctgcagtcatagaagtcctctgctgagggcacaaaggtcaggtaatggaacttgtggaagctgtaatctgttctgggcaggaagaggctctcagcgacaccctcagtgaccagctccccgttgcacagccacgtgacgttgagcactggtgggaagaacttgtcaatgtggcagatgagggtgttgggctggcccagctccacaggctccttgggaaacacggtcacctcagggggatctggaaggagacagcaccaggttaggcccctcttctgggatgaatcacaaaggctccacctcttaggggagggtggtcctctacctcagccttagattttatggcagctctgaatcacagagaggggtatcacaccactgaccagcctcactctgctcacctttctctctcctgagaagagaggatgcaagcccttgctgtagtgggatcagcccatggccactaggggaagaggatcacacagcagggggcacttaggcttcctagtctgagggtggcagagaggccctctcatcccttccagttgggctacagaggaagaggcaaagatagggcgtaccgttggtggcctgagtgtggttggaacgctggatcaaggtattcaagttgttgttcaatatagcaatgttagccagcccgccctgagcctcaaaggaaaaggcttggccaaactcctccagatgccagacggtctccttcttgtccagatccacatagaacatctcatcttcatcaaattcaaacataaactcccctgttggtctatgcgtctgtacaaacgcggcataagttgacacatggtccgctgcataaagacagtagagaaaaacacgacaaaatgtcagtttgaatatgcaagtggtcaaagctagagaatgaataaagacttatgaatataaaaaggaagaaggtaagaggtcaaaggaaggacatatggggaagaagaaggagcaacaccataaaggaaataatacagagcagatgagcagttataaaaagaaaggagcaaagaacaaaatgaaaagtttatcactgataagtcaagctgcttcctggtctttgaaagtctgggcatcctgaccctacacaatagtaatagtaacaatgacagctaacatttgttgagcacttacttgtgccaggcatccttctaaatactttacatatttcactcgctgaattgtcacaataaccctatgaagcaaatacatatcatacattttacaggtaaggaaatgcagggaagttacatattaataacttgctaaggtcatacggctactggcggaactagtagagaggttttctctcccattaagatcttaatttttctatgacacagatgtaaaattgtttttagagtcatgggggtgggggaatggacattttctttttcttattatagaaaaggtagaaaaaaatacaaaattgagaggaagaagaaaatatccttcaaattttagggctcttgacagttttaaagtttctgtcttagtttatgaacatgaaactgtagaatgtatagctttgttgataatatttttcatttggggcatataaattcaaaagtacagtacagttattttggcatttgttccaaacttttgtttcctttttaaaaatatttcaacatttattttatgttcaggagtacatgtgcaggtttgttgtataggtaaactcatgacttgggggtttagtgtacagattatttcatcacacaggtactaagcattctaaacttttcttacatttatattttgatttttgttttagaggccaactagaaattattgctgagtttggaacacctgtaggatttaatttattttgtttcttagtctttattagtttgtaagaattagcaaagataagaggataaaagcaactattatcatgaaagaaaacgatgaatgtgtatgtgaaagtctgggtttagaatgataaatgcatcagagtgagaaggaactacgggactcttctgctctcacctcccaactcacagatttccctgtgagttttcagccctgacatgtggggacccagtctgtgcttggccacttacagtgacaggagaatgactccttgccactgtaattgtaagtgtctagagggtatgacctgtgtcttatttttcactgagaatgactccctgacacagtaagtggccaagcaaagagtggtatttgaaactaaacaaaacaaatcctataggtatttcactaggaaacttagcttgctcctcagtttaaaggactcaaaggactcatcaggaaaaagagggtaaaataaaaagacacaaagtcctctagcagttattggaaactcatcttcttaatacatgaatgtcccttgtactttttaaaatgctttttaaaaaacactttcacaagttctgcagtccaaagatcagccagctatggaacagattatttttcttcaaaatatcatttccattcagacaaaaatatgtattaaaagactactatatgtcaaacactgttagatgctaaatacccaaataaaaataatacatacgtcctgttctgcagacgcgtataagtcacagaaggaaacacaagtgacaggacaacagcaggttcagaaggataagtgcagatacgtaggtatacacaagatgcgaccaaacagcacatcagggaaggcttcctggggaacagatggcttcaatgtaggcattcagaaaacagggcaaaagccacttctctcagggaagacagcctgaccgggagaagatactgagtttactgtggggctattgcacttagaagacctgaaagtcatctaaggagaaataatacatagatatttgtggattatgggtggtctcaggagaggaatttaggccatagaactgagagtcattagtggcaggtgcaggttaaataagattttccaggaagagtgccaaaaatcagaattgccgagatctcagggtataatgagagaacatgatagttaagaggtggtttaaaagatgataaggaggatccaggtaaacaggagaaaaataaggacagggtagttcatcagaaagaagtggattatagtgcaaatgttattagtaactcaagtcagaggcactgagaagaacccactgaatttgaccttctgtagaggttcctgatggccaagatgagaggatcctcagggatgtaccagagacaagtcagaagcttagctccacgtgtgaggacacaaagaaagtgtctctgggacaggatgcagactgaaggcaaggttgttttttatcagttggtttgcacttatgtttttaaggtaaatgacatgtttaaatgttaagagactgggcagggaagccctgaagagacagctgagctcattaggaatttctaccaagaatactaaaaagtatttgcatctatgaagagaagcctattgtggtgtttattataacataacattagaaataactcaggtgaccgcgaacagggcaatagatacttctggttctacccagcctgacctcctctttattctacacatcttaaataaaactgtctgaagccagtgtgcatcttgtacgttatggattctaaccttccccatcactagattttggaatgacagcatcatgcacaggcttgatgtcattctccctgatttcagctacaggaaaaaggagcattcactacggtccatctctggctgagtccttgcagctatcaaaagtctaggcctcccttgcagtcctgaatctctcagaacccgaatcacaaggctatcaagaccatgcaaccctgctgtcttgagagaggaaagcttgtgaccacccacaaagacccaggaagagccctagggtcctagaagagagggaggatacagaaacactctttgcacttcgtctcctaatgcagagtccatagctcggagttcctgtaaagcagccacaaaagatagaggctggggatcccagagagataggagggccctgatagtaggtcactgtgtgcaggaatctggggaaggcagtgtatgaccctcagagctgggtctggacttcaaacttggctcgttgatctgctgtgtaaccttggaaaacttattcatctttttgagcttcagttttttcaaaataatttctaaataaaaggaataatttctaaatgaatggaatattatcttcattgaagattcctgtgagatgtaaatggggaaagaaactatgcaggagtctcataaattctggctgttattgctgttattattatgagggccagagggaacatagactatgaggaccagatagatcaatgagcccctaaaatctgtgatccctgaagcagcaattgatgtgaaccaccccatcactcaccccgacgctcctgcgtcctcctgagcactcacccttgatggccccagctcctcggagactcagcaggaaagccaaggagagggctctcaagatcacagctctgatatggaacattctgtcttcagggcgcatgttgtggggtctataattgatgactgtgagcacaggaacagtgatgaggaactgaggccgagtggaggcagatgagactgaaactgtgggcctctagcactggaaatgggtggagaggaatcagcatggctgggattcacctatcagagaaatcatagagctgacattctctgttgctgggtaaagaggacgctggaaggtgctggggaagagatgggagaattttaggtaccagcgtggtcaagagagctccagttcacagttcattttcagagttagagaaagagatgtaaaaagataagttacaccttcttctgacggcaaatgttttccattatgttccttctcccgagccccacccccatcccagacagtcagatgatctttgatgttttttggtcactatattttaaatcatgttttatgttatgttgtcaatattttacaaaaatattctgctgataattaagaatgaatgtgctatctaataaaatatataattaatctttctttcaggtccacctccctgagatacctcctttttatttaatcatttctgcagaagtgttataatttctatttagaggttttaattaacttgaatgaagttgatctttaattgtttatctattcctggttacctttgttagtgaaatttctagataatttttatttttcagatttcttagtatttgatttttcctggtatttaaacagtgtaataacatttttatctttaaattactagtcttgttatttcattttcatataagaatacccaggacagcattacctgtggtaacaatgtgcgcccatattttgatcttgtttttaagaagggtttctctaatgtttttctgttacaggtaatgttaattttttattttatattctctttaccatatttaagaaatacttttctagtctcattttaaatatttcaattttgagctatttatttgatactcatagagaaggtcacaaaacatttactatttaatgtaatgatgaagtacatatattacgttaatattttatcttatttgtggtagccttaccttgcataaataataattactaacagattaggacatgagagattctgttattagtgctttgcatgcattacctcatttaaacctcatattaaacctgagggaggtattattaatgtctactgtaaaaataaattacctgagacatcgaggaagtatttgtctaattatctatggcaggtaaatgacaaggagaaaagtcccacccaggcagttactaaaaaaactgagtttttctccacaatcctctcctggccccttaatcctactagacaccttctactacataattattttcttctcttgcattttacatgctagccttctatttacattttaatattgatttaaagaaatgatgccaatttgattttttttgaaattagaattggtggtccaacaggatcacatttataagtgtctaaagtaagaagtaatgttctttgaaagtttgtaaaaatattcactctaaacaaaatagaatcagatgctttgaaggaggtggggtctttgatgattttttttcactttcttccttatttaccagtcaatttatattctctatggactttatttttccaaagcaatttcagacctattgatctcatttgatcttaagagctttgctataaggcaggttatatcatccccatattgaagacaaggaatcgaagtccaagagaggcagtgtcgttaaagctgcatatttacatggtagggtaggtggtgtgtccacgctcccagtgtaaggtccctagactgagccctcctgaccctgatgacagtcctgtggaagaacctggtaactcctgcacatcgcaggactcacagacctctgggagaaagtaaatatgaatgggtgctaatcttaaacacacccttggacaaaggcaagacagacagactcagacctcatttgagttctgagatgggtactctaatccctctaagtcatgccactgaatgaccttttacacactaagatagcactttttccacaacagaccatgtcctgtgggtgtgtgaggtgtggcagaattggggaaatgataatccctgtagatgggccagcagaatatttgagatcaccttcagagcaaagaaaacgcataatctccccaaacatcatgacttatctgactggttaaaatgagtatcactgtctttcctccgtcatcttaagtgcatcacaggctttatattttcagacctttcatactaactttctgcctagtgagcaatgactcatacaaagctcagtgtccattggttcttttctcagactctgtccaatcccagggtcacagaagactacttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccaggtaagagccgaactgccattcttggagggtctggctcagggaacaattcctaggggacgttatctttaagggatcaaattctgagacaggctgcgggggctcctgccctaaggcagtgtcctctcttcccagctagagaaagaggttcatcccctataggatagcttgctaccctactggcctattctctctccaaggacatgggtacagtaaacagagagaggtgcccagtggtcagtgtctttggggaaaatgggaccaagaggtcctggataaccttggacagacaaggtttgcagagagagaagttggcaagtgcaggctcctgggcgtgttcatgtctgcatccagcctggaggggactcaggcagagagccctaagctggagtgtccaggctctgaggatcactgaggattcagtgctcacgaagaatgcctcttattccccagggtggagcaggagcccacatcccttggacaattaaggagagaagggagggagggggataggttttagcccctgaaggcattctcattaaaggtacttctcccagcctccccagaacttggttagggtactagagtgggttgcgacttgtaggaagaatgagatgaggttgtgtgggtgcatgacagggattgagtgtaggttatcagacagccaaggaagcagtaaccaagtgaaaaatctcttcttcctgctgcctccctgtggctggtgtaatattatggcatctatgatccattgtttttctctcaggatactctcaggatatttctttttatatatatatatactttaagttctagggtacatgtgcacaacgtgcaggtttgttacatatgtatacatgtgccatgttggtgtgctgcacccattaactcgtcatttacattaggtatatttcctaatgctatccctcccccctccccccaccccacaacaggccccggtgtatgatgttccccttcctgtgtccatgtgttctcattgttcagttcccacctatgagtgagaacatgtggtctttggttttttgtccttgcaatagtttgctgtgaatgatgatttccagcttcctccatgtccctacaaaggacatgaactcatccttttttatggctgcacagtattccatggtgtatatgtgtgcattttcttaatccagtctatcactgatggacagttgggttggttccaagtctttgctattgtgaatagtgccgcaataaacatatgtgtgcatgtgtctttatagcagcatgatttataatcctttgggtatatatccagtaatgggatggctgggtcaaatggtatttctagttctagatctttgaggaattgccacactgtcttgagataccatctcacaccagttaaaatggcgatcattaaaaagtcaggaaacaacaggtgctggagaggatgtggagaaataggaacacttttactctgttggtgggactgtaaactagttcaaccattgtactctcaggacatttctagtccaaatttacaccaacactctgagaggaaggactgcaaagtaggtaccttagttttccactgacttccacttttcctgcttacacccttcctcctagacctctccacacccctcctaggacacacctagaaggtactgacatcatgtcacctcctcatctttcagggtagcaaggttggaatctcctgaatacagcccctcaagccctaaaacctcttatctattaccttgggttcattgtccaggaaggggaggagaacttgaacttgtagtcacagaagggtgctgagaactaaccagcaggacggctcagccctgggaactgcagaggggtgaggctggggagagaggaggctggagcagcactggtgacactgaacagtgtcaggaggaagtgacggatgcagcgcccccatcccataggcagagctgtcatgtgggatgagggacagtgttgggagccaccaaggaaacccagaggtgggggagcagagagcagaagggggcatgtgatgctgggcagtgaaagggaggacgggcaaaggctgggttgaggtttgtagggggaatgagatgaggcagtggagccatgtgacagggactgagggtagattactggagctccctgcgtagaatgaatgttcaatcaaaacctgctggagggagagctggagccataggggagtgggtaaagtgggcagggctgattccacaattccctgcatgctcccccaactccacacacatccccaacctcaaacagggcacaagaccaaagggctgaggagccaggctatagcttaaagaggctgggggagaaaagcttggctgagacaacccatagggagctagaggtttttaatatatcctattctgaataagagacgaattcattcagatcagtggtttcaaaccgtgctctgggcaactcaattgctaagggttccacaaacaggataaagtttcttatatacaaaaaaaaatgaaggtttcaaattacaccataaaacccctcattgcttatgtctacttggcaggtaaaattccatttcaaaagttaaatgtacttaaaaaattacctaagactgggtaaattaaaaaaattaaatgttgcaaagaaaaaattcaaaattcttattcttgaatgaaaaacgttctcttactggtgattgaggaggagaaacaaagactaacaaatgaaaatgggagaatccacactcagagtggggcaattgaacaggcaggggcggatggatggcagaggaggaggaatctggactcaaggagctggggggctctgggcctggaattttagggtctggggcccaaggcaccaggagaagaggcaggtcaggatatctgagtcaagacctgggatcttgccttagcaatgacactggagactaaaggtggactccatggtgcccttgagcccagccctaccccatctccactatcctctgccaccagctgtgcaacttctgctaggggtgaggttaataaactggagaagttaatttgtggagcatgaaacagatgagcagaacaatcacagcaccttaatttccccagtgtgcccaagaacagagcaggcctgaagatactcaaacagaaacaaacatgtgccgtgtcactgataattctgtgtagacacacacctgccagacactgctcatggcactccctaggaagaacagcatgtgggaaaggctgccaaaattgttcatgtaaaaattacatcaatgctgtcttcctcggtgctgcctatgcagctggcagccatctcttcctccacatcatggcctccctcagactcctcatgaaggataagatcctcaaaaagaggaccaacaagttcatgaggcaccaatcagactgaaatgtcaaaattaagcataactggcggaaacccagaggtcttaacagtagggttcgtagaaggtccaagggccagatcttgatgcccaacattgcttatgggagcaacaacaacaacaaaaaaaacatgctgcccagtggcttccagaagtttctggtccacagcctcaaggagctgaaagtgctgctgatgtgcaacaaatcttactgtgctgagatcgctcacaaaatttcctccagaactgcaaagtcatcatggaaagagtcacccagccggccatcagagtcaccaaccccagtaccagggtgcacagctaagaaaatgagtagaaagttcatgtccacgttttgtgtgtaaataaaaccataaaaactgccaaaaaaaattacatcaatgcctctaaacccaaaggactctacccccacaggtccctggttgttgtggtgattttcattgtgtaaaatactttccacatcttttgacaccaagtctttctgcagccatgtttgaaaattaactttcaggctacagagtctttcttataccaaagttgaagaaagttttaagaaatatatttctacatctcctacatgcaaaacaacaggagcaagttgaggaattctcaagaaactggtcgagaagagagagcgcttagctatggaaaagagaaagaaggaagggagggcttcctggaggaggtggcatttgaaccaggactgacatcaggatggaaatgtcagtcagggagttaagtagggggagcagctccgccctccacgtccccagctcctcccgcccctgttttttctcccagtgaccccacgtgaaacgtctccgcctcctccagccaccagcagaagggactgccttcccctcagtgctcgcccctccctagtgatcactcagtgcccctgagctcattcttttcagtaaattctctctctgcgtggtgagaaaacaggcctggagaggctctgcgacccgcttaggaccacagaactcggtactaggaaaactcctattttaaaatccagccctgggtgggaagatttgggaagaatcgttaatattgagagagagagggagaaagaggattagatgagagtggcgcctccgctcatgtccgccccctccccgcagagaattaccttttccagggacggcaggaatgctacgcgtttaatgggacacagcgcttcctggagagatacatctacaaccgggaggagttcgcgcgcttcgacagcgacgtgggggagttccgggcggtgacggagctggggcggcctgctgcggagtactggaacagccagaaggacatcctggaggagaagcgggcagtgccggacaggatgtgcagacacaactacgagctgggcgggcccatgaccctgcagcgccgaggtgagtgagggctttgggccggcggtcccagggcagccccgcgggcccgtgcccagggcgcaggagcagccgggttggcctaagggaccttagtgccgggcggaaaggggactttgggttggggattcatggggggagcccatctggagcttgtcaggggagcgagcgcggggacctggactgggctgagcatggagtgaggaggacgagagcagagagacccccgggacttcatcaggcctggcagctgactgcatgtggggtgaaaaaaggaagccacaggacagcgcacaagggtatggtgtggagatggaggtggagatggcacagcaggccacacagagaagaaacctacagggaggtagctgggtttgaggtgcttgaggggcagatgggtggtctgatgggcaggtagacagaagggtctgcagccggggaggagactgagatacatgagaccatccagggagaggggacccagggggaagagcaaaggaccggatcctgggaactggacagttgtgatttggccaagacagaaaagcctgtgaaagagaccaaaaaaacccaagtgcagtgtgaggagaggcccgcagagaagagtcttggaagctgaggggaggtgacctcagcagcacagtggacagcggtgccagtgacttgggaaggtcagaaaacagaagatggaaagtgggtttggaaaccagggagacctggggagagcaggttggccgcagcggcaggagctggaatgggagggggtgcatgaggctgagtgtggcgcatcctcctcggggctgagatggattttacttgtcttgggttccccacggctgtcacagggcagtgtctcagttcattcgtctttttccttcaggaagtctgggtgtaaagggatggagagaggtgaggtgtgtgcagtaagaggatttctcaaggatgggacaggaaggccttggagctttggcttcctcctgtgaacttgtggggtggggagcctggtgcaccaacctgagggacttgagggagtagtatcaggatgtgggattgagccctggaccttttttctagaaagaggaaaaaaatgaagggaggaggaggaggaagctggggagatcacacctttgattttcttgttcctggaaagtgaaaggaagttcacctgctatgagtgagaaggtggacacactgggtggggatgaggtgagtgacatgagcttaggaaagttgctgaggtaattggttgagagaggtgttcaaataaaaataacgcaattggcaaaaactgttactaagactttgtagaggcaccaatcagtgacatggcagcattttctttcacagtaatcaactgccagattgcagacagccctgatgccagcctaaggagtgtgggtttctcctccaggcccgcaggtccccaacctcactcctctgaagactcttctggagatcctctgtgatgcacagatctccagactcagtgcccccagactcagattccctgggtggggaggtctggggatctctgcttgtaatcagctccctagaggttcccatgtagccagataagtattgtcagaacactgaagatttttgaaaaatgaaaaagagaaggttggagatgtgtcttcagaagactactaagggtgctggctagaggagggaccagaggcagggagatgaggtaggaaactgctattatttgtcagggaaattgcaatcaaggcatgagttagaacagggaaaacacagaggcaagggagaggtggaagggggaggaaagaagtagtgacaattccagggtggatgtccacccaaatctagaagtaattgagcaaatgttttctgggcattagagaaggcaactagaacaaacaggaatccttgccttggtgaaatgtatttgaactgggtcagaaatgaggccattgggtatcaggccttaactccagcgcaccctggaggtcactgatgtggctccaggctgacctgctcctgtcaaagaatattgagcaagatgcctctcgtggaatgttctgggaccttaaaacagatacccaagtattccccctgatttcatggttcccagaagctctatggggaagaaattgtaggtaattcacaactgagatttagacataagttgaatagtgtaatggacattgagttaaccgaggtaatgaagtagtgagacacaggtgcccctgaaataaactcacattgagggaagaggctgacaatgtggatcagtctgaaaacaaggcaaaaatacaatagggagtaagggttgtgtgtcagttcaagactgtacttttacctggcccagcgccatgttagggtatttgtgttctccaggaagtagaaaggaaagaactgagtgattagggacctagaagactaatttgagacattcctcttgatgagctgttctctagggtagtcctctgaaagagctgttctctagtggatctccctgaatgaactgttctctaggagcacttgacccttttctgtgtttgttttttgttttgtgtttgtgtttgtttttgagacaggttctcactttgtctcccaggctggagtgctgtggcaccatcatggctcactgcagcctcaacctcctgggctcaagtgatcctcctgcctcagcctcccatgtagctagaactacagatacacgtaccaccatgtctggctaatttatttttctttttagagatgggttctcactatgttgcccaggccggtctcaaaaccctgggctcaagtgatcctcatgcctcaacctcccaaagtgctaagattataggcatgaccaccatgcctggccttttctgctttctgaggaggaaaaaggtactggtggcagagatccaaaagaaaagttgccagtggcagtgtggaaattcacctgagaacaacaggacaagctggggcacaaatgcaaagatgcagagggaggcaacacctggtcatctgtgagaccttcatgggacctgaagacgcagcacagaggaggaacttgaaaaaggacgggatttctactactcaagcatgtaggagctcaggatattctgtaaatatgaagattttgagtttttgtaggtgaggtaaaaaaatacataggttttttacagaataagacatgtaaagctctcttcattttctttgtattttcatgaagttattagattcacaggccaccataatgccattgtctgtatatcttaatttcaagatattatttgagtaaattttgcttcctttgtatcaagatagaactttgaaaaggtaggtaatttcacagttgatcaaatattctttgcccaaattacttttggttaaaatttctcctaaatgtgctacagagtgcaaactctgtctccctgccattccgctatatacttactaactattattttattcaagatcatgcatgctctacttgaaggtctatttctatcttttcaatgctacccttacccactagcctaatcacattattcctattttcaacatctaggaatcaattacatagtgaacatgcctaagaaataataatctgggcagatgcagtggctcaggcccgtaatcccagccctttgagaggccgagcgggtggatcacttgaggtcaggcgttggtcaagtgctcctagagaaccaggctgaccaacatggagaaaccttgtctctactaataatacaaaaattagccaggtgaagtggcaggcacctataatcccagctattcgggaggctgaggaaggagaattggttgaagcccggaggtggaggttgcagtgagccaatattgcgccactgcattccagacttggcaacagagtgacactccatctcaacaaaaagaaagaatgaaagaaagaaagagcgagattatgtctcaaaaaaaaggaaggaaggaaggaaggaaggaaggaaggaaggaaggaaggaaggaaagaaggacaatctcaaattctatttcattatttttcttccacgctcctagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggagtgagtctctgatgaccctctagaccccacctctgaagagcaggggactctctggctctggggtccactcatcttatcttctgcatctataccctggggccatgtccaaaccccatctttcttctataccagctcctgagcatagtttgaagccagggaaatggagacttcctgaccttggcttaggggttcctgaagattcatagttctcccccttgtcagagaatctagggacactgactggtctcgaaaccctcacacttaggaactgacctcacacataggaacagttctcttccttcagcattttagcctcttctcaggcattttgagaggcaacttccagaatcagcatttgccaccttgttgaggtcacacccctgttccagatatgagggtggctctttctgaatttcctcttagcaagctttttccgctgcactgtcctcatcccgatatgctgcatcaggctccagaatctcagacaggacatgagtagggatgcagctggtggaggtgacactaaacctgggtctgtccttcccagaggcacagtctgattctgcccggagtaagacattgacgggagctgggggcttcgtgctggggctcatcatctgtggagtgggcatcttcatgcacaggaggagcaagaaaggtgagaaagcctgcagggtgagcgggacttaccttcccctggcatattcacacttattccacgatgaggggtttgacagaaaagaaatgtcagaaagctctagaggccactgatatcagataatcggggaacaaacatgacctatagcgagagagggatcccaggctgggatcttaatgcagccagatgcatgaggtcccaagtactcaggctcctgcggagcgtccattgagtgatgggcaatggaatttggtgggatggaaatgtttctctaattatctgaggtggtttcaatggctgattatataacctttcgtctttcatttcagttcaacgaggatctgcataaacaggtaatattcctgctttgatttccttgtggggtgggttgcaggaggatatgagtcctttctgtgcattgtaacactgaggctcctccaggaagggaatctcaggcatgaacccctctttcaatgtcagccttcaggcaagtggggaaagagcattgcttggctccattgctgaaggaagcagagatcaactctgttatttatcagcctgagacgcatcctctcaccataatttttctctcctggacttacaggaaggaggctggcaacctgggataacttgtcttttacccccacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaaccattttctttgtgtgccatcacaaatactccttaaccaaatacggcttggacttttgaatgcatccaatagacgtcatttgtcgtctaagtctgcattcatccaccagcctaggcctcctgtcttaattttcatacagacagaaatgactccccactggggaaagagcaaagcaatacatgtagcactctttttcaaacactggtctttttttttttcttaacaatccaacattgttatgtgttttgcgtctcatattgacaccttttggtcaaggtagaggacatgtttgttgtaagctttctttttcgtgtagaggatggattcttcactcctgatacacacaatcagtgcacagcagctctcttatacatccagttgatgccttcagtctccctggcttcttacaagcatcttctgggccttgtgtgtccctgggcacctgtccctggtcaattcccgaaagctactgtgctcctcttgcccatctccccttgcaaataatatcttccatcgggggaccggcttcctccaatttcaggagaggtggggctgaaggcacagacttgggcgtcactggcacagatataagtaaatacagctggagtctgcagagaggctggactgagtcagggagtcaggaaagagaagccacacacaaggacaaccaatcatgtttctcataatcttcttaacctagggaataggacacaatcattttttctttttaaaacatctttatccctgatcagcctcatttcctcaaaaactataaaggaaaatgctgctgacttgtttttgcgtagtaatttcagctgtcacataataagctaaggaagacagtatatagtaaataaggaccctttatctgtcttattttcccttttggcttcacaggaaacttgtgagaaacctatgcagcataaaattaatatgatttcaatccagggattcaacgatggaaggaggtcatgagaatagcagaaagtcttcaaatcgagatcattatgaaatcctcagacccagagcacataaatcctaccctcagagtcactgagcagttaacattacaaattacaaaccatatccagtcagagtcattctctttcctgcttgtctcctgtactcatgttacaggttagggcagtaccccgagtggagtgaacaatctctggactaacacttgtcaggatcagaagctgaggtatctgcacccacattacaggaacaggatatgtgctcctagggaactgagggtgtcaggagatgaggaatgtccctggagtcacagaaagaaggtatcagatgtgtctcactctgacatatgcaggtgtttatgaaactctgggatttctaaggaaggatgcagtgcagagacaggtcccagaggagacaagagctgagagaccatccaaactgggaccaccttgtcactagacttcaaattttcaatattgatagagtgttttctaagagtcaggccctttgctgagtgctatgtgcagcaggatcaaaggcagccaggaggtagaggagtcttgaggtacatcagtcattggagttgaagagcagagattcaaaggaaagttggaactggagctttaaaggagatgtgaagtgggtgactcaacctctgactcagaaaaattgatacctgcagaagaaaaaacccggcgggcttaggactcccagctgagtgttgtatcctccatccctttccacctggtcccttcattttctacccctcacagttccctaacgagaaggtggtccacccaacagacaacactgcctcagatggttatcaaggggtaccctaagaagaaatcatctcaccctctctttgtccccatttgtcaagtagcagtgaggccgagccaggggatggtgaaagtggaaggaggtgggagttgggcatcgggtgtgaagatgctcttgaaaggggttttaataaccacttgctaccaggccagtgaacacttaccatagttgatgccttttgagcatgttgcattgtaaactgtccctgaaattactgtgcacttggcttatgggatgaaacatcctcctagttcttttgtctctcagcttctctgaagtctcattgagcaccttctcttcaatttcttttacacagtaagaataggatcagctgtgctaaactaacaaatacccagatatccaggtttggctcatgttacacgtccaaagtaagtcatgcaggaagctctgctcatcatcgtactcaggaagtcaggctgacagtctttctcctgcacatctgctcccagaacctccccagcagaatgaagggaacctaagaatttattcactggcttttaatgatccctcctagaaagaacacacttctcgcatttcattttccaatgtaaatcatatggctgcaactaacttcaaataagtgggaatacttgaaggtggaaaacatttaagaagtacacactaaataaataataaaatacttctacaagagatatttatggaggacctactgtgtaccaggagcaatgctaggcattatggatatcagcagcctttggctcctgaaaagcttacacactacctcctggcctaaggaggggcacagggatgctggcaacagtctatttcttcacccgggtactagttacatgggtgcttgcggtgataaccattcaacgtacattctattggtttgtgtgtttcttccaaatgtcccctagttcacaatagaaagggcttaaatagagaagtaaaggagaatttgggaatttgaagcaaaagcaagaagccactgaatcaagcacaaatattgagctttgataaagattggaataagaaacataataaatgagacaagaaataggacttttgcaactgaagtgtaattaataaacaaaaagccaaactgagaaactgtcccaaggacaatatgatcgagtaaacaatagaaaatgtaaaggacaagtgaagagaaatgaaggatagaaacagacatctgacatcttaataattagacgtctagaaagtcagggaaatagtggaggaagaggaaataactgaaaacataatagatgtttagtctttatagaaagatgaaataagttcattcaaaatgctgcatagaatgtcagactgttaaacaattttgttagagtaaaatgactgtaaacaaatgagctaattatgtgaattaagaggatggaaaagcagaaaaacagcaaaaagaaaatacatgtaaataataaggacaaaagctgaattcaatgaaatataaaaatagagaagataaaatcaaattttgaggcaatgaaaactttaatgagacctctggcaagactcctaaggaaaatacaggagattcagaacgaaaagggtaaatgacatttatacacattttaaaatgcaaaatcttacgaccaactctatacatataaatttgaaaatttagataaaacggatacgtttctagaaagatataaaggtcaaaactacaggaagaaatagaaaactaaaatagagtagagaatatcaaagaaattgtcatgggaagcaaagaatcgccttccaaagggccctgtcctgatcttattgcagatgagggtgtcctcccacatttccaggagcagatcatgcctcttacacgtgtgattctagaacatagaatggaacagaatttttgagatcattttatgaggttggttcatttatatttccagagccagctaagaatagtacaggagaacaggattgtggactaattttagccatgtcactgaatccaacagtacattataaaaacaatacgttttgaccaattttagatttattctaggaatgcaatgattcttcagtgtcagaaaatatataatgtggttaacacattagtggactccgcaaaattcatattaatttaaactgaattcagctcaagacatagacagaatttaatcaatttcatgacatgttaaaggtagtgaaccaaaaatctatagcatatatatttcaaagaaatgaggtggattgcctttgagattgtgcaaaagataggatgtccttcgttgctggaaatgtttaacatagcattggaagttctgaacatcactctgcgggcagaagaaaattaaggctgtgtaaaatgtaggaagacagatagtgactgcagatgaaataatctaaatactggacaagactgcagccactgcaggcccaaagcctgggtttaaatccaagctttgcactttgaagctgtgtggtcttcacctctcccggtgtctgattcctgctctgtaacatgaaataaataagaaccaacctccagatgtaaataagtgaacacatgagaagcacttagaatagtgcctagaacatagtaagcaactcaatgaatgtcatttctcattacatttgttaatgtttttatccagcccaatggcagtaaaacatcaatgctcaaagagcccctggtgaagtgtttctctttcccactcttcacccctaacttgttacctcgtcttttccactctgtccctaatacacctataggatgactcataggagcccctggacccggggatgctgtcagatcgcttggtctttgagacaatggtgccattaaggacccccgccaggcccaccagcaggccgagggcacagaccagcatctccatggtctcaggcacctggattagttcatggacctctggggcaccaagggaagacagagttataaggtacagagagcaggggctggccttggatgtgggaggtgttgggtattcgaaaccatgagatggtgaaatttggataaagtgaccataaaacatgggattgaggaaggcaggtgctgaggggcgatgggcccaggaaataaaggtggtgccaaggccgtgagggcagagggagggcgctccataccccagtgcctgaggagaggctggtgcaggccccagtgctccccctggaggtcacaggtgtcctcggccatgggaacgagggtcagatagtggaacctgtgtaatctgagtttcttgctgggcaggaagatggtctctgcaataccctcaatgactggctccccattgcgcagccacgtgatgttcagcactggtgggaagaacttgtcaacatggcagacgagggtgttgggctggcccagatccacaggctccttgggaaagacgcttacctcggtgggggctccaaaaggggatagaacccaaggagcctactgccattggctgattcttaaaggttccaccaccccaagtcctatattcaccagattaggggccacctctcccaggcccatcctcctgctcccctagggctcctggacagggtcacagcttctcgtgctcctgacctggccccctcagcccagcctttctcttgagtaagaagaaaatgcctcctcctctgctgtcctaagaacccagctgtgtggacccaagatttctcgctctcagggaaggggctcattcatgagtgggcatcatggcctctagttctatgtgtggcagagaggccctcccatccctccagctggactctagaggaacaggcagctataggcagtgccatttgtggcccaagtctgtttggaccattgatccgggtgttcaagtgcttccttgccatgacgatgccagcaatacccctctgagaggaacaggcagctataggcagtgccatttgtggcccaagtctgtttggaccattgatccgggtgttcaagtgcttccttgccatgacgatgccagcaatacccctctgagcaccaaagtcaaaggtgtgaataaactctggtagaggccagaccatctccttctcatccaggttcacgtagaactgctcctcctcatcaaattcaaacatatactccccagagggtctgtgcgtctgcacaaactccgcatatgttgacacatggtctgctgcatgaaggagaagatggagaatgggtgaatacgtaggatgctacacagaatgcaggaagcaaacaggtaacaggaaggttattgggaacatgaaggaataacacagaaaatgagaaatgcaaatgaaagaaaagaaaaggagtgagaagaaacaaagacagaaatgacccatggacgatataggttgtttcccttgtccctgaagacttaacatccgtctatgataatggtaatgctgaatacagtaagataatatttattgggcacttactatgtgctaaacttactcattgaatcttcacacccccatgtagaagaacttattttccatagtagggaactgaccccagaggtaaagtaacttgtccaagtcacacaactcctggtagaaacaatattgagtagtcctcctacctcattcctgtaggatctcagaaaccctacaggacaatacattaaaaattactgatatagccataaagcaaggcagggaagtggaaggatggaataaatatttcagagtggaacaaaatcgtgaaggacatgaaaatacctccagagtcttagtgacatttatagacttcaagttacattcttacttttagaagaaaaatgataccttctataattttatccacaacacttacattttaggcagagtaaatttaaaagtattatcattcacataacattcacaaaattgtcttgtggagtgtagttttcaagtgtagtttcacctggaaatacaagttgttggcatttgaaagacctatgggatagtatcttagctttacctgatacataagaagcagcaactggttgataacaaaaagtgaattattattacagtgaattacagagagtttagggttcggcctggaagaggaagtgaagccaaatgacactgcatggttggtggtccctaagtgaggatttcccctcccagcccagcatggggagaaccagtcctctacttagatgcatagtgtgacagcaggttcagtgccgcacacggatggtgagggtcccccactgagtttagggtctagaggattactcacctacagaaatgaatcccaaaggaaaaagaaaaatacatggtgtatagactgggctacacagatgtaattggttcagcttaggttactttgtatttattatatttacaaaatctgaaaactaaaggttggcacattttgaagcaaattccacacttcaaatgttaattttcattcagttaataaatgctttttgtgaactttcactctctaggtaataaggatgaaactctaaagatgggaactttgtccttaatctacttgaaattcaagaataaaacagacaaagaaaagatgattgctacatgtgtggtttgatcaccactgagtatcacaaggtatacacaagagctactcaggagcaaaattaaaatacgatttaggaaaggttcctagggacagtgttcacctgcagatagcaaaacagagaaaggggaaatggcatttccagcaggagaagcaggctcaggagcagagaggcatgaagttgcaaggagaactgcagttcttcagtgtgactgaagccaggggagatgtgggccaggcagcactgtaacctgccttgtgtgctgatggcaagtgtttgcattttatcccacaggacataggaagttgtgaagtatcttaagcaggagagtaacacggtcagatttgtgtttggatggggcacctgtaggaaggatgggctggaggaggcgggactcaaggcaagaccagtagcacttttaagccctctggtgggaagtaatgaaggcgtaggccagggcaggaacatggggtgaggaggacagcagatggatttgatggcagtaatgacatgagaggccacaggaatcactaaatcacatgccagaagtagggatatgaagaagtcgagaataaccacgcaacgtggagaattgtggcatccgtgcctgcaaaggtgataattaagtgattgagagaaggtaaaattttctgtttgagacatactgaatttaaacttctaggggaaaacatacagttgatttgaaggcagtgaaataaatggatgagtgtcatgctacattaggttagtgacataaactggaaggaggctcatggtgggtgaagttctaattttgggtcaggtcactcaagaaaagtacacaaagtcaggatagcagggatctgagtgtgtgctcctgcatccagacaaacacagacatgaagaaagaggctgaaaagcagaggactagaaattggtaggaaaacagagaggaagtgggttcataaaagacaagagacaggagaaaacttccaggaaagaggagagggggcatctcaaacacactaatgacacacataagacagaaacagaacagtgaccactggcttgagttgtataaaagtcattagttgccaccctgagaggagcatcagagatgagggaaagaaaaagagagagtacattgggttgaggactgaatgaaatgggagaaaatcgataataggctgggcacagtggcccatacctgtaatctcagtgatttgagaggccgagacaggaggatcacttgaggccaggagtttgaaagcagcctaggaaacatagtgagagtccatctctaagaaaacaattttggattccctgccttccatgagcaacacagcaaacataagctctgcagatgtgctcagacttgagcctgactcactgaagagagtgtggtgctgccaggcctcagacaccagattataatcaacctcttcccaggccctgcacaggagaggcccactctgtggggcatacagtgcccaggggtggtacaggccctgcagagaccacagactgttcacctgacaagaaatatcttgaggaactcacttcacagatccctcaagaaaggaaccactgcaggagaatacccagaaaatcgaaagaattcacagatccttttaaagaagggaggggccactgcaaactccaccagacaagtgaaaaactgtgcgttcccaaagcgtgagaggggaaaaacctgcctccggacccatgtccccactggggaactcgaaaatccagattacaggaaaaggatttaactttacctagacctgaaacagatttagcatgaaatacaaaagtacgccgggcgctgccgctcacacctgtaatcccggcactttgggaggccgaggcgggcggattacaaggtcaggagattgagaccatcctggctaacacgatgaaaccccgtctctactaaaaatacaaaacaattagccaggcgtggtggcgggcgcctgtagtgccagctactaggaaggctgaggcaggagaatggcataaacccggaaggcggagcctgcagtgaaccgagatcgcgccactgcactccagcctgggtgacagagtgagactccgtcgcaacaaaaagaaaaaaaaaatatatatatatggtagatgcagcagtgagaagagccttgtaggcacgcccagtctttagctcaagcccagggaagccacccctgactatatctcacaagggccctgggggaaggcagacggcaaaatttggaaggggtcacagtgtgaaaggagcgtccaactgaaatttgttataattctgactgggcacaaatcctctggagcagaatctgggggcgaacggaactgctggagaaagagcagaagttactgccaacattgtgggcagacagggaggcacatggcctgaaagctgtgcttgctttctcagcaggaaacttatagcctggagtgaggtctgagtccatcctgaaggctgcagggagataaattcaatgctgttagtgtggcacagcaggagcaaaacctgcctcgccaactgcatgggagctgggtgaagcctattgctaccaggtttcccctacttctctggtgacagaggcagccataatgccctctggaacataattccattggctggagaaaaaccctccgccccatccctcacagtggctgccgcaagccccccgcccgaggagagtctgagctcagacc
